US009834782B2

(12) United States Patent
Poraty-Gavra et al.

(10) Patent No.: US 9,834,782 B2
(45) Date of Patent: Dec. 5, 2017

(54) ISOLATED POLYNUCLEOTIDES AND POLYPEPTIDES, AND METHODS OF USING SAME FOR INCREASING PLANT YIELD AND/OR AGRICULTURAL CHARACTERISTICS

(71) Applicant: Evogene Ltd., Rechovot (IL)

(72) Inventors: Limor Poraty-Gavra, Holon (IL); Ilya Pankratov, Rehovot (IL); Hagai Karchi, Moshav Sitriya (IL)

(73) Assignee: Evogene Ltd., Rehovot (IL)

( * ) Notice: Subject to any disclaimer, the term of this patent is extended or adjusted under 35 U.S.C. 154(b) by 85 days.

(21) Appl. No.: 14/403,657

(22) PCT Filed: May 27, 2013

(86) PCT No.: PCT/IB2013/054374
§ 371 (c)(1),
(2) Date: Nov. 25, 2014

(87) PCT Pub. No.: WO2013/179211
PCT Pub. Date: Dec. 5, 2013

(65) Prior Publication Data
US 2015/0167015 A1 Jun. 18, 2015

Related U.S. Application Data

(60) Provisional application No. 61/721,197, filed on Nov. 1, 2012, provisional application No. 61/652,267, filed on May 28, 2012.

(51) Int. Cl.
C12N 15/82 (2006.01)
C07K 14/415 (2006.01)

(52) U.S. Cl.
CPC ........ *C12N 15/8261* (2013.01); *C07K 14/415* (2013.01)

(58) Field of Classification Search
None
See application file for complete search history.

(56) References Cited

U.S. PATENT DOCUMENTS

| 6,084,153 A | 7/2000 | Good et al. |
| 2002/0046419 A1 | 4/2002 | Choo et al. |
| 2004/0214272 A1* | 10/2004 | La Rosa ............... C07H 21/04 435/69.1 |
| 2005/0108791 A1 | 5/2005 | Edgerton |
| 2006/0179511 A1 | 8/2006 | Chomet et al. |
| 2009/0094717 A1 | 4/2009 | Troukhan et al. |

FOREIGN PATENT DOCUMENTS

| WO | WO 2004/081173 | 9/2004 |
| WO | WO 2004/104162 | 12/2004 |
| WO | WO 2004/111183 | 12/2004 |
| WO | WO 2005/121364 | 12/2005 |
| WO | WO 2007/020638 | 2/2007 |
| WO | WO 2007/049275 | 5/2007 |
| WO | WO 2008/075364 | 6/2008 |
| WO | WO 2008/122980 | 10/2008 |
| WO | WO 2009/013750 | 1/2009 |
| WO | WO 2009/083958 | 7/2009 |
| WO | WO 2009/141824 | 11/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |
| WO | WO 2013/027223 | 2/2013 |
| WO | WO 2013/078153 | 5/2013 |
| WO | WO 2013/080203 | 6/2013 |
| WO | WO 2013/098819 | 7/2013 |
| WO | WO 2013/128448 | 9/2013 |
| WO | WO 2013/179211 | 12/2013 |
| WO | WO 2014/033714 | 3/2014 |
| WO | WO 2014/102773 | 7/2014 |
| WO | WO 2014/102774 | 7/2014 |
| WO | WO 2014/188428 | 11/2014 |
| WO | WO 2015/029031 | 3/2015 |
| WO | WO 2015/181823 | 12/2015 |
| WO | WO 2016/030885 | 3/2016 |

OTHER PUBLICATIONS

Rhoads et al., J Biol Chem 273(46):30750-56 (1998).*
Hill & Preiss, Biochem Biophys Res Commun 244(2):573-77 (1998).*
Guo et al., Proc Natl Acad Sci USA 101: 9205-10 (2004).*
Zhang, Curr Opin Plant Biol 6:430-40 (2003).*
Egli, "Introduction" in Seed Biology and the Yield of Grain Crops (ed. Egli), pp. 1-14 (1998).*
Whisstock & Lesk, Q Rev Biophys. 36(3):307-40 (2003).*
Marechal et al., BMC Plant Biol 8:42 (1-15) (2008).*
GenBank NP_196470 (2000).*
Rasmusson et al., Mitochondrion 8:47-60 (2008).*
International Preliminary Report on Patentability dated Dec. 11, 2014 From the International Bureau of WIPO Re. Application No. PCT/IB2013/054374.
International Preliminary Report on Patentability dated Mar. 12, 2015 From the International Bureau of WIPO Re. Application No. PCT/IL2013/050725.
International Search Report and the Written Opinion dated Sep. 1, 2013 From the International Searching Authority Re. Application No. PCT/IB2013/054374.

(Continued)

*Primary Examiner* — Cathy Kingdon Worley
*Assistant Examiner* — Russell Boggs

(57) ABSTRACT

Provided are isolated polynucleotides, polypeptides encoded thereby, nucleic acid constructs comprising same, plant cells and plants comprising same and methods of generating plants with increased yield, biomass, growth rate, vigor, oil content, fiber yield, fiber quality, abiotic stress tolerance, and/or nitrogen use efficiency, wherein the polynucleotides encode polypeptides at least 80% identical to SEQ ID NO: 574-930, 6266-10549 or 10550, such as the polynucleotides set forth in SEQ ID NOs:1-573, and 931-6265.

24 Claims, 8 Drawing Sheets

(56) References Cited

OTHER PUBLICATIONS

International Search Report and the Written Opinion dated Nov. 19, 2013 From the International Searching Authority Re. Application No. PCT/IL2013/050725.
Invitation to Pay Additional Fees dated Oct. 16, 2013 From the International Searching Authority Re. Application No. PCT/IL2013/050725.
Invitation to Pay Additional Fees dated Jul. 17, 2013 From the International Searching Authority Re. Application No. PCT/IB2013/054374.
Bennetzen et al. "Setaria Italica Strain Yugul SETITScaffold_2_Cont751, Whole Genome Shotgun Sequence", Database NCBI [Online], GenBank Accession No. AGNK01000751, May 11, 2012.
Briggs et al. "Poly(ADP-Ribosyl)ation in Plants", Trends in Plant Science, 16(7):372-380, Jul. 31, 2011. p. 378.
NCBI "Predicted: Nudix Hydrolase 16, Mitochondrial-Like [Setaria Italica]", Database NCBI [Online], NCBI Reference Sequence: XP_004955808, Jun. 26, 2013.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Yu et al. "Cell Cycle Checkpoint Protein MAD2 Homolog [*Zea mays*]", Database NCBI [Online], GenBank: AAD30555.1, GenBank Accession No. AAD30555, May 17, 1999.
Examination Report Dated May 13, 2016 From the Instituto Mexicano de la Propiedad Industrial, IMPI Re. Application No. MX/a/2014/014542 and Its Translation Into English.
Examination Report Dated Dec. 1, 2016 From the Instituto Mexicano de la Propiedad Industrial, IMPI Re. Application No. MX/a/2014/014542 and Its Translation Into English. (8 Pages).

\* cited by examiner pQFN, pQFNc pQNa_RP

ISOLATED POLYNUCLEOTIDES AND POLYPEPTIDES, AND METHODS OF USING SAME FOR INCREASING PLANT YIELD AND/OR AGRICULTURAL CHARACTERISTICS

RELATED APPLICATIONS

This application is a National Phase of PCT Patent Application No. PCT/IB2013/054374 having International filing date of May 27, 2013, which claims the benefit of priority under 35 USC §119(e) of U.S. Provisional Patent Application Nos. 61/652,267 filed on May 28, 2012 and 61/721,197 filed on Nov. 1, 2012. The contents of the above applications are all incorporated by reference as if fully set forth herein in their entirety.

SEQUENCE LISTING STATEMENT

The ASCII file, entitled 60821SequenceListing.txt, created on Oct. 29, 2014, comprising 23,825,924 bytes, submitted concurrently with the filing of this application is incorporated herein by reference.

FIELD AND BACKGROUND OF THE INVENTION

The present invention, in some embodiments thereof, relates to isolated polynucleotides and polypeptides which can increase the yield (e.g., biomass, grain quantity and/or quality, seed yield, oil yield), growth rate, vigor, oil content, fiber yield, fiber quality, abiotic stress tolerance (ABST), water use efficiency (WUE), nitrogen use to efficiency (NUE) and/or fertilizer use efficiency (FUE) of a plant.

Yield is affected by various factors, such as, the number and size of the plant organs, plant architecture (for example, the number of branches), grains set length, number of filled grains, vigor (e.g. seedling), growth rate, root development, utilization of water, nutrients (e.g., nitrogen) and fertilizers, and stress tolerance.

Crops such as, corn, rice, wheat, canola and soybean account for over half of total human caloric intake, whether through direct consumption of the seeds themselves or through consumption of meat products raised on processed seeds or forage. Seeds are also a source of sugars, proteins and oils and metabolites used in industrial processes. The ability to increase plant yield, whether through increase dry matter accumulation rate, modifying cellulose or lignin composition, increase stalk strength, enlarge meristem size, change of plant branching pattern, erectness of leaves, increase in fertilization efficiency, enhanced seed dry matter accumulation rate, modification of seed development, enhanced seed filling or by increasing the content of oil, starch or protein in the seeds would have many applications in agricultural and non-agricultural uses such as in the biotechnological production of pharmaceuticals, antibodies or vaccines.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing consumption of plant oils as bio-fuel is the oil price, which is still higher than fossil fuel. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants. Genes known to be involved in increasing plant oil yields include those participating in fatty acid synthesis or sequestering such as desaturase [e.g., DELTA6, DELTA12 or acyl-ACP (Ssi2; Arabidopsis Information Resource (TAIR; Hypertext Transfer Protocol://World Wide Web (dot) arabidopsis (dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. Cell. 26; 93(7):1195-205], Lec2 [TAIR No. AT1G28300, Santos Mendoza et al. 2005, FEBS Lett. 579(21):4666-70], Fus3 (TAIR No. AT3G26790), ABI3 [TAIR No. AT3G24650, Lara et al. 2003. J Biol. Chem. 278(23): 21003-11] and Wril [TAIR No. AT3G54320, Cernac and Benning, 2004. Plant J. 40(4): 575-85].

Genetic engineering efforts aiming at increasing oil content in plants (e.g., in seeds) include upregulating endoplasmic reticulum (FAD3) and plastidal (FAD7) fatty acid desaturases in potato (Zabrouskov V., et al., 2002; Physiol Plant. 116:172-185); over-expressing the GmD of 4 and GmD of 11 transcription factors (Wang H W et al., 2007; Plant J. 52:716-29); over-expressing a yeast glycerol-3-phosphate dehydrogenase under the control of a seed-specific promoter (Vigeolas H, et al. 2007, Plant Biotechnol J. 5:431-41; U.S. Pat. Appl. No. 20060168684); using Arabidopsis FAE1 and yeast SLC1-1 genes for improvements in erucic acid and oil content in rapeseed (Katavic V, et al., 2000, Biochem Soc Trans. 28:935-7).

Various patent applications disclose genes and proteins which can increase oil content in plants. These include for example, U.S. Pat. Appl. No. 20080076179 (lipid metabolism protein); U.S. Pat. Appl. No. 20060206961 (the Ypr140w polypeptide); U.S. Pat. Appl. No. 20060174373 [triacylglycerols synthesis enhancing protein (TEP)]; U.S. Pat. Appl. Nos. 20070169219, 20070006345, 20070006346 and 20060195943 (disclose transgenic plants with improved nitrogen use efficiency which can be used for the conversion into fuel or chemical feedstocks); WO2008/122980 (polynucleotides for increasing oil content, growth rate, biomass, yield and/or vigor of a plant).

A common approach to promote plant growth has been, and continues to be, the use of natural as well as synthetic nutrients (fertilizers). Thus, fertilizers are the fuel behind the "green revolution", directly responsible for the exceptional increase in crop yields during the last 40 years, and are considered the number one overhead expense in agriculture. For example, inorganic nitrogenous fertilizers such as ammonium nitrate, potassium nitrate, or urea, typically accounts for 40% of the costs associated with crops to such as corn and wheat. Of the three macronutrients provided as main fertilizers [Nitrogen (N), Phosphate (P) and Potassium (K)], nitrogen is often the rate-limiting element in plant growth and all field crops have a fundamental dependence on inorganic nitrogenous fertilizer. Nitrogen is responsible for biosynthesis of amino and nucleic acids, prosthetic groups, plant hormones, plant chemical defenses, etc. and usually needs to be replenished every year, particularly for cereals, which comprise more than half of the cultivated areas worldwide. Thus, nitrogen is translocated to the shoot, where it is stored in the leaves and stalk during the rapid step of plant development and up until flowering. In corn for example, plants accumulate the bulk of their organic nitrogen during the period of grain germination, and until flowering. Once fertilization of the plant has occurred, grains begin to form and become the main sink of plant nitrogen. The stored nitrogen can be then redistributed from the leaves and stalk that served as storage compartments until grain formation.

Since fertilizer is rapidly depleted from most soil types, it must be supplied to growing crops two or three times during the growing season. In addition, the low nitrogen use efficiency (NUE) of the main crops (e.g., in the range of only 30-70%) negatively affects the input expenses for the farmer, due to the excess fertilizer applied. Moreover, the over and inefficient use of fertilizers are major factors responsible for environmental problems such as eutrophication of groundwater, lakes, rivers and seas, nitrate pollution in drinking water which can cause methemoglobinemia, phosphate pollution, atmospheric pollution and the like. However, in spite of the negative impact of fertilizers on the environment, and the limits on fertilizer use, which have been legislated in several countries, the use of fertilizers is expected to increase in order to support food and fiber production for rapid population growth on limited land resources. For example, it has been estimated that by 2050, more than 150 million tons of nitrogenous fertilizer will be used worldwide annually.

Increased use efficiency of nitrogen by plants should enable crops to be cultivated with lower fertilizer input, or alternatively to be cultivated on soils of poorer quality and would therefore have significant economic impact in both developed and developing agricultural systems.

Genetic improvement of fertilizer use efficiency (FUE) in plants can be generated either via traditional breeding or via genetic engineering.

Attempts to generate plants with increased FUE have been described in U.S. Pat. Appl. No. 20020046419 to Choo, et al.; U.S. Pat. Appl. No. 20050108791 to Edgerton et al.; U.S. Pat. Appl. No. 20060179511 to Chomet et al.; Good, A, et al. 2007 (Engineering nitrogen use efficiency with alanine aminotransferase. Canadian Journal of Botany 85: 252-262); and Good A G et al. 2004 (Trends Plant Sci. 9:597-605).

Yanagisawa et al. (Proc. Natl. Acad. Sci. U.S.A. 2004 101:7833-8) describe Dofl transgenic plants which exhibit improved growth under low-nitrogen conditions.

U.S. Pat. No. 6,084,153 to Good et al. discloses the use of a stress responsive promoter to control the expression of Alanine Amine Transferase (AlaAT) and transgenic canola plants with improved drought and nitrogen deficiency tolerance when compared to control plants.

Abiotic stress (ABS; also referred to as "environmental stress") conditions such as salinity, drought, flood, suboptimal temperature and toxic chemical pollution, cause substantial damage to agricultural plants. Most plants have evolved strategies to protect themselves against these conditions. However, if the severity and duration of the stress conditions are too great, the effects on plant development, growth and yield of most crop plants are profound. Furthermore, most of the crop plants are highly susceptible to abiotic stress and thus necessitate optimal growth conditions for commercial crop yields. Continuous exposure to stress causes major alterations in the plant metabolism which ultimately leads to cell death and consequently yield losses.

Drought is a gradual phenomenon, which involves periods of abnormally dry weather that persists long enough to produce serious hydrologic imbalances such as crop damage, water supply shortage and increased susceptibility to various diseases. In severe cases, drought can last many years and results in devastating effects on agriculture and water supplies. Furthermore, drought is associated with increase susceptibility to various diseases.

For most crop plants, the land regions of the world are too arid. In addition, overuse of available water results in increased loss of agriculturally-usable land (desertification), and increase of salt accumulation in soils adds to the loss of available water in soils.

Salinity, high salt levels, affects one in five hectares of irrigated land. None of the top five food crops, i.e., wheat, corn, rice, potatoes, and soybean, can tolerate to excessive salt. Detrimental effects of salt on plants result from both water deficit, which leads to osmotic stress (similar to drought stress), and the effect of excess sodium ions on critical biochemical processes. As with freezing and drought, high salt causes water deficit; and the presence of high salt makes it difficult for plant roots to extract water from their environment. Soil salinity is thus one of the more important variables that determine whether a plant may thrive. In many parts of the world, sizable land areas are uncultivable due to naturally high soil salinity. Thus, salination of soils that are used for agricultural production is a significant and increasing problem in regions that rely heavily on agriculture, and is worsen by over-utilization, over-fertilization and water shortage, typically caused by climatic change and the demands of increasing population. Salt tolerance is of particular importance early in a plant's lifecycle, since evaporation from the soil surface causes upward water movement, and salt accumulates in the upper soil layer where the seeds are placed. On the other hand, germination normally takes place at a salt concentration which is higher than the mean salt level in the whole soil profile.

Salt and drought stress signal transduction consist of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The osmotic component of salt stress involves complex plant reactions that overlap with drought and/or cold stress responses.

Suboptimal temperatures affect plant growth and development through the whole plant life cycle. Thus, low temperatures reduce germination rate and high temperatures result in leaf necrosis. In addition, mature plants that are exposed to excess of heat may experience heat shock, which may arise in various organs, including leaves and particularly fruit, when transpiration is insufficient to overcome heat stress. Heat also damages cellular structures, including organelles and cytoskeleton, and impairs membrane function. Heat shock may produce a decrease in overall protein synthesis, accompanied by expression of heat shock proteins, e.g., chaperones, which are involved in refolding proteins denatured by heat. High-temperature damage to pollen almost always occurs in conjunction with drought stress, and rarely occurs under well-watered conditions. Combined stress can alter plant metabolism in novel ways. Excessive chilling conditions, e.g., low, but above freezing, temperatures affect crops of tropical origins, such as soybean, rice, maize, and cotton. Typical chilling damage includes wilting, necrosis, chlorosis or leakage of ions from cell membranes. The underlying mechanisms of chilling sensitivity are not completely understood yet, but probably involve the level of membrane saturation and other physiological deficiencies. Excessive light conditions, which occur under clear atmospheric conditions subsequent to cold late summer/autumn nights, can lead to photoinhibition of photosynthesis (disruption of photosynthesis). In addition, chilling may lead to yield losses and lower product quality through the delayed ripening of maize.

Common aspects of drought, cold and salt stress response [Reviewed in Xiong and Zhu (2002) Plant Cell Environ. 25: 131-139] include: (a) transient changes in the cytoplasmic calcium levels early in the signaling event; (b) signal transduction via mitogen-activated and/or calcium dependent protein kinases (CDPKs) and protein phosphatases; (c) increases in abscisic acid levels in response to stress triggering a subset of responses; (d) inositol phosphates as signal molecules (at least for a subset of the stress responsive transcriptional changes; (e) activation of phospholipases which in turn generates a diverse array of second messenger molecules, some of which might regulate the activity of stress responsive kinases; (f) induction of late embryogenesis abundant (LEA) type genes including the CRT/DRE responsive COR/RD genes; (g) increased levels of antioxidants and compatible osmolytes such as proline and soluble sugars; and (h) accumulation of reactive oxygen species such as superoxide, hydrogen peroxide, and hydroxyl radicals. Abscisic acid biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Several genes which increase tolerance to cold or salt stress can also improve drought stress protection, these include for example, the transcription factor AtCBF/DREB1, OsCDPK7 (Saijo et al. 2000, Plant J. 23: 319-327) or AVP1 (a vacuolar pyrophosphatase-proton pump, Gaxiola et al. 2001, Proc. Natl. Acad. Sci. USA 98: 11444-11449).

Studies have shown that plant adaptations to adverse environmental conditions are complex genetic traits with polygenic nature. Conventional means for crop and horticultural improvements utilize selective breeding techniques to identify plants having desirable characteristics. However, selective breeding is tedious, time consuming and has an unpredictable outcome. Furthermore, limited germplasm resources for yield improvement and incompatibility in crosses between distantly related plant species represent significant problems encountered in conventional breeding. Advances in genetic engineering have allowed mankind to modify the germplasm of plants by expression of genes-of-interest in plants. Such a technology has the capacity to generate crops or plants with improved economic, agronomic or horticultural traits.

Genetic engineering efforts, aimed at conferring abiotic stress tolerance to transgenic crops, have been described in various publications [Apse and Blumwald (Curr Opin Biotechnol. 13:146-150, 2002), Quesada et al. (Plant Physiol. 130:951-963, 2002), Holmström et al. (Nature 379: 683-684, 1996), Xu et al. (Plant Physiol 110: 249-257, 1996), Pilon-Smits and Ebskamp (Plant Physiol 107: 125-130, 1995) and Tarczynski et al. (Science 259: 508-510, 1993)].

Various patents and patent applications disclose genes and proteins which can be used for increasing tolerance of plants to abiotic stresses. These include for example, U.S. Pat. Nos. 5,296,462 and 5,356,816 (for increasing tolerance to cold stress); U.S. Pat. No. 6,670,528 (for increasing ABST); U.S. Pat. No. 6,720,477 (for increasing ABST); U.S. application Ser. Nos. 09/938,842 and 10/342,224 (for increasing ABST); U.S. application Ser. No. 10/231,035 (for increasing ABST); WO2004/104162 (for increasing ABST and biomass); WO2007/020638 (for increasing ABST, biomass, vigor and/or yield); WO2007/049275 (for increasing ABST, biomass, vigor and/or yield); WO2010/076756 (for increasing ABST, biomass and/or yield); WO2009/083958 (for increasing water use efficiency, fertilizer use efficiency, biotic/abiotic stress tolerance, yield and/or biomass); WO2010/020941 (for increasing nitrogen use efficiency, abiotic stress tolerance, yield and/or biomass); WO2009/141824 (for increasing plant utility); WO2010/049897 (for increasing plant yield).

Nutrient deficiencies cause adaptations of the root architecture, particularly notably for example is the root proliferation within nutrient rich patches to increase nutrient uptake. Nutrient deficiencies cause also the activation of plant metabolic to pathways which maximize the absorption, assimilation and distribution processes such as by activating architectural changes. Engineering the expression of the triggered genes may cause the plant to exhibit the architectural changes and enhanced metabolism also under other conditions.

In addition, it is widely known that the plants usually respond to water deficiency by creating a deeper root system that allows access to moisture located in deeper soil layers. Triggering this effect will allow the plants to access nutrients and water located in deeper soil horizons particularly those readily dissolved in water like nitrates.

Cotton and cotton by-products provide raw materials that are used to produce a wealth of consumer-based products in addition to textiles including cotton foodstuffs, livestock feed, fertilizer and paper. The production, marketing, consumption and trade of cotton-based products generate an excess of $100 billion annually in the U.S. alone, making cotton the number one value-added crop.

Even though 90% of cotton's value as a crop resides in the fiber (lint), yield and fiber quality has declined due to general erosion in genetic diversity of cotton varieties, and an increased vulnerability of the crop to environmental conditions.

There are many varieties of cotton plant, from which cotton fibers with a range of characteristics can be obtained and used for various applications. Cotton fibers may be characterized according to a variety of properties, some of which are considered highly desirable within the textile industry for the production of increasingly high quality products and optimal exploitation of modem spinning technologies. Commercially desirable properties include length, length uniformity, fineness, maturity ratio, decreased fuzz fiber production, micronaire, bundle strength, and single fiber strength. Much effort has been put into the improvement of the characteristics of cotton fibers mainly focusing on fiber length and fiber fineness. In particular, there is a great demand for cotton fibers of specific lengths.

A cotton fiber is composed of a single cell that has differentiated from an epidermal cell of the seed coat, developing through four stages, i.e., initiation, elongation, secondary cell wall thickening and maturation stages. More specifically, the elongation of a cotton fiber commences in the epidermal cell of the ovule immediately following flowering, after which the cotton fiber rapidly elongates for approximately 21 days. Fiber elongation is then terminated, and a secondary cell wall is formed and grown through maturation to become a mature cotton fiber.

Several candidate genes which are associated with the elongation, formation, quality and yield of cotton fibers were disclosed in various patent applications such as U.S. Pat. No. 5,880,100 and U.S. patent application Ser. Nos. 08/580,545, 08/867,484 and 09/262,653 (describing genes involved in cotton fiber elongation stage); WO0245485 (improving fiber quality by modulating sucrose synthase); U.S. Pat. No. 6,472,588 and WO0117333 (increasing fiber quality by transformation with a DNA encoding sucrose phosphate synthase); WO9508914 (using a fiber-specific promoter and a coding sequence encoding cotton peroxidase); WO9626639 (using an ovary specific promoter sequence to express plant growth modifying hormones in cotton ovule tissue, for altering fiber quality characteristics such as fiber dimension and strength); U.S. Pat. No. 5,981,834, U.S. Pat. No. 5,597,718, U.S. Pat. No. 5,620,882, U.S. Pat. No. 5,521,708 and U.S. Pat. No. 5,495,070 (coding sequences to alter the fiber characteristics of transgenic fiber producing plants); U.S. patent applications U.S. 2002049999 and U.S. 2003074697 (expressing a gene coding for endoxyloglucan transferase, catalase or peroxidase for improving cotton fiber characteristics); WO 01/40250 (improving cotton fiber quality by modulating transcription factor gene expression); WO 96/40924 (a cotton fiber transcriptional initiation regulatory region associated which is expressed in cotton fiber); EP0834566 (a gene which controls the fiber formation mechanism in cotton plant); WO2005/121364 (improving cotton fiber quality by modulating gene expression); WO2008/075364 (improving fiber quality, yield/biomass/vigor and/or abiotic stress tolerance of plants).

WO publication No. 2004/104162 discloses methods of increasing abiotic stress tolerance and/or biomass in plants and plants generated thereby.

WO publication No. 2004/111183 discloses nucleotide sequences for regulating gene expression in plant trichomes and constructs and methods utilizing same.

WO publication No. 2004/081173 discloses novel plant derived regulatory sequences and constructs and methods of using such sequences for directing expression of exogenous polynucleotide sequences in plants.

WO publication No. 2005/121364 discloses polynucleotides and polypeptides involved in plant fiber development and methods of using same for improving fiber quality, yield and/or biomass of a fiber producing plant.

WO publication No. 2007/049275 discloses isolated polypeptides, polynucleotides encoding same, transgenic plants expressing same and methods of using same for increasing fertilizer use efficiency, plant abiotic stress tolerance and biomass.

WO publication No. 2007/020638 discloses methods of increasing abiotic stress tolerance and/or biomass in plants and plants generated thereby.

WO publication No. 2008/122980 discloses genes constructs and methods for increasing oil content, growth rate and biomass of plants.

WO publication No. 2008/075364 discloses polynucleotides involved in plant fiber development and methods of using same.

WO publication No. 2009/083958 discloses methods of increasing water use efficiency, fertilizer use efficiency, biotic/abiotic stress tolerance, yield and biomass in plant and plants generated thereby.

WO publication No. 2009/141824 discloses isolated polynucleotides and methods using same for increasing plant utility.

WO publication No. 2009/013750 discloses genes, constructs and methods of increasing abiotic stress tolerance, biomass and/or yield in plants generated thereby.

WO publication No. 2010/020941 discloses methods of increasing nitrogen use efficiency, abiotic stress tolerance, yield and biomass in plants and plants generated thereby.

WO publication No. 2010/076756 discloses isolated polynucleotides for increasing abiotic stress tolerance, yield, biomass, growth rate, vigor, oil content, fiber yield, fiber quality, and/or nitrogen use efficiency of a plant.

WO2010/100595 publication discloses isolated polynucleotides and polypeptides, and methods of using same for increasing plant yield and/or agricultural characteristics.

WO publication No. 2010/049897 discloses isolated polynucleotides and polypeptides and methods of using same for increasing plant yield, biomass, growth rate, vigor, oil content, abiotic stress tolerance of plants and nitrogen use efficiency.

WO2010/143138 publication discloses isolated polynucleotides and polypeptides, and methods of using same for increasing nitrogen use efficiency, fertilizer use efficiency, yield, growth rate, vigor, biomass, oil content, abiotic stress tolerance and/or water use efficiency.

WO publication No. 2011/080674 discloses isolated polynucleotides and polypeptides and methods of using same for increasing plant yield, biomass, growth rate, vigor, oil content, abiotic stress tolerance of plants and nitrogen use efficiency.

WO2011/015985 publication discloses polynucleotides and polypeptides for increasing desirable plant qualities.

WO2011/135527 publication discloses isolated polynucleotides and polypeptides for increasing plant yield and/or agricultural characteristics.

WO2012/028993 publication discloses isolated polynucleotides and polypeptides, and methods of using same for increasing nitrogen use efficiency, yield, growth rate, vigor, biomass, oil content, and/or abiotic stress tolerance.

WO2012/085862 publication discloses isolated polynucleotides and polypeptides, and methods of using same for improving plant properties.

WO2013/027223 publication discloses isolated polynucleotides and polypeptides, and methods of using same for increasing plant yield and/or agricultural characteristics.

SUMMARY OF THE INVENTION

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence encoding a polypeptide at least 80% identical to SEQ ID NO: 574-930, 6266-8621, 8623-10549 or 10550, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, to comprising expressing within the plant an exogenous polynucleotide comprising a nucleic acid sequence encoding a polypeptide selected from the group consisting of SEQ ID NOs: 574-930, and 6266-10550, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of producing a crop comprising growing a crop of a plant expressing an exogenous polynucleotide comprising a nucleic acid sequence encoding a polypeptide at least 80% homologous to the amino acid sequence selected from the group consisting of SEQ ID NOs: 574-930, 6266-8621, and 8623-10550, wherein the plant is derived from a plant selected for increased yield, increased growth rate, increased biomass, increased vigor, increased oil content, increased seed yield, increased fiber yield, increased fiber quality, increased nitrogen use efficiency, and/or increased abiotic stress tolerance as compared to a control plant, thereby producing the crop.

According to an aspect of some embodiments of the present invention there is provided a method of producing a crop comprising growing a crop plant transformed with an exogenous polynucleotide encoding a polypeptide at least 80% homologous to the amino acid sequence selected from the group consisting of SEQ ID NOs: 574-930, 6266-8621, and 8623-10550, wherein the crop plant is derived from plants selected for increased yield, increased growth rate, increased biomass, increased vigor, increased oil content, increased seed yield, increased fiber yield, increased fiber quality, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased nitrogen use efficiency, and/or increased abiotic stress tolerance, thereby producing the crop.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising a nucleic acid sequence at least 80% identical to SEQ ID NO: 1-573, 931-6264 or 6265, to thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of increasing yield, growth rate, biomass, vigor, oil content, seed yield, fiber yield, fiber quality, nitrogen use efficiency, and/or abiotic stress of a plant, comprising expressing within the plant an exogenous polynucleotide comprising the nucleic acid sequence selected from the group consisting of SEQ ID NOs:1-573, and 931-6265, thereby increasing the yield, growth rate, biomass, vigor, oil content, seed yield, fiber yield, fiber quality, nitrogen use efficiency, and/or abiotic stress of the plant.

According to an aspect of some embodiments of the present invention there is provided a method of producing a crop comprising growing a crop of a plant expressing an exogenous polynucleotide which comprises a nucleic acid sequence which is at least 80% identical to the nucleic acid sequence selected from the group consisting of SEQ ID NOs: 1-573, and 931-6265, wherein the plant is derived from a plant selected for increased yield, increased growth rate, increased biomass, increased vigor, increased oil content, increased seed yield, increased fiber yield, increased fiber quality, increased nitrogen use efficiency, and/or increased abiotic stress tolerance as compared to a control plant, thereby producing the crop.

According to an aspect of some embodiments of the present invention there is provided a method of producing a crop comprising growing a crop of a plant expressing transformed with an exogenous polynucleotide which comprises a nucleic acid sequence which is at least 80% identical to the nucleic acid sequence selected from the group consisting of SEQ ID NOs: 1-573, and 931-6265, wherein the crop plant is derived from plants selected for increased yield, increased growth rate, increased biomass, increased vigor, increased oil content, increased seed yield, increased fiber yield, increased fiber quality, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased nitrogen use efficiency, and/or increased abiotic stress tolerance, thereby producing the crop.

According to an aspect of some embodiments of the present invention there is to provided an isolated polynucleotide comprising a nucleic acid sequence encoding a polypeptide which comprises an amino acid sequence at least 80% homologous to the amino acid sequence set forth in SEQ ID NO: 574-930, 6266-8621, 8623-10549 or 10550, wherein the amino acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polynucleotide comprising a nucleic acid sequence encoding a polypeptide which comprises the amino acid sequence selected from the group consisting of SEQ ID NOs: 574-930, and 6266-10550.

According to an aspect of some embodiments of the present invention there is provided an isolated polynucleotide comprising a nucleic acid sequence at least 80% identical to SEQ ID NOs: 1-573, and 931-6265, wherein the nucleic acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polynucleotide comprising the nucleic acid sequence selected from the group consisting of SEQ ID NOs: 1-573, and 931-6265.

According to an aspect of some embodiments of the present invention there is provided a nucleic acid construct comprising the isolated polynucleotide of some embodiments of the invention, and a promoter for directing transcription of the nucleic acid sequence in a host cell.

According to an aspect of some embodiments of the present invention there is provided an isolated polypeptide comprising an amino acid sequence at least 80% homologous to SEQ ID NO: 574-930, 6266-8621, 8623-10549 or 10550, wherein the amino acid sequence is capable of increasing yield, growth rate, biomass, vigor, oil content, seed yield, fiber yield, fiber quality, nitrogen use efficiency, and/or abiotic stress of a plant.

According to an aspect of some embodiments of the present invention there is provided an isolated polypeptide comprising the amino acid sequence selected from the group consisting of SEQ ID NOs: 574-930, and 6266-10550.

According to an aspect of some embodiments of the present invention there is provided a plant cell exogenously expressing the polynucleotide of some embodiments of the invention, or the nucleic acid construct of some embodiments of the invention.

According to an aspect of some embodiments of the present invention there is provided a plant cell exogenously expressing the polypeptide of some embodiments of the invention.

According to an aspect of some embodiments of the present invention there is provided a transgenic plant comprising the nucleic acid construct of some embodiments of the invention or the plant cell of some embodiments of the invention.

According to an aspect of some embodiments of the present invention there is provided a method of growing a crop, the method comprising seeding seeds and/or planting plantlets of a plant transformed with the isolated polynucleotide of some embodiments of the invention, or with the nucleic acid construct of some embodiments of the invention, wherein the plant is derived from plants selected for at least one trait selected from the group consisting of: increased nitrogen use efficiency, increased abiotic stress tolerance, increased biomass, increased growth rate, increased vigor, increased yield and increased fiber yield or quality, and increased oil content as compared to a non-transformed plant, thereby growing the crop.

According to some embodiments of the invention, the nucleic acid sequence encodes an amino acid sequence selected from the group consisting of SEQ ID NOs: 574-930, and 6266-10550.

According to some embodiments of the invention, the nucleic acid sequence is selected from the group consisting of SEQ ID NOs: 1-573, and 931-6265.

According to some embodiments of the invention, the polynucleotide consists of the nucleic acid sequence selected from the group consisting of SEQ ID NOs: 1-573, and 931-6265.

According to some embodiments of the invention, the nucleic acid sequence encodes the amino acid sequence selected from the group consisting of SEQ ID NOs: 574-930, 6266-10550.

According to some embodiments of the invention, the plant cell forms part of a plant.

According to some embodiments of the invention, the method further comprising to growing the plant expressing the exogenous polynucleotide under the abiotic stress.

According to some embodiments of the invention, the abiotic stress is selected from the group consisting of salinity, drought, osmotic stress, water deprivation, flood, etiolation, low temperature, high temperature, heavy metal toxicity, anaerobiosis, nutrient deficiency, nutrient excess, atmospheric pollution and UV irradiation.

According to some embodiments of the invention, the yield comprises seed yield or oil yield.

According to some embodiments of the invention, the method further comprising growing the plant expressing the exogenous polynucleotide under nitrogen-limiting conditions.

According to some embodiments of the invention, the promoter is heterologous to the isolated polynucleotide and/or to the host cell.

According to some embodiments of the invention, the wherein the non-transformed plant is a wild type plant of identical genetic background.

According to some embodiments of the invention, the non-transformed plant is a wild type plant of the same species.

According to some embodiments of the invention, the non-transformed plant is grown under identical growth conditions.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 3C-D) or nitrogen-limiting (FIGS. 3E-F) conditions. The different transgenes were grown in transparent agar plates for 17 days (7 days nursery and 10 days after transplanting). The plates were photographed every 3-4 days starting at day 1 after transplanting. FIG. 3A—An image of a photograph of plants taken following 10 after transplanting days on agar plates when grown under normal (standard) conditions. FIG. 3B—An image of root analysis of the plants shown in FIG. 3A in which the lengths of the roots measured are represented by arrows. FIG. 3C—An image of a photograph of plants taken following 10 days after transplanting on agar plates, grown under high osmotic (PEG 15%) conditions. FIG. 3D—An image of root analysis of the plants shown in FIG. 3C in which the lengths of the roots measured are represented by arrows. FIG. 3E—An image of a photograph of plants taken following 10 days after transplanting on agar plates, grown under low nitrogen conditions. FIG. 3F—An image of root analysis of the plants shown in FIG. 3E in which the lengths of the roots measured are represented by arrows.

DESCRIPTION OF SPECIFIC EMBODIMENTS OF THE INVENTION

Figure 1:
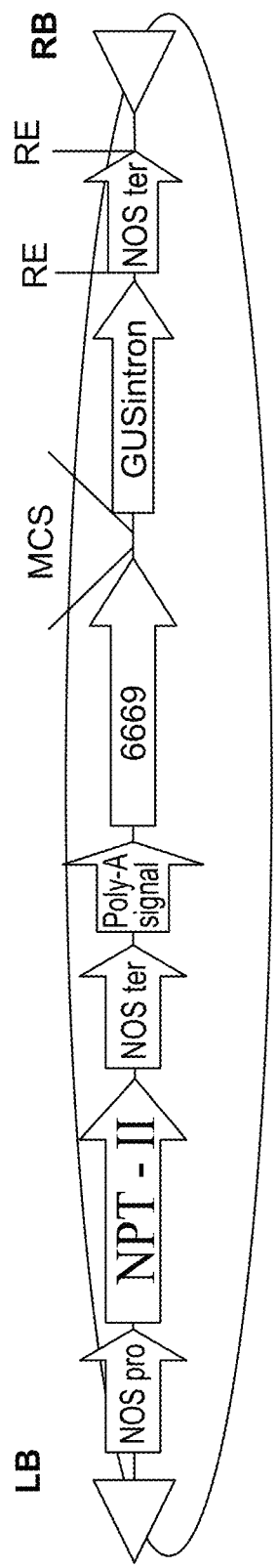
FIG. 1 is a schematic illustration of the modified pGI binary plasmid containing the new At6669 promoter (SEQ ID NO: 10575) and the GUSintron (pQYN_6669) used for expressing the isolated polynucleotide sequences of the invention. RB-T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the vector while replacing the GUS-intron reporter gene.
Figure 2:
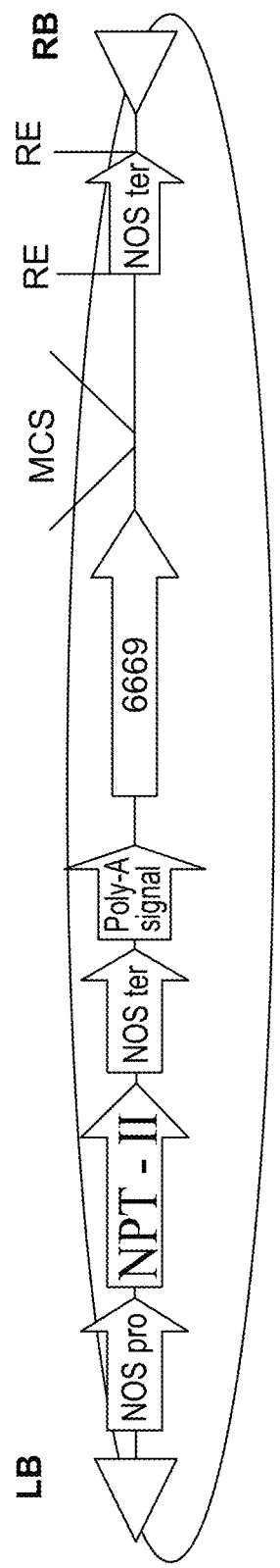
FIG. 2 is a schematic illustration of the modified pGI binary plasmid containing the new At6669 promoter (SEQ ID NO:10575) (pQFN or pQFNc) used for expressing the isolated polynucleotide sequences of the invention. RB-T-DNA right border; LB—T-DNA left border; MCS—Multiple cloning site; RE—any restriction enzyme; NOS pro=nopaline synthase promoter; NPT-II=neomycin phosphotransferase gene; NOS ter=nopaline synthase terminator; Poly-A signal (polyadenylation signal); GUSintron—the GUS reporter gene (coding sequence and intron). The isolated polynucleotide sequences of the invention were cloned into the MCS of the vector.

The present invention, in some embodiments thereof, relates to isolated polynucleotides and polypeptides, nucleic acid constructs, transgenic cells and transgenic plants comprising same and methods of generating and using same, and, more particularly, but not exclusively, to methods of increasing yield, biomass, growth rate, vigor, oil content, fiber yield, fiber quality abiotic stress tolerance, and/or fertilizer use efficiency (e.g., nitrogen use efficiency) of a plant.

Before explaining at least one embodiment of the invention in detail, it is to be understood that the invention is not necessarily limited in its application to the details set to forth in the following description or exemplified by the Examples. The invention is capable of other embodiments or of being practiced or carried out in various ways.

The present inventors have identified novel polypeptides and polynucleotides which can be used to increase yield, growth rate, biomass, oil content, vigor, abiotic stress tolerance and/or fertilizer (e.g., nitrogen) use efficiency of a plant.

Thus, as shown in the Examples section which follows, the present inventors have utilized bioinformatics tools to identify polynucleotides which enhance yield (e.g., seed yield, oil yield, oil content), growth rate, biomass, vigor, abiotic stress tolerance and/or fertilizer (e.g., nitrogen) use efficiency of a plant. Genes which affect the trait-of-interest were identified based on expression profiles and gene copy number of genes of several Barley, Arabidopsis, Sorghum, Maize, Brachypodium, Foxtail Millet, Soybean, and tomato ecotypes, accessions and varieties in various tissues, developmental stages, ABST and fertilizer-limiting conditions; as well as homology with genes known to affect the trait-of-interest and using digital expression profile in specific tissues and conditions (Tables 1, 3-96, Examples 1 and 3-15 of the Examples section which follows). Homologous polypeptides and polynucleotides having the same function were also identified (Table 2, Example 2 of the Examples section which follows). The novel polynucleotides were cloned into nucleic acid constructs (e.g., binary vectors, Example 16 and Table 97 of the Examples section which follows), transformed into agrobacterium tumefaciens cells (Example 17 of the Examples section which follows), and transgenic Arabidopsis plants transformed with the isolated polynucleotides were generated (Example 18 of the Examples section which follows) for evaluation of the effect of the transgene on plant performance (Examples 19-21 of the Examples section which follows). Transgenic plants exogenously expressing the genes of some embodiments of the invention exhibit increased biomass, yield, growth rate, vigor, nitrogen use efficiency, and/or abiotic stress tolerance as compared to control plants grown under the same (r.g., identical) growth conditions (Tables 98-111; Examples 19-21 in the Examples section which follows). Altogether, these results suggest the use of the novel polynucleotides and polypeptides of the invention for increasing yield (including oil yield, seed yield and oil content), growth rate, biomass, fiber yield and/or quality, vigor, abiotic stress tolerance and/or fertilizer (e.g., nitrogen) use efficiency of a plant.

Thus, according to an aspect of some embodiments of the invention, there is provided method of increasing yield, growth rate, biomass, vigor, oil content, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 574-930, 6266-8621, and 8623-10550, thereby increasing the yield, growth rate, biomass, vigor, oil content, fiber yield, fiber quality, fertilizer use efficiency (e.g., nitrogen use efficiency) and/or abiotic stress tolerance of the plant.

As used herein the phrase "plant yield" refers to the amount (e.g., as determined by weight or size) or quantity (numbers) of tissues or organs produced per plant or per growing season. Hence increased yield could affect the economic benefit one can obtain from the plant in a certain growing area and/or growing time.

It should be noted that a plant yield can be affected by various parameters including, but not limited to, plant biomass; plant vigor; growth rate; seed yield; seed or grain quantity; seed or grain quality; oil yield; content of oil, starch and/or protein in harvested organs (e.g., seeds or vegetative parts of the plant); number of flowers (florets) per panicle (expressed as a ratio of number of filled seeds over number of primary panicles); harvest index; number of plants grown per area; number and size of harvested organs per plant and per area; number of plants per growing area (density); number of harvested organs in field; total leaf area; carbon assimilation and carbon partitioning (the distribution/allocation of carbon within the plant); resistance to shade; number of harvestable organs (e.g. seeds), seeds per pod, weight per seed; and modified architecture [such as increase stalk diameter, thickness or improvement of physical properties (e.g. elasticity)].

As used herein the phrase "seed yield" refers to the number or weight of the seeds per plant, seeds per pod, or per growing area or to the weight of a single seed, or to the oil extracted per seed. Hence seed yield can be affected by seed dimensions (e.g., length, width, perimeter, area and/or volume), number of (filled) seeds and seed filling rate and by seed oil content. Hence increase seed yield per plant could affect the economic benefit one can obtain from the plant in a certain growing area and/or growing time; and increase seed yield per growing area could be achieved by increasing seed yield per plant, and/or by increasing number of plants grown on the same given area.

The term "seed" (also referred to as "grain" or "kernel") as used herein refers to a small embryonic plant enclosed in a covering called the seed coat (usually with some stored food), the product of the ripened ovule of gymnosperm and angiosperm plants which occurs after fertilization and some growth within the mother plant.

The phrase "oil content" as used herein refers to the amount of lipids in a given plant organ, either the seeds (seed oil content) or the vegetative portion of the plant (vegetative oil content) and is typically expressed as percentage of dry weight (10% humidity of seeds) or wet weight (for vegetative portion).

It should be noted that oil content is affected by intrinsic oil production of a tissue (e.g., seed, vegetative portion), as well as the mass or size of the oil-producing tissue per plant or per growth period.

In one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant biomass" refers to the amount (e.g., measured in grams of air-dry tissue) of a tissue produced from the plant in a growing season, which could also determine or affect the plant yield or the yield per growing area. An increase in plant biomass can be in the whole plant or in parts thereof such as aboveground (harvestable) parts, vegetative biomass, roots and seeds.

As used herein the phrase "growth rate" refers to the increase in plant organ/tissue size per time (can be measured in $cm^2$ per day).

As used herein the phrase "plant vigor" refers to the amount (measured by weight) of tissue produced by the plant in a given time. Hence increased vigor could to determine or affect the plant yield or the yield per growing time or growing area. In addition, early vigor (seed and/or seedling) results in improved field stand.

Improving early vigor is an important objective of modem rice breeding programs in both temperate and tropical rice cultivars. Long roots are important for proper soil anchorage in water-seeded rice. Where rice is sown directly into flooded fields, and where plants must emerge rapidly through water, longer shoots are associated with vigor. Where drill-seeding is practiced, longer mesocotyls and coleoptiles are important for good seedling emergence. The ability to engineer early vigor into plants would be of great importance in agriculture. For example, poor early vigor has been a limitation to the introduction of maize (*Zea mays* L.) hybrids based on Corn Belt germplasm in the European Atlantic.

It should be noted that a plant yield can be determined under stress (e.g., abiotic stress, nitrogen-limiting conditions) and/or non-stress (normal) conditions.

As used herein, the phrase "non-stress conditions" refers to the growth conditions (e.g., water, temperature, light-dark cycles, humidity, salt concentration, fertilizer concentration in soil, nutrient supply such as nitrogen, phosphorous and/or potassium), that do not significantly go beyond the everyday climatic and other abiotic conditions that plants may encounter, and which allow optimal growth, metabolism, reproduction and/or viability of a plant at any stage in its life cycle (e.g., in a crop plant from seed to a mature plant and back to seed again). Persons skilled in the art are aware of normal soil conditions and climatic conditions for a given plant in a given geographic location. It should be noted that while the non-stress conditions may include some mild variations from the optimal conditions (which vary from one type/species of a plant to another), such variations do not cause the plant to cease growing without the capacity to resume growth.

The phrase "abiotic stress" as used herein refers to any adverse effect on metabolism, growth, reproduction and/or viability of a plant. Accordingly, abiotic stress can be induced by suboptimal environmental growth conditions such as, for example, salinity, water deprivation, flooding, freezing, low or high temperature, heavy metal toxicity, anaerobiosis, nutrient deficiency, atmospheric pollution or UV irradiation. The implications of abiotic stress are discussed in the Background section.

The phrase "abiotic stress tolerance" as used herein refers to the ability of a to plant to endure an abiotic stress without suffering a substantial alteration in metabolism, growth, productivity and/or viability.

Plants are subject to a range of environmental challenges. Several of these, including salt stress, general osmotic stress, drought stress and freezing stress, have the ability to impact whole plant and cellular water availability. Not surprisingly, then, plant responses to this collection of stresses are related. Zhu (2002) Ann. Rev. Plant Biol. 53: 247-273 et al. note that "most studies on water stress signaling have focused on salt stress primarily because plant responses to salt and drought are closely related and the mechanisms overlap". Many examples of similar responses and pathways to this set of stresses have been documented. For example, the CBF transcription factors have been shown to condition resistance to salt, freezing and drought (Kasuga et al. (1999) Nature Biotech. 17: 287-291). The *Arabidopsis* rd29B gene is induced in response to both salt and dehydration stress, a process that is mediated largely through an ABA signal transduction process (Uno et al. (2000) Proc. Natl. Acad. Sci. USA 97: 11632-11637), resulting in altered activity of transcription factors that bind to an upstream element within the rd29B promoter. In *Mesembryanthemum crystallinum* (ice plant), Patharker and Cushman have shown that a calcium-dependent protein kinase (McCDPK1) is induced by exposure to both drought and salt stresses (Patharker and Cushman (2000) Plant J. 24: 679-691). The stress-induced kinase was also shown to phosphorylate a transcription factor, presumably altering its activity, although transcript levels of the target transcription factor are not altered in response to salt or drought stress. Similarly, Saijo et al. demonstrated that a rice salt/drought-induced calmodulin-dependent protein kinase (OsCDPK7) conferred increased salt and drought tolerance to rice when overexpressed (Saijo et al. (2000) Plant J. 23: 319-327).

Exposure to dehydration invokes similar survival strategies in plants as does freezing stress (see, for example, Yelenosky (1989) Plant Physiol 89: 444-451) and drought stress induces freezing tolerance (see, for example, Siminovitch et al. (1982) Plant Physiol 69: 250-255; and Guy et al.

(1992) Planta 188: 265-270). In addition to the induction of cold-acclimation proteins, strategies that allow plants to survive in low water conditions may include, for example, reduced surface area, or surface oil or wax production. In another example increased solute content of the plant prevents to evaporation and water loss due to heat, drought, salinity, osmoticum, and the like therefore providing a better plant tolerance to the above stresses.

It will be appreciated that some pathways involved in resistance to one stress (as described above), will also be involved in resistance to other stresses, regulated by the same or homologous genes. Of course, the overall resistance pathways are related, not identical, and therefore not all genes controlling resistance to one stress will control resistance to the other stresses. Nonetheless, if a gene conditions resistance to one of these stresses, it would be apparent to one skilled in the art to test for resistance to these related stresses. Methods of assessing stress resistance are further provided in the Examples section which follows.

As used herein the phrase "water use efficiency (WUE)" refers to the level of organic matter produced per unit of water consumed by the plant, i.e., the dry weight of a plant in relation to the plant's water use, e.g., the biomass produced per unit transpiration.

As used herein the phrase "fertilizer use efficiency" refers to the metabolic process(es) which lead to an increase in the plant's yield, biomass, vigor, and growth rate per fertilizer unit applied. The metabolic process can be the uptake, spread, absorbent, accumulation, relocation (within the plant) and use of one or more of the minerals and organic moieties absorbed by the plant, such as nitrogen, phosphates and/or potassium.

As used herein the phrase "fertilizer-limiting conditions" refers to growth conditions which include a level (e.g., concentration) of a fertilizer applied which is below the level needed for normal plant metabolism, growth, reproduction and/or viability.

As used herein the phrase "nitrogen use efficiency (NUE)" refers to the metabolic process(es) which lead to an increase in the plant's yield, biomass, vigor, and growth rate per nitrogen unit applied. The metabolic process can be the uptake, spread, absorbent, accumulation, relocation (within the plant) and use of nitrogen absorbed by the plant.

As used herein the phrase "nitrogen-limiting conditions" refers to growth conditions which include a level (e.g., concentration) of nitrogen (e.g., ammonium or to nitrate) applied which is below the level needed for normal plant metabolism, growth, reproduction and/or viability.

Improved plant NUE and FUE is translated in the field into either harvesting similar quantities of yield, while implementing less fertilizers, or increased yields gained by implementing the same levels of fertilizers. Thus, improved NUE or FUE has a direct effect on plant yield in the field. Thus, the polynucleotides and polypeptides of some embodiments of the invention positively affect plant yield, seed yield, and plant biomass. In addition, the benefit of improved plant NUE will certainly improve crop quality and biochemical constituents of the seed such as protein yield and oil yield.

It should be noted that improved ABST will confer plants with improved vigor also under non-stress conditions, resulting in crops having improved biomass and/or yield e.g., elongated fibers for the cotton industry, higher oil content.

The term "fiber" is usually inclusive of thick-walled conducting cells such as vessels and tracheids and to fibrillar aggregates of many individual fiber cells. Hence, the term "fiber" refers to (a) thick-walled conducting and non-conducting cells of the xylem; (b) fibers of extraxylary origin, including those from phloem, bark, ground tissue, and epidermis; and (c) fibers from stems, leaves, roots, seeds, and flowers or inflorescences (such as those of *Sorghum vulgare* used in the manufacture of brushes and brooms).

Example of fiber producing plants, include, but are not limited to, agricultural crops such as cotton, silk cotton tree (Kapok, Ceiba pentandra), desert willow, creosote bush, winterfat, balsa, kenaf, rosette, jute, sisal abaca, flax, corn, sugar cane, hemp, ramie, kapok, coir, bamboo, spanish moss and *Agave* spp. (e.g. sisal).

As used herein the phrase "fiber quality" refers to at least one fiber parameter which is agriculturally desired, or required in the fiber industry (further described hereinbelow). Examples of such parameters, include but are not limited to, fiber length, fiber strength, fiber fitness, fiber weight per unit length, maturity ratio and uniformity (further described hereinbelow).

Cotton fiber (lint) quality is typically measured according to fiber length, strength and fineness. Accordingly, the lint quality is considered higher when the fiber is longer, stronger and finer.

As used herein the phrase "fiber yield" refers to the amount or quantity of fibers produced from the fiber producing plant.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in yield, seed yield, growth rate, biomass, vigor, oil content, fiber yield, fiber quality, fertilizer use efficiency (e.g., nitrogen use efficiency) and/or abiotic stress tolerance yield of a plant as compared to a native plant or a wild type plant [i.e., a plant not modified with the biomolecules (polynucleotide or polypeptides) of the invention, e.g., a non-transformed plant of the same species which is grown under the same (e.g., identical) growth conditions].

The phrase "expressing within the plant an exogenous polynucleotide" as used herein refers to upregulating the expression level of an exogenous polynucleotide within the plant by introducing the exogenous polynucleotide into a plant cell or plant and expressing by recombinant means, as further described herein below.

As used herein "expressing" refers to expression at the mRNA and optionally polypeptide level.

As used herein, the phrase "exogenous polynucleotide" refers to a heterologous nucleic acid sequence which may not be naturally expressed within the plant (e.g., a nucleic acid sequence from a different species) or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

The term "endogenous" as used herein refers to any polynucleotide or polypeptide which is present and/or naturally expressed within a plant or a cell thereof.

According to some embodiments of the invention, the exogenous polynucleotide of the invention comprises a nucleic acid sequence encoding a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs: 574-930, 6266-8621, and 8623-10550.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor-joining tree (Hypertext Transfer Protocol://en (dot) wikipedia (dot) org/wiki/Neighbor-joining) which helps visualizing the clustering.

Homology (e.g., percent homology, identity+similarity) can be determined using any homology comparison software computing a pairwise sequence alignment. Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., an homology over the entire amino acid or nucleic acid sequences of the invention and not over portions thereof.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from www.(dot)emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting from a polypeptide sequence and comparing to polynucleotide sequences, the OneModel FramePlus algorithm [Halperin, E., Faigler, S, and Gill-More, to R. (1999)—FramePlus: aligning DNA to protein sequences. Bioinformatics, 15, 867-873) (available from world wide web(dot)biocceleration(dot)com/Products(dot)html]can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from www.(dot)emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 87%, 88%, 89%, 90%, 91%, 92%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "—F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):

EMBOSS-6.0.1 Needleman-Wunsch algorithm with the following modified parameters: gapopen=8 gapextend=2. The rest of the parameters are unchanged from the default options listed here:

| Standard (Mandatory) qualifiers: | | |
|---|---|---|
| [-asequence] | sequence | Sequence filename and optional format, or reference (input USA) |
| [-bsequence] | seqall | Sequence(s) filename and optional format, or reference (input USA) |
| -gapopen | float | [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0) |
| -gapextend | float | [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0) |
| [-outfile] | align | [*.needle] Output alignment filename |
| Additional (Optional) qualifiers: | | |
| -datafile | matrixf | [EBLOSUM62 for protein, EDNAFULL for DNA]. This is the scoring matrix file used when comparing sequences. By default it is the file 'EBLOSUM62' (for proteins) or the file 'EDNAFULL' (for nucleic sequences). These files are found in the 'data' directory of the EMBOSS installation. |
| Advanced (Unprompted) qualifiers: | | |
| -[no]brief | boolean | [Y] Brief identity and similarity |
| Associated qualifiers: | | |
| "-asequence" associated qualifiers | | |
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |
| -sformat1 | string | Input sequence format |
| -sdbname1 | string | Database name |
| -sid1 | string | Entryname |
| -ufo1 | string | UFO features |
| -fformat1 | string | Features format |
| -fopenfile1 | string | Features file name |
| "-bsequence" associated qualifiers | | |
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |

| "-outfile" associated qualifiers | | |
|---|---|---|
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |
| General qualifiers: | | |
| -auto | boolean | Turn off prompts |
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean | Report command line options. More information on associated and general qualifiers can be found with -help -verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal -q=protein.sequence -db=nucleotide.sequence. The rest of the parameters are unchanged from the default options:

Usage:

om -model=<model_fname>[-q=]query [-db=]database [options]

-model=<model_fname> Specifies the model that you want to run. All models supplied by Compugen are located in the directory $CGNROOT/models/.

Valid Command Line Parameters:

-dev=<dev_name> Selects the device to be used by the application.

Valid devices are:
  bic—Bioccelerator (valid for SW, XSW, FRAME_N2P, and FRAME_P2N models).
  xlg—BioXL/G (valid for all models except XSW).
  xlp—BioXL/P (valid for SW, FRAME+_N2P, and FRAME_P2N models).
  xlh—BioXL/H (valid for SW, FRAME+_N2P, and FRAME_P2N models).
  soft—Software device (for all models).

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify query using accession numbers.

-dacc Add this parameter to the command line if you specify a database using accession numbers.

-dfmt/-qfmt=<format_type> Chooses the database/query format type. Possible formats are:
  fasta—fasta with seq type auto-detected.
  fastap—fasta protein seq.
  fastan—fasta nucleic seq.
  gcg—gcg format, type is auto-detected.
  gcg9seq—gcg9 format, type is auto-detected.
  gcg9seqp—gcg9 format protein seq.
  gcg9seqn—gcg9 format nucleic seq.
  nbrf—nbrf seq, type is auto-detected.
  nbrfp—nbrf protein seq.
  nbrfn—nbrf nucleic seq.
  embl—embl and swissprot format.
  genbank—genbank format (nucleic).
  blast—blast format.
  nbrf_gcg—nbrf-gcg seq, type is auto-detected.
  nbrf_gcgp—nbrf-gcg protein seq.
  nbrf_gcgn—nbrf-gcg nucleic seq.
  raw—raw ascii sequence, type is auto-detected.
  rawp—raw ascii protein sequence.
  rawn—raw ascii nucleic sequence.
  pir—pir codata format, type is auto-detected.
  profile—gcg profile (valid only for -qfmt in SW, XSW, FRAME_P2N, and FRAME+_P2N).

-out=<out_fname> The name of the output file.

-suffix=<name> The output file name suffix.

-gapop=<n> Gap open penalty. This parameter is not valid for FRAME+. For FrameSearch the default is 12.0. For other searches the default is 10.0.

-gapext=<n> Gap extend penalty. This parameter is not valid for FRAME+. For FrameSearch the default is 4.0. For other models: the default for protein searches is 0.05, and the default for nucleic searches is 1.0.

-qgapop=<n> The penalty for opening a gap in the query sequence. The default is 10.0. Valid for XSW.

-qgapext=<n> The penalty for extending a gap in the query sequence. The default is 0.05. Valid for XSW.

-start=<n> The position in the query sequence to begin the search.

-end=<n> The position in the query sequence to stop the search.

-qtrans Performs a translated search, relevant for a nucleic query against a protein database. The nucleic query is translated to six reading frames and a result is given for each frame.
   Valid for SW and XSW.
-dtrans Performs a translated search, relevant for a protein query against a DNA database. Each database entry is translated to six reading frames and a result is given for each frame.
   Valid for SW and XSW.
Note: "-qtrans" and "-dtrans" options are mutually exclusive.
-matrix=<matrix_file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
   zscore.
   escore.
-thr_max=<n> The score upper threshold. Results that are larger than -thr_max value are not shown.
-thr_min=<n> The score lower threshold. Results that are lower than -thr_min value are not shown.
-align=<n> The number of alignments reported in the output file.
-noalign Do not display alignment.
Note: "-align" and "-noalign" parameters are mutually exclusive.
-outfmt=<format_name> Specifies the output format type. The default format is PFS.
Possible values are:
   PFS—PFS text format
   FASTA—FASTA text format
   BLAST—BLAST text format
-nonorm Do not perform score normalization.
-norm=<norm_name> Specifies the normalization method. Valid options are:
   log—logarithm normalization.
   std—standard normalization.
   stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default to is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host_name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note: "-batch" and "-wait" parameters are mutually exclusive.
-version Prints the software version number.
-help Displays this help message. To get more specific help type:
   "om-model=<model_fname>-help".
According to some embodiments the homology is a local homology or a local identity.
Local alignments tools include, but are not limited to the BlastP, BlastN, BlastX or TBLASTN software of the National Center of Biotechnology Information (NCBI), FASTA, and the Smith-Waterman algorithm.
A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.
Default parameters for blastp include: Max target sequences: 100; Expected threshold: $e^{-5}$; Word size: 3; Max matches in a query range: 0; Scoring parameters: Matrix—BLOSUM62; filters and masking: Filter—low complexity regions.
Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.
According to some embodiments of the invention, the exogenous polynucleotide of the invention encodes a polypeptide having an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:574-930, 6266-8621, and 8623-10550.
According to some embodiments of the invention, the method of increasing yield, growth rate, biomass, vigor, oil content, fiber yield, fiber quality, fertilizer use efficiency (e.g., nitrogen use efficiency) and/or abiotic stress tolerance of a plant, is effected by expressing within the plant an exogenous polynucleotide comprising a nucleic acid sequence encoding a polypeptide at least at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the amino acid sequence selected from the group consisting of SEQ ID NOs:574-930, 6266-8621, and 8623-10550, thereby increasing the yield, growth rate, biomass, vigor, oil content, fiber yield, fiber quality, fertilizer use efficiency (e.g., nitrogen use efficiency) and/or abiotic stress tolerance of the plant.

According to some embodiments of the invention, the exogenous polynucleotide encodes a polypeptide consisting of the amino acid sequence set forth by SEQ ID NO: 574-930, 6266-10549 or 10550.

According to an aspect of some embodiments of the invention, the method of increasing yield, growth rate, biomass, vigor, oil content, fiber yield, fiber quality, fertilizer use efficiency (e.g., nitrogen use efficiency) and/or abiotic stress tolerance of a plant, is effected by expressing within the plant an exogenous polynucleotide comprising a nucleic acid sequence encoding a polypeptide comprising an amino acid sequence selected from the group consisting of SEQ ID NOs: 574-930, and 6266-10550, thereby increasing the yield, growth rate, biomass, vigor, oil content, fiber yield, fiber quality, fertilizer use efficiency (e.g., nitrogen use efficiency) and/or abiotic stress tolerance of the plant.

According to an aspect of some embodiments of the invention, there is provided a method of increasing yield, growth rate, biomass, vigor, oil content, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence encoding a polypeptide selected from the group consisting of SEQ ID NOs: 574-930, and 6266-10550, thereby increasing the yield, growth rate, biomass, vigor, oil content, fiber yield, fiber quality, fertilizer use efficiency (e.g., nitrogen use efficiency) and/or abiotic stress tolerance of the plant.

According to some embodiments of the invention, the exogenous polynucleotide encodes a polypeptide consisting of the amino acid sequence set forth by SEQ ID NO: 574-930, 6266-10549 or 10550.

According to some embodiments of the invention the exogenous polynucleotide comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-573, and 931-6265.

According to an aspect of some embodiments of the invention, there is provided a method of increasing yield, growth rate, biomass, vigor, oil content, fiber yield, fiber quality, fertilizer use efficiency (e.g., nitrogen use efficiency) and/or abiotic stress tolerance of a plant, comprising expressing within the plant an exogenous polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-573, and 931-6265, thereby increasing the yield, growth rate, biomass, vigor, oil content, fiber yield, fiber quality, fertilizer use efficiency (e.g., nitrogen use efficiency) and/or abiotic stress tolerance of the plant.

According to some embodiments of the invention the exogenous polynucleotide is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-573, and 931-6265.

According to some embodiments of the invention the exogenous polynucleotide is set forth by SEQ ID NO: 1-573, 931-6264 or 6265.

According to some embodiments of the invention the exogenous polynucleotide is set forth by the nucleic acid sequence selected from the group consisting of SEQ ID NOs: 1-573 and 931-6265.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

The term "isolated" refers to at least partially separated from the natural environment e.g., from a plant cell.

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: 1 SDCU=n=1 N [(Xn−Yn)/Yn]2/N, where Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (Hypertext Transfer Protocol://World Wide Web (dot) kazusa (dot) or (dot) jp/codon/). The Codon Usage Database contains codon usage tables for a number of different species, with each codon usage Table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Non-limiting examples of non-coding RNA polynucleotides are provided in SEQ ID NOs: 253-261, 330-333, and 571-573.

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

The invention provides an isolated polynucleotide comprising a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the polynucleotide selected from the group consisting of SEQ ID NOs: 1-573, and 931-6265.

According to some embodiments of the invention the nucleic acid sequence is capable of increasing yield, growth rate, biomass, vigor, oil content, fiber yield, fiber quality, fertilizer use efficiency (e.g., nitrogen use efficiency) and/or abiotic stress tolerance of a plant.

According to some embodiments of the invention the isolated polynucleotide to comprising the nucleic acid sequence selected from the group consisting of SEQ ID NOs: 1-573 and 931-6265.

According to some embodiments of the invention the isolated polynucleotide is set forth by SEQ ID NO: 1-573, 931-6264 or 6265.

The invention provides an isolated polynucleotide comprising a nucleic acid sequence encoding a polypeptide which comprises an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to the amino acid sequence selected from the group consisting of SEQ ID NO: 574-930, 6266-8621, 8623-10549 or 10550.

According to some embodiments of the invention the amino acid sequence is capable of increasing yield, seed yield, growth rate, biomass, vigor, oil content, fiber yield, fiber quality, fertilizer use efficiency (e.g., nitrogen use efficiency), abiotic stress tolerance yield and/or water use efficiency of a plant.

The invention provides an isolated polynucleotide comprising a nucleic acid sequence encoding a polypeptide which comprises the amino acid sequence selected from the group consisting of SEQ ID NOs: 574-930 and 6266-10550.

According to an aspect of some embodiments of the invention, there is provided a nucleic acid construct comprising the isolated polynucleotide of the invention, and a promoter for directing transcription of the nucleic acid sequence in a host cell.

The invention provides an isolated polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NO: 574-930, 6266-8621, 8623-10549 or 10550.

According to some embodiments of the invention, the polypeptide comprising an amino acid sequence selected from the group consisting of SEQ ID NOs: 574-930, and 6266-10550.

According to some embodiments of the invention, the polypeptide is set forth by SEQ ID NO: 574-930, 6266-10549 or 10550.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis*, *Albizia amara*, *Alsophila tricolor*, *Andropogon* spp., *Arachis* spp, *catechu*, *Astelia fragrans*, *Astragalus cicer*, *Baikiaea plurijuga*, *Betula* spp., *Brassica* spp., *Bruguiera gymnorrhiza*, *Burkea africana*, *Butea frondosa*, *Cadaba farinosa*, *Calliandra* spp, *Camellia sinensis*, *Canna indica*, *Capsicum* spp., *Cassia* spp., *Centroema pubescens*, *Chacoomeles* spp., *Cinnamomum cassia*, *Coffea arabica*, *Colophospermum mopane*, *Coronillia varia*, *Cotoneaster serotina*, *Crataegus* spp., *Cucumis* spp., *Cupressus* spp., *Cyathea dealbata*, *Cyclonia oblonga*, *Cryptomeria japonica*, *Cymbopogon* spp., *Cynthea dealbata*, *Cyclonia oblonga*, *Dalbergia monetaria*, *Davallia divaricata*, *Desmodium* spp., *Dicksonia squarosa*, *Dibeteropogon amplectens*, *Dioclea* spp, *Dolichos* spp., *Dorycnium rectum*, *Echinochloa pyramidalis*, *Ehraffia* spp., *Eleusine coracana*, *Eragrestis* spp., *Erythrina* spp., *Eucalypfus* spp., *Euclea schimperi*, *Eulalia vi/losa*, *Pagopyrum* spp., *Feijoa sellowlana*, *Fragaria* spp., *Flemingia* spp, *Freycinetia banksli*, *Geranium thunbergii*, *GinAgo biloba*, *Glycine javanica*, *Gliricidia* spp, *Gossypium hirsutum*, *Grevillea* spp., *Guibourtia coleosperma*, *Hedysarum* spp., *Hemaffhia altissima*, *Heteropogon contoffus*, *Hordeum vulgare*, *Hyparrhenia rufa*, *Hypericum erectum*, *Hypeffhelia dissolute*, *Indigo incamata*, *Iris* spp., *Leptarrhena pyrolifolia*, *Lespediza* spp., *Lettuca* spp., *Leucaena leucocephala*, *Loudetia simplex*, *Lotonus bainesli*, *Lotus* spp., *Macrotyloma axillare*, *Malus* spp., *Manihot esculenta*, *Medicago saliva*, *Metasequoia glyptostroboides*, *Musa sapientum*, *Nicotianum* spp., *Onobrychis* spp., *Ornithopus* spp., *Oryza* spp., *Peltophorum africanum*, *Pennisetum* spp., *Persea gratissima*, *Petunia* spp., *Phaseolus* spp., *Phoenix canariensis*, *Phormium cookianum*, *Photinia* spp., *Picea glauca*, *Pinus* spp., *Pisum sativam*, *Podocarpus totara*, *Pogonarthria fleckii*, *Pogonaffhria squarrosa*, *Populus* spp., *Prosopis cineraria*, *Pseudotsuga menziesii*, *Pterolobium stellatum*, *Pyrus communis*, *Quercus* spp., *Rhaphiolepsis umbellata*, *Rhopalostylis sapida*, *Rhus natalensis*, *Ribes grossularia*, *Ribes* spp., *Robinia pseudoacacia*, *Rosa* spp., *Rubus* spp., *Salix* spp., *Schyzachyrium sanguineum*, *Sciadopitys vefficillata*, *Sequoia sempervirens*, *Sequoiadendron giganteum*, *Sorghum bicolor*, *Spinacia* spp., *Sporobolus fimbriatus*, *Stiburus alopecuroides*, *Stylosanthos humilis*, *Tadehagi* spp, *Taxodium distichum*, *Themeda triandra*, *Trifolium* spp., *Triticum* spp., *Tsuga heterophylla*, *Vaccinium* spp., *Vicia* spp., *Vitis vinifera*, *Watsonia pyramidata*, *Zantedeschia aethiopica*, *Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the plant used by the method of the invention is a crop plant such as rice, maize, wheat, barley, peanut, potato, sesame, olive tree, palm oil, banana, soybean, sunflower, canola, sugarcane, alfalfa, millet, leguminosae (bean, pea), flax, lupinus, rapeseed, tobacco, poplar and cotton.

According to some embodiments of the invention the plant is a dicotyledonous plant.

According to some embodiments of the invention the plant is a monocotyledonous plant.

According to some embodiments of the invention, there is provided a plant cell to exogenously expressing the polynucleotide of some embodiments of the invention, the nucleic acid construct of some embodiments of the invention and/or the polypeptide of some embodiments of the invention.

According to some embodiments of the invention, expressing the exogenous polynucleotide of the invention within the plant is effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

Any suitable promoter sequence can be used by the nucleic acid construct of the to present invention. Preferably the promoter is a constitutive promoter, a tissue-specific, or an abiotic stress-inducible promoter.

According to some embodiments of the invention, the promoter is a plant promoter, which is suitable for expression of the exogenous polynucleotide in a plant cell.

Suitable promoters for expression in wheat include, but are not limited to, Wheat SPA promoter (SEQ ID NO: 10551; Albanietal, Plant Cell, 9: 171-184, 1997, which is fully incorporated herein by reference), wheat LMW (SEQ ID NO: 10552 (longer LMW promoter), and SEQ ID NO: 10553 (LMW promoter) and HMW glutenin-1 (SEQ ID NO: 10554 (Wheat HMW glutenin-1 longer promoter); and SEQ ID NO: 10555 (Wheat HMW glutenin-1 Promoter); Thomas and Flavell, The Plant Cell 2:1171-1180; Furtado et al., 2009 Plant Biotechnology Journal 7:240-253, each of which is fully incorporated herein by reference), wheat alpha, beta and gamma gliadins [e.g., SEQ ID NO: 10556 (wheat alpha gliadin, B genome, promoter); SEQ ID NO: 10557 (wheat gamma gliadin promoter); EMBO 3:1409-15, 1984, which is fully incorporated herein by reference], wheat TdPR60 [SEQ ID NO:10558 (wheat TdPR60 longer promoter) or SEQ ID NO:10559 (wheat TdPR60 promoter); Kovalchuk et al., Plant Mol Biol 71:81-98, 2009, which is fully incorporated herein by reference], maize Ub1 Promoter [cultivar Nongda 105 (SEQ ID NO:10560); GenBank: DQ141598.1; Taylor et al., Plant Cell Rep 1993 12: 491-495, which is fully incorporated herein by reference; and cultivar B73 (SEQ ID NO:10561); Christensen, A H, et al. Plant Mol. Biol. 18 (4), 675-689 (1992), which is fully incorporated herein by reference]; rice actin 1 (SEQ ID NO:10562; Mc Elroy et al. 1990, The Plant Cell, Vol. 2, 163-171, which is fully incorporated herein by reference), rice GOS2 [SEQ ID NO: 10563 (rice GOS2 longer promoter) and SEQ ID NO: 10564 (rice GOS2 Promoter); De Pater et al. Plant J. 1992; 2: 837-44, which is fully incorporated herein by reference], arabidopsis Pho1 [SEQ ID NO: 10565 (arabidopsis Pho1 Promoter); Hamburger et al., Plant Cell. 2002; 14: 889-902, which is fully incorporated herein by reference], ExpansinB promoters, e.g., rice ExpB5 [SEQ ID NO:10566 (rice ExpB5 longer promoter) and SEQ ID NO: 10567 (rice ExpB5 promoter)] and Barley ExpB1 [SEQ ID NO: 10568 (barley ExpB1 Promoter), Won et al. Mol. Cells. 2010; 30:369-76, which is fully incorporated herein by reference], barley SS2 (sucrose synthase 2) [(SEQ ID NO: 10569), Guerin and Carbonero, *Plant Physiology May* 1997 vol. 114 no. 1 55-62, which is fully incorporated herein by reference], and rice PG5a [SEQ ID NO:10570, U.S. Pat. No. 7,700,835, Nakase et al., Plant Mol. Biol. 32:621-30, 1996, each of which is fully incorporated herein by reference].

Suitable constitutive promoters include, for example, CaMV 35S promoter [SEQ ID NO: 10571 (CaMV 35S (QFNC) Promoter); SEQ ID NO: 10572 (PJJ 35S from Brachypodium); SEQ ID NO: 10573 (CaMV 35S (OLD) Promoter) (Odell et al., Nature 313:810-812, 1985)], *Arabidopsis* At6669 promoter (SEQ ID NO: 10574 (*Arabidopsis* At6669 (OLD) Promoter); see PCT Publication No. WO04081173A2 or the new At6669 promoter (SEQ ID NO: 10575 (*Arabidopsis* At6669 (NEW) Promoter)); maize Ub1 Promoter [cultivar Nongda 105 (SEQ ID NO:10560); GenBank: DQ141598.1; Taylor et al., Plant Cell Rep 1993 12: 491-495, which is fully incorporated herein by reference; and cultivar B73 (SEQ ID NO:10561); Christensen, A H, et al. Plant Mol. Biol. 18 (4), 675-689 (1992), which is fully incorporated herein by reference]; rice actin 1 (SEQ ID NO: 10562, McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); rice GOS2 [SEQ ID NO: 10563 (rice GOS2 longer Promoter) and SEQ ID NO: 10564 (rice GOS2 Promoter), de Pater et al, Plant J Nov; 2(6):837-44, 1992]; RBCS promoter (SEQ ID NO:10576); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608, 149; 5,608,144; 5,604,121; 5,569,597: 5,466,785; 5,399, 680; 5,268,463; and 5,608,142.

Suitable tissue-specific promoters include, but not limited to, leaf-specific promoters [e.g., AT5G06690 (Thioredoxin) (high expression, SEQ ID NO: 10577), AT5G61520 (AtSTP3) (low expression, SEQ ID NO: 10578) described in Buttner et al 2000 Plant, Cell and Environment 23, 175-184, or the promoters described in Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993; as well as *Arabidopsis* STP3 (AT5G61520) promoter (Buttner et al., Plant, *Cell and Environment* 23:175-184, 2000)], seed-preferred promoters [e.g., Napin (originated from *Brassica napus* which is characterized by a seed specific promoter activity; Stuitje A. R. et. al. Plant Biotechnology Journal 1 (4): 301-309; SEQ ID NO: 10579 (*Brassica napus* NAPIN Promoter) from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), rice PG5a (SEQ ID NO: 10570; U.S. Pat. No. 7,700,835), early seed development *Arabidopsis* BAN (AT1G61720) (SEQ ID NO: 10580, US 2009/0031450 A1), late seed development *Arabidopsis* ABI3 (AT3G24650) (SEQ ID NO: 10581 (*Arabidopsis* ABI3 (AT3G24650) longer Promoter) or 10582 (*Arabidopsis* ABI3 (AT3G24650) Promoter)) (Ng et al., Plant Molecular Biology 54: 25-38, 2004), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143: 323-32 1990), napA (Stalberg, et al, Planta 199: 515-519, 1996), Wheat SPA (SEQ ID NO:10551; Albanietal, Plant Cell, 9: 171-184, 1997), sunflower oleosin (Cummins, et al., Plant Mol. Biol. 19: 873-876, 1992)], endosperm specific promoters [e.g., wheat LMW (SEQ ID NO: 10552 (Wheat LMW Longer Promoter), and SEQ ID NO: 10553 (Wheat LMW Promoter) and HMW glutenin-1 [(SEQ ID NO: 10552 (Wheat HMW glutenin-1 longer Promoter)); and SEQ ID NO: 10553 (Wheat HMW glutenin-1 Promoter), Thomas and Flavell, The Plant Cell 2:1171-1180, 1990; Mol Gen Genet. 216:81-90, 1989; NAR 17:461-2), wheat alpha, beta and gamma gliadins (SEQ ID NO: 10556 (wheat alpha gliadin (B genome) promoter); SEQ ID NO: 10557 (wheat gamma gliadin promoter); EMBO 3:1409-15, 1984), Barley ltr1 promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Barley SS2 (SEQ ID NO: 10569 (Barley SS2 Promoter); Guerin and Carbonero Plant Physiology 114: 1 55-62, 1997), wheat Tarp60 (Kovalchuk et al., Plant Mol Biol 71:81-98, 2009), barley D-hordein (D-Hor) and B-hordein (B-Hor) (Agnelo Furtado, Robert J. Henry and Alessandro Pellegrineschi (2009)], Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al., Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet. 217: 240-245; 1989), Arabidopsis apetala-3 (Tilly et al., Development. 125:1647-57, 1998), Arabidopsis APETALA 1 (AT1G69120, AP1) (SEQ ID NO: 10583 (Arabidopsis (AT1G69120) APETALA 1)) (Hempel et al., Development 124:3845-3853, 1997)], and root promoters [e.g., the ROOTP promoter [SEQ ID NO: 10584]; rice ExpB5 (SEQ ID NO:10567 (rice ExpB5 Promoter); or SEQ ID NO: 10566 (rice ExpB5 longer Promoter)) and barley ExpB1 promoters (SEQ ID NO: 10568) (Won et al. Mol. Cells. 30: 369-376, 2010); arabidopsis ATTPS-CIN (AT3G25820) promoter (SEQ ID NO: 10585; Chen et al., Plant Phys 135:1956-66, 2004); arabidopsis Pho1 promoter (SEQ ID NO: 10565, Hamburger et al., Plant Cell. 14: 889-902, 2002), which is also slightly induced by stress].

Suitable abiotic stress-inducible promoters include, but not limited to, salt-inducible promoters such as RD29A (Yamaguchi-Shinozalei et al., Mol. Gen. Genet. 236:331-340, 1993); drought-inducible promoters such as maize rab17 gene promoter (Pla et. al., Plant Mol. Biol. 21:259-266, 1993), maize rab28 gene promoter (Busk et. al., Plant J. 11:1285-1295, 1997) and maize Ivr2 gene promoter (Pelleschi et. al., Plant Mol. Biol. 39:373-380, 1999); heat-inducible promoters such as heat tomato hsp80-promoter from tomato (U.S. Pat. No. 5,187,267).

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol., Plant. Mol. Biol. (1991) 42:205-225; Shimamoto et al., Nature (1989) 338: 274-276).

The principle methods of causing stable integration of exogenous DNA into plant genomic DNA include two main approaches:

(i) *Agrobacterium*-mediated gene transfer: Klee et al. (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Amtzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, Tobacco mosaic virus (TMV), brome mosaic virus (BMV) and Bean Common Mosaic Virus (BV or BCMV). Transformation of plants using plant viruses is described in U.S. Pat. No. 4,855,237 (bean golden mosaic virus; BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Taylor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; Takamatsu et al. FEBS Letters (1990) 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the to subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since processes which increase yield, seed yield, growth rate, biomass, vigor, oil content, fiber yield, fiber quality, fertilizer use efficiency (e.g., nitrogen use efficiency) and/or abiotic stress tolerance yield of a plant can involve multiple genes acting additively or in synergy (see, for example, in Quesda et al., Plant Physiol. 130:951-063, 2002), the present invention also envisages expressing a plurality of exogenous polynucleotides in a single host plant to thereby achieve superior effect on oil content, yield, growth rate, biomass, vigor and/or abiotic stress tolerance.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, growth, biomass, yield and/or vigor traits, using conventional plant breeding techniques.

According to some embodiments of the invention, the method further comprising growing the plant expressing the exogenous polynucleotide under the abiotic stress.

Non-limiting examples of abiotic stress conditions include, salinity, osmotic stress, drought, water deprivation, excess of water (e.g., flood, waterlogging), etiolation, low temperature (e.g., cold stress), high temperature, heavy metal toxicity, anaerobiosis, nutrient deficiency, nutrient excess, atmospheric pollution and UV irradiation.

According to some embodiments of the invention, the method further comprising growing the plant expressing the exogenous polynucleotide under fertilizer limiting conditions (e.g., nitrogen-limiting conditions). Non-limiting examples include growing the plant on soils with low nitrogen content (40-50% Nitrogen of the content present under normal or optimal conditions), or even under sever nitrogen deficiency (0-10% Nitrogen of the content present under normal or optimal conditions).

Thus, the invention encompasses plants exogenously expressing the polynucleotide(s), the nucleic acid constructs and/or polypeptide(s) of the invention.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or to determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a wide range of economical plants, in a safe and cost effective manner.

Plant lines exogenously expressing the polynucleotide or the polypeptide of the invention are screened to identify those that show the greatest increase of the desired plant trait.

Thus, according to an additional embodiment of the present invention, there is provided a method of evaluating a trait of a plant, the method comprising: (a) expressing in a plant or a portion thereof the nucleic acid construct of some embodiments of the invention; and (b) evaluating a trait of a plant as compared to a wild type plant of the same type (e.g., a plant not transformed with the claimed biomolecules); thereby evaluating the trait of the plant.

According to an aspect of some embodiments of the invention there is provided a method of producing a crop comprising growing a crop of a plant expressing an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous (e.g., identical) to the amino acid sequence selected from the group consisting of SEQ ID NOs: 574-930, 6266-8621, and 8623-10550, wherein the plant is derived from a plant selected for increased fertilizer use efficiency (e.g., nitrogen use efficiency), increased oil content, increased yield, increased growth rate, increased biomass, increased vigor, increased fiber yield, increased fiber quality, and/or increased abiotic stress tolerance as compared to a control plant, thereby producing the crop.

According to an aspect of some embodiments of the invention there is provided a method of producing a crop comprising growing a crop of a plant expressing an exogenous polynucleotide which comprises a nucleic acid sequence which is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to the nucleic acid sequence selected from the group consisting of SEQ ID NOs: 1-573, and 931-6265, wherein the plant is derived from a plant selected for increased fertilizer use efficiency (e.g., nitrogen use efficiency), increased oil content, increased yield, increased growth rate, increased biomass, increased vigor, increased fiber yield, increased fiber quality, and/or increased abiotic stress tolerance as compared to a control plant, thereby producing the crop.

According to an aspect of some embodiments of the present invention there is provided a method of producing a crop comprising growing a crop of a plant transformed with an exogenous polynucleotide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% identical to the nucleic acid sequence selected from the group consisting of SEQ ID NOs: 1-573, and 931-626, wherein the crop plant is derived from plants selected for increased yield, increased growth rate, increased biomass, increased vigor, increased oil content, increased seed yield, increased fiber yield, increased fiber quality, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased nitrogen use efficiency, and/or increased abiotic stress tolerance, thereby producing the crop.

According to an aspect of some embodiments of the present invention there is provided a method of producing a crop comprising growing a crop plant transformed with an exogenous polynucleotide encoding a polypeptide at least 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% homologous to the amino acid sequence selected from the group consisting of SEQ ID NOs: 574-930, 6266-8621, and 8623-10550, wherein the crop plant is derived from plants selected for increased yield, increased growth rate, increased biomass, increased vigor, increased oil content, increased seed yield, increased fiber yield, increased fiber quality, increased nitrogen use efficiency, and/or increased abiotic stress tolerance as compared to a wild type plant of the same species which is grown under the same growth conditions, and the crop plant having the increased yield, increased growth rate, increased biomass, increased vigor, increased oil content, increased seed yield, increased fiber yield, increased fiber quality, increased nitrogen use efficiency, and/or increased abiotic stress tolerance, thereby producing the crop. According to an aspect of some embodiments of the invention there is provided a method of growing a crop comprising seeding seeds and/or planting plantlets of a plant transformed with the exogenous polynucleotide of the invention, e.g., the polynucleotide which encodes the polypeptide of some embodiments of the invention, wherein the plant is derived from plants selected for at least one trait selected from the group consisting of increased abiotic stress tolerance, increased nitrogen use efficiency, increased biomass, increased growth rate, increased vigor, increased yield and increased fiber yield or quality as compared to a non-transformed plant.

According to some embodiments of the invention the method of growing a crop comprising seeding seeds and/or planting plantlets of a plant transformed with an exogenous polynucleotide comprising a nucleic acid sequence encoding a polypeptide at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 574-930, 6266-8621, 8623-10549 or 10550, wherein the plant is derived from plants selected for at least one trait selected from the group consisting of increased abiotic stress tolerance, increased nitrogen use efficiency, increased biomass, increased growth rate, increased vigor, increased yield and increased fiber yield or quality, increased oil content as compared to a non-transformed plant, thereby growing the crop.

According to some embodiments of the invention the method of growing a crop comprising seeding seeds and/or planting plantlets of a plant transformed with an exogenous polynucleotide comprising the nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to SEQ ID NO: 1-573, 931-6264 or 6265, wherein the plant is derived from plants selected for at least one trait selected from the group consisting of increased abiotic stress tolerance, increased nitrogen use efficiency, increased biomass, increased growth rate, increased vigor, increased yield and increased fiber yield or quality, increased oil content as compared to a non-transformed plant, thereby growing the crop.

The effect of the transgene (the exogenous polynucleotide encoding the polypeptide) on abiotic stress tolerance can be determined using known methods such as detailed below and in the Examples section which follows.

Abiotic stress tolerance—Transformed (i.e., expressing the transgene) and non-transformed (wild type) plants are exposed to an abiotic stress condition, such as water deprivation, suboptimal temperature (low temperature, high temperature), nutrient deficiency, nutrient excess, a salt stress condition, osmotic stress, heavy metal toxicity, anaerobiosis, atmospheric pollution and UV irradiation.

Salinity tolerance assay—Transgenic plants with tolerance to high salt concentrations are expected to exhibit better germination, seedling vigor or growth in high salt. Salt stress can be effected in many ways such as, for example, by irrigating the plants with a hyperosmotic solution, by cultivating the plants hydroponically in a hyperosmotic growth solution (e.g., Hoagland solution), or by culturing the plants in a hyperosmotic growth medium [e.g., 50% Murashige-Skoog medium (MS medium)]. Since different plants vary considerably in their tolerance to salinity, the salt concentration in the irrigation water, growth solution, or growth medium can be adjusted according to the specific characteristics of the specific plant cultivar or variety, so as to inflict a mild or moderate effect on the physiology and/or morphology of the plants (for guidelines as to appropriate concentration see, Bernstein and Kafkafi, Root Growth Under Salinity Stress In: Plant Roots, The Hidden Half 3rd ed. Waisel Y, Eshel A and Kafkafi U. (editors) Marcel Dekker Inc., New York, 2002, and reference therein).

For example, a salinity tolerance test can be performed by irrigating plants at different developmental stages with increasing concentrations of sodium chloride (for example 50 mM, 100 mM, 200 mM, 400 mM NaCl) applied from the bottom and from above to ensure even dispersal of salt. Following exposure to the stress condition the plants are frequently monitored until substantial physiological and/or morphological effects appear in wild type plants. Thus, the external phenotypic appearance, degree of wilting and overall success to reach maturity and yield progeny are compared between control and transgenic plants.

Quantitative parameters of tolerance measured include, but are not limited to, the average wet and dry weight, growth rate, leaf size, leaf coverage (overall leaf area), the weight of the seeds yielded, the average seed size and the number of seeds produced per plant. Transformed plants not exhibiting substantial physiological and/or morphological effects, or exhibiting higher biomass than wild-type plants, are identified as abiotic stress tolerant plants.

Osmotic tolerance test—Osmotic stress assays (including sodium chloride and mannitol assays) are conducted to determine if an osmotic stress phenotype was sodium chloride-specific or if it was a general osmotic stress related phenotype. Plants which are tolerant to osmotic stress may have more tolerance to drought and/or freezing. For salt and osmotic stress germination experiments, the medium is supplemented for example with 50 mM, 100 mM, 200 mM NaCl or 100 mM, 200 mM NaCl, 400 mM mannitol.

Drought tolerance assay/Osmoticum assay—Tolerance to drought is performed to identify the genes conferring better plant survival after acute water deprivation. To analyze whether the transgenic plants are more tolerant to drought, an osmotic stress produced by the non-ionic osmolyte sorbitol in the medium can be performed. Control and transgenic plants are germinated and grown in plant-agar plates for 4 days, after which they are transferred to plates containing 500 mM sorbitol. The treatment causes growth retardation, then both control and transgenic plants are compared, by measuring plant weight (wet and dry), yield, and by growth rates measured as time to flowering.

Conversely, soil-based drought screens are performed with plants overexpressing the polynucleotides detailed above. Seeds from control *Arabidopsis* plants, or other transgenic plants overexpressing the polypeptide of the invention are germinated and transferred to pots. Drought stress is obtained after irrigation is ceased accompanied by placing the pots on absorbent paper to enhance the soil-drying rate. Transgenic and control plants are compared to each other when the majority of the control plants develop severe wilting. Plants are re-watered after obtaining a significant fraction of the control plants displaying a severe wilting. Plants are ranked comparing to controls for each of two criteria: tolerance to the drought conditions and recovery (survival) following re-watering.

Cold stress tolerance—To analyze cold stress, mature (25 day old) plants are transferred to 4° C. chambers for 1 or 2 weeks, with constitutive light. Later on plants are moved back to greenhouse. Two weeks later damages from chilling period, resulting in growth retardation and other phenotypes, are compared between both control and transgenic plants, by measuring plant weight (wet and dry), and by comparing growth rates measured as time to flowering, plant size, yield, and the like.

Heat stress tolerance—Heat stress tolerance is achieved by exposing the plants to temperatures above 34° C. for a certain period. Plant tolerance is examined after transferring the plants back to 22° C. for recovery and evaluation after 5 days relative to internal controls (non-transgenic plants) or plants not exposed to neither cold or heat stress.

Water use efficiency—can be determined as the biomass produced per unit transpiration. To analyze WUE, leaf relative water content can be measured in control and transgenic plants. Fresh weight (FW) is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to the following Formula I:

$$RWC=[(FW-DW)/(TW-DW)]\times 100 \qquad \text{Formula I}$$

Fertilizer use efficiency—To analyze whether the transgenic plants are more responsive to fertilizers, plants are grown in agar plates or pots with a limited amount of fertilizer, as described, for example, in Yanagisawa et al (Proc Natl Acad Sci USA. 2004; 101:7833-8). The plants are analyzed for their overall size, time to flowering, yield, protein content of shoot and/or grain. The parameters checked are the overall size of the mature plant, its wet and dry weight, the weight of the seeds yielded, the average seed size and the number of seeds produced per plant. Other parameters that may be tested are: the chlorophyll content of leaves (as nitrogen plant status and the degree of leaf verdure is highly correlated), amino acid and the total protein content of the seeds or other plant parts such as leaves or shoots, oil content, etc. Similarly, instead of providing nitrogen at limiting amounts, phosphate or potassium can be added at increasing concentrations. Again, the same parameters measured are the same as listed above. In this way, nitrogen use efficiency (NUE), phosphate use efficiency (PUE) and potassium use efficiency (KUE) are assessed, checking the ability of the transgenic plants to thrive under nutrient restraining conditions.

Nitrogen use efficiency—To analyze whether the transgenic plants (e.g., *Arabidopsis* plants) are more responsive to nitrogen, plant are grown in 0.75-3 mM (nitrogen deficient conditions) or 6-10 mM (optimal nitrogen concentration). Plants are allowed to grow for additional 25 days or until seed production. The plants are then analyzed for their overall size, time to flowering, yield, protein content of shoot and/or grain/seed production. The parameters checked can be the overall size of the plant, wet and dry weight, the weight of the seeds yielded, the average seed size and the number of seeds produced per plant. Other parameters that may be tested are: the chlorophyll content of leaves (as nitrogen plant status and the degree of leaf greenness is highly correlated), amino acid and the total protein content of the seeds or other plant parts such as leaves or shoots and oil content. Transformed plants not exhibiting substantial physiological and/or morphological effects, or exhibiting higher measured parameters levels than wild-type plants, are identified as nitrogen use efficient plants.

Nitrogen Use efficiency assay using plantlets—The assay is done according to Yanagisawa-S. et al. with minor modifications ("Metabolic engineering with Dof1 transcription factor in plants: Improved nitrogen assimilation and growth under low-nitrogen conditions" *Proc. Natl. Acad. Sci. USA* 101, 7833-7838). Briefly, transgenic plants which are grown for 7-10 days in 0.5×MS [Murashige-Skoog] supplemented with a selection agent are transferred to two nitrogen-limiting conditions: MS media in which the combined nitrogen concentration ($NH_4NO_3$ and $KNO_3$) was 0.75 mM (nitrogen deficient conditions) or 6-15 mM (optimal nitrogen concentration). Plants are allowed to grow for additional 30-40 days and then photographed, individually removed from the Agar (the shoot without the roots) and immediately weighed (fresh weight) for later statistical analysis. Constructs for which only T1 seeds are available are sown on selective media and at least 20 seedlings (each one representing an independent transformation event) are carefully transferred to the nitrogen-limiting media. For constructs for which T2 seeds are available, different transformation events are analyzed. Usually, 20 randomly selected plants from each event are transferred to the nitrogen-limiting media allowed to grow for 3-4 additional weeks and individually weighed at the end of that period. Transgenic plants are compared to control plants grown in parallel under the same conditions. Mock-transgenic plants expressing the uidA reporter gene (GUS) under the same promoter or transgenic plants carrying the same promoter but lacking a reporter gene are used as control.

Nitrogen determination—The procedure for N (nitrogen) concentration determination in the structural parts of the plants involves the potassium persulfate digestion method to convert organic N to $NO_3^-$ (Purcell and King 1996 Argon. J. 88:111-113, the modified $Cd^-$ mediated reduction of $NO_3^-$ to $NO_2^-$ (Vodovotz 1996 Biotechniques 20:390-394) and the measurement of nitrite by the Griess assay (Vodovotz 1996, supra). The absorbance values are measured at 550 nm against a standard curve of NaNO$_2$. The procedure is described in details in Samonte et al. 2006 Agron. J. 98:168-176.

Germination tests—Germination tests compare the percentage of seeds from transgenic plants that could complete the germination process to the percentage of seeds from control plants that are treated in the same manner. Normal conditions are considered for example, incubations at 22° C. under 22-hour light 2-hour dark daily cycles. Evaluation of germination and seedling vigor is conducted between 4 and 14 days after planting. The basal media is 50% MS medium (Murashige and Skoog, 1962 Plant Physiology 15, 473-497).

Germination is checked also at unfavorable conditions such as cold (incubating at temperatures lower than 10° C. instead of 22° C.) or using seed inhibition solutions that contain high concentrations of an osmolyte such as sorbitol (at concentrations of 50 mM, 100 mM, 200 mM, 300 mM, 500 mM, and up to 1000 mM) or applying increasing concentrations of salt (of 50 mM, 100 mM, 200 mM, 300 mM, 500 mM NaCl).

The effect of the transgene on plant's vigor, growth rate, biomass, yield and/or oil content can be determined using known methods.

Plant vigor—The plant vigor can be calculated by the increase in growth parameters such as leaf area, fiber length, rosette diameter, plant fresh weight and the like per time.

Growth rate—The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Evaluation of growth rate can be done by measuring plant biomass produced, rosette area, leaf size or root length per time (can be measured in cm$^2$ per day of leaf area).

Relative growth area can be calculated using Formula II.

Relative growth rate area=Regression coefficient of area along time course.  Formula II:

Thus, the relative growth area rate is in units of 1/day and length growth rate is in units of 1/day.

Seed yield—Evaluation of the seed yield per plant can be done by measuring the amount (weight or size) or quantity (i.e., number) of dry seeds produced and harvested from 8-16 plants and divided by the number of plants.

For example, the total seeds from 8-16 plants can be collected, weighted using e.g., an analytical balance and the total weight can be divided by the number of plants. Seed yield per growing area can be calculated in the same manner while taking into account the growing area given to a single plant. Increase seed yield per growing area could be achieved by increasing seed yield per plant, and/or by increasing number of plants capable of growing in a given area.

In addition, seed yield can be determined via the weight of 1000 seeds. The weight of 1000 seeds can be determined as follows: seeds are scattered on a glass tray and a picture is taken. Each sample is weighted and then using the digital analysis, the number of seeds in each sample is calculated.

The 1000 seeds weight can be calculated using formula III:

1000 Seed Weight=number of seed in sample/sample weight×1000  Formula III:

The Harvest Index can be calculated using Formula IV

Harvest Index=Average seed yield per plant/Average dry weight  Formula IV:

Grain protein concentration—Grain protein content (g grain protein m$^{-2}$) is estimated as the product of the mass of grain N (g grain N m$^{-2}$) multiplied by the N/protein conversion ratio of k-5.13 (Mosse 1990, supra). The grain protein concentration is estimated as the ratio of grain protein content per unit mass of the grain (g grain protein kg$^{-1}$ grain).

Fiber length—Fiber length can be measured using fibrograph. The fibrograph system was used to compute length in terms of "Upper Half Mean" length. The upper half mean (UHM) is the average length of longer half of the fiber distribution. The fibrograph measures length in span lengths at a given percentage point (Hypertext to Transfer Protocol://WorldWide Web (dot) cottoninc (dot) com/ClassificationofCotton/?Pg=4#Length).

According to some embodiments of the invention, increased yield of corn may be manifested as one or more of the following: increase in the number of plants per growing area, increase in the number of ears per plant, increase in the number of rows per ear, number of kernels per ear row, kernel weight, thousand kernel weight (1000-weight), ear length/diameter, increase oil content per kernel and increase starch content per kernel.

As mentioned, the increase of plant yield can be determined by various parameters. For example, increased yield of rice may be manifested by an increase in one or more of the following: number of plants per growing area, number of panicles per plant, number of spikelets per panicle, number of flowers per panicle, increase in the seed filling rate, increase in thousand kernel weight (1000-weight), increase oil content per seed, increase starch content per seed, among others. An increase in yield may also result in modified architecture, or may occur because of modified architecture.

Similarly, increased yield of soybean may be manifested by an increase in one or more of the following: number of plants per growing area, number of pods per plant, number of seeds per pod, increase in the seed filling rate, increase in thousand seed weight (1000-weight), reduce pod shattering, increase oil content per seed, increase protein content per seed, among others. An increase in yield may also result in modified architecture, or may occur because of modified architecture.

Increased yield of canola may be manifested by an increase in one or more of the following: number of plants per growing area, number of pods per plant, number of seeds per pod, increase in the seed filling rate, increase in thousand seed weight (1000-weight), reduce pod shattering, increase oil content per seed, among others. An increase in yield may also result in modified architecture, or may occur because of modified architecture.

Increased yield of cotton may be manifested by an increase in one or more of the following: number of plants per growing area, number of bolls per plant, number of seeds per boll, increase in the seed filling rate, increase in thousand seed weight (1000-weight), increase oil content per seed, improve fiber length, fiber strength, among others. An increase in yield may also result in modified architecture, or may occur because of modified architecture.

Oil content—The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light.

Thus, the present invention is of high agricultural value for promoting the yield of commercially desired crops (e.g., biomass of vegetative organ such as poplar wood, or reproductive organ such as number of seeds or seed biomass).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods. According to some embodiments of the invention, the oil comprises a seed oil.

According to some embodiments of the invention, the oil comprises a vegetative portion oil (oil of the vegetative portion of the plant).

According to some embodiments of the invention, the plant cell forms a part of a plant.

According to another embodiment of the present invention, there is provided a food or feed comprising the plants or a portion thereof of the present invention.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges to between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Binen et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton &

Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

General Experimental and Bioinformatics Methods

RNA extraction—Tissues growing at various growth conditions (as described below) were sampled and RNA was extracted using TRIzol Reagent from Invitrogen [Hypertext Transfer Protocol://World Wide Web (dot) invitrogen (dot) com/content (dot)cfm?pageid=469]. Approximately 30-50 mg of tissue was taken from samples. The weighed tissues were ground using pestle and mortar in liquid nitrogen and resuspended in 500 µl of TRIzol Reagent. To the homogenized lysate, 100 µl of chloroform was to added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA). For convenience, each microarray expression information tissue type has received an expression Set ID.

Correlation analysis—was performed for selected genes according to some embodiments of the invention, in which the characterized parameters (measured parameters according to the correlation IDs) were used as "X axis" for correlation with the tissue transcriptom, which was used as the "Y axis". For each gene and measured parameter a correlation coefficient "R" was calculated (using Pearson correlation) along with a p-value for the significance of the correlation. When the correlation coefficient (R) between the levels of a gene's expression in a certain tissue and a phenotypic performance across ecotypes/variety/hybrid is high in absolute value (between 0.5-1), there is an association between the gene (specifically the expression level of this gene) the phenotypic characteristic (e.g., improved yield, growth rate, nitrogen use efficiency, abiotic stress tolerance and the like).

Example 1

Identifying Genes which Improve Yield and Agronomically Important Traits in Plants The present inventors have identified polynucleotides which expression thereof in plants can increase yield, fiber yield, fiber quality, growth rate, vigor, biomass, growth rate, oil content, abiotic stress tolerance (ABST), fertilizer use efficiency (FUE) such as nitrogen use efficiency (NUE), and water use efficiency (WUE) of a plant, as follows.

All nucleotide sequence datasets used here were originated from publicly to available databases or from performing sequencing using the Solexa technology (e.g. Barley and *Sorghum*). Sequence data from 100 different plant species was introduced into a single, comprehensive database. Other information on gene expression, protein annotation, enzymes and pathways were also incorporated.

Major databases used include:

Genomes

*Arabidopsis* genome [TAIR genome version 6 (Hypertext Transfer Protocol://World Wide Web (dot) *arabidopsis* (dot) org/)]

Rice genome [IRGSP build 4.0 (Hypertext Transfer Protocol://rgp (dot) dna (dot) affrc (dot) go (dot) jp/IRGSP/)].

Poplar [*Populus trichocarpa* release 1.1 from JGI (assembly release v1.0) (Hypertext Transfer Protocol://World Wide Web (dot) genome (dot) jgi-psf (dot) org/)]

Brachypodium [JGI 4× assembly, Hypertext Transfer Protocol://World Wide Web (dot) brachpodium (dot) org)]

Soybean [DOE-JGI SCP, version Glyma0 (Hypertext Transfer Protocol://World Wide Web (dot) phytozome (dot) net/)]

Grape [French-Italian Public Consortium for Grapevine Genome Characterization grapevine genome (Hypertext Transfer Protocol://World Wide Web (dot) genoscope (dot) cns (dot) fr/)]

Castobean [TIGR/J Craig Venter Institute 4× assembly [(Hypertext Transfer Protocol://msc (dot) jcvi (dot) org/r communis]

*Sorghum* [DOE-JGI SCP, version Sbi1 [Hypertext Transfer Protocol://World Wide Web (dot) phytozome (dot) net/)].

Partially assembled genome of Maize [Hypertext Transfer Protocol://maizesequence (dot) org/]

Expressed EST and mRNA Sequences were Extracted from the Following Databases:

GenBank Hypertext Transfer Protocol://World Wide Web (dot) ncbi (dot) nlm (dot) nih (dot) gov/dbEST RefSeq (Hypertext Transfer Protocol://World Wide Web (dot) ncbi (dot) nlm (dot) nih (dot) gov/RefSeq/).

TAIR (Hypertext Transfer Protocol://World Wide Web (dot) *arabidopsis* (dot) org/).

Protein and Pathway Databases

Uniprot [Hypertext Transfer Protocol://World Wide Web (dot) uniprot (dot) org/].

AraCyc [Hypertext Transfer Protocol://World Wide Web (dot) *arabidopsis* (dot) org/biocyc/index (dot) jsp].

ENZYME [Hypertext Transfer Protocol://expasy (dot) org/enzyme/].

Microarray Datasets were Downloaded from:

GEO (Hypertext Transfer Protocol://World Wide Web.ncbi.nlm.nih gov/geo/)

TAIR (Hypertext Transfer Protocol://World Wide Web.arabidopsis.org/).

Proprietary microarray data (WO2008/122980).

QTL and SNPs Information

Gramene [Hypertext Transfer Protocol://World Wide Web (dot) gramene (dot) org/qtl/].

Panzea [Hypertext Transfer Protocol://World Wide Web (dot) panzea (dot) org/index (dot) html].

Database Assembly—was performed to build a wide, rich, reliable annotated and easy to analyze database comprised of publicly available genomic mRNA, ESTs DNA sequences, data from various crops as well as gene expression, protein annotation and pathway data QTLs, and other relevant information.

Database assembly is comprised of a toolbox of gene refining, structuring, annotation and analysis tools enabling to construct a tailored database for each gene discovery project. Gene refining and structuring tools enable to reliably detect splice variants and antisense transcripts, generating understanding of various potential phenotypic outcomes of a single gene. The capabilities of the "LEADS" platform of Compugen LTD for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST clustering and gene assembly—For gene clustering and assembly of organisms with available genome sequence data (*arabidopsis*, rice, castorbean, grape, brachypodium, poplar, soybean, *sorghum*) the genomic LEADS version (GANG) was to employed. This tool allows most accurate clustering of ESTs and mRNA sequences on genome, and predicts gene structure as well as alternative splicing events and anti-sense transcription.

For organisms with no available full genome sequence data, "expressed LEADS" clustering software was applied.

Gene annotation—Predicted genes and proteins were annotated as follows:

Blast search [Hypertext Transfer Protocol://blast (dot) ncbi (dot) nlm (dot) nih (dot) gov/Blast (dot) cgi] against all plant UniProt [Hypertext Transfer Protocol://World Wide Web (dot) uniprot (dot) org/] sequences was performed. Open reading frames of each putative transcript were analyzed and longest ORF with higher number of homologues was selected as predicted protein of the transcript. The predicted proteins were analyzed by InterPro [Hypertext Transfer Protocol://World Wide Web (dot) ebi (dot) ac (dot) uk/interpro/].

Blast against proteins from AraCyc and ENZYME databases was used to map the predicted transcripts to AraCyc pathways.

Predicted proteins from different species were compared using blast algorithm [Hypertext Transfer Protocol://World Wide Web (dot) ncbi (dot) nlm (dot) nih (dot) gov/Blast (dot) cgi] to validate the accuracy of the predicted protein sequence, and for efficient detection of orthologs.

Gene expression profiling—Several data sources were exploited for gene expression profiling, namely microarray data and digital expression profile (see below). According to gene expression profile, a correlation analysis was performed to identify genes which are co-regulated under different development stages and environmental conditions and associated with different phenotypes.

Publicly available microarray datasets were downloaded from TAIR and NCBI GEO sites, renormalized, and integrated into the database. Expression profiling is one of the most important resource data for identifying genes important for yield.

A digital expression profile summary was compiled for each cluster according to all keywords included in the sequence records comprising the cluster. Digital expression, also known as electronic Northern Blot, is a tool that displays virtual expression profile based on the EST sequences forming the gene cluster. The tool to provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis Of The Melon Fruit Transcriptome Based On 454 Pyrosequencing) in: Plant & Animal Genomes XVII Conference, San Diego, Calif. Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags, that assembled into 67,477 unigenes (32,357 singletons and 35,120 contigs). Analysis of the data obtained against the Cucurbit Genomics Database [Hypertext Transfer Protocol://World Wide Web (dot) icugi (dot) org/] confirmed the accuracy of the sequencing and assembly. Expression patterns of selected genes fitted well their qRT-PCR data.

Overall, 242 genes (SEQ ID NOs: 1-573 for polynucleotides; SEQ ID NOs: 574-930 for polypeptides) were identified to have a major impact on plant yield, fiber yield, fiber quality, growth rate, vigor, biomass, growth rate, oil content, abiotic stress tolerance, nitrogen use efficiency, water use efficiency and/or fertilizer use efficiency when expression thereof is increased in plants. The identified genes, their curated polynucleotide and polypeptide sequences, their updated sequences according to Genbank database and the sequences of the cloned genes and proteins are summarized to in Table 1, hereinbelow.

TABLE 1

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM751 | arabidopsis\|10v1\|AT4G04640 | arabidopsis | 1 | 574 |
| LYM752 | arabidopsis\|10v1\|AT3G18850 | arabidopsis | 2 | 575 |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM753 | arabidopsis\|10v1\|AT1G11390 | arabidopsis | 3 | 576 |
| LYM754 | arabidopsis\|10v1\|AT5G06800 | arabidopsis | 4 | 577 |
| LYM755 | barley\|10v2\|AV833513 | barley | 5 | 578 |
| LYM756 | barley\|10v2\|AV835159 | barley | 6 | 579 |
| LYM757 | barley\|10v2\|AV924606 | barley | 7 | 580 |
| LYM758 | barley\|10v2\|BE195600 | barley | 8 | 581 |
| LYM759 | berley\|10v2\|BE195715 | barley | 9 | 582 |
| LYM760 | berley\|10v2\|BE413175 | barley | 10 | 583 |
| LYM761 | barley\|10v2\|BE421023XX2 | barley | 11 | 584 |
| LYM762 | barley\|10v2\|BI947330 | barley | 12 | 585 |
| LYM763 | barley\|10v2\|BI953862 | barley | 13 | 586 |
| LYM764 | barley\|10v2\|BQ466718 | barley | 14 | 587 |
| LYM765 | brachypodium\|09v1\|BRADI1G61270 | brachypodium | 15 | 588 |
| LYM766 | brachypodium\|09v1\|DV475587 | brachypodium | 16 | 589 |
| LYM767 | brachypodium\|09v1\|DV475900 | brachypodium | 17 | 590 |
| LYM768 | brachypodium\|09v1\|DV484992 | brachypodium | 18 | 591 |
| LYM769 | brachypodium\|09v1\|DV487876 | brachypodium | 19 | 592 |
| LYM770 | brachypodium\|09v1\|DV488569 | brachypodium | 20 | 593 |
| LYM771 | brachypodium\|09v1\|GT764168 | brachypodium | 21 | 594 |
| LYM772 | brachypodium\|09v1\|GT765880 | brachypodium | 22 | 595 |
| LYM773 | brachypodium\|09v1\|GT766594 | brachypodium | 23 | 596 |
| LYM774 | foxtail_millet\|10v2\|FXTRMSLX00438373D2 | foxtail_millet | 24 | 597 |
| LYM775 | foxtail_millet\|11v3\|EC612534 | foxtail_millet | 25 | 598 |
| LYM776 | foxtail_millet\|11v3\|EC612958 | foxtail_millet | 26 | 599 |
| LYM777 | foxtail_millet\|11v3\|EC613028 | foxtail_millet | 27 | 600 |
| LYM778 | foxtail_millet\|11v3\|PHY7SI000720M | foxtail_millet | 28 | 601 |
| LYM779 | foxtail_millet\|11v3\|PHY7SI003519M | foxtail_millet | 29 | 602 |
| LYM780 | foxtail_millet\|11v3\|PHY7SI006329M | foxtail_millet | 30 | 603 |
| LYM781 | foxtail_millet\|11v3\|PHY7SI008506M | foxtail_millet | 31 | 604 |
| LYM782 | foxtail_millet\|11v3\|PHY7SI013054M | foxtail_millet | 32 | 605 |
| LYM783 | foxtail_millet\|11v3\|PHY7SI017318M | foxtail_millet | 33 | 606 |
| LYM784 | foxtail_millet\|11v3\|PHY7SI018849M | foxtail_millet | 34 | 607 |
| LYM785 | foxtail_millet\|11v3\|PHY7SI022017M | foxtail_millet | 35 | 608 |
| LYM786 | foxtail_millet\|11v3\|PHY7SI022359M | foxtail_millet | 36 | 609 |
| LYM787 | foxtail_millet\|11v3\|PHY7SI023441M | foxtail_millet | 37 | 610 |
| LYM788 | foxtail_millet\|11v3\|PHY7SI029348M | foxtail_millet | 38 | 611 |
| LYM789 | foxtail_millet\|11v3\|PHY7SI029497M | foxtail_millet | 39 | 612 |
| LYM790 | foxtail_millet\|11v3\|PHY7SI030847M | foxtail_millet | 40 | 613 |
| LYM791 | foxtail_millet\|11v3\|PHY7SI031055M | foxtail_millet | 41 | 614 |
| LYM792 | foxtail_millet\|11v3\|PHY7SI031295M | foxtail_millet | 42 | 615 |
| LYM793 | foxtail_millet\|11v3\|PHY7SI033179M | foxtail_millet | 43 | 616 |
| LYM794 | foxtail_millet\|11v3\|PHY7SI037622M | foxtail_millet | 44 | 617 |
| LYM795 | foxtail_millet\|11v3\|PHY7SI037675M | foxtail_millet | 45 | 618 |
| LYM796 | foxtail_millet\|11v3\|PHY7SI038189M | foxtail_millet | 46 | 619 |
| LYM797 | foxtail_millet\|11v3\|SOLX00019413 | foxtail_millet | 47 | 620 |
| LYM798 | maize\|10v1\|AI372232 | maize | 48 | 621 |
| LYM799 | maize\|10v1\|AI372303 | maize | 49 | 622 |
| LYM800 | maize\|10v1\|AI396221 | maize | 50 | 623 |
| LYM801 | maize\|10v1\|AI438912 | maize | 51 | 624 |
| LYM802 | maize\|10v1\|AI491261 | maize | 52 | 625 |
| LYM803 | maize\|10v1\|AI491475 | maize | 53 | 626 |
| LYM804 | maize\|10v1\|AI600385 | maize | 54 | 627 |
| LYM805 | maize\|10v1\|AI603694 | maize | 55 | 628 |
| LYM806 | maize\|10v1\|AI649787 | maize | 56 | 629 |
| LYM807 | maize\|10v1\|AI665169 | maize | 57 | 630 |
| LYM808 | maize\|10v1\|AI665888 | maize | 58 | 631 |
| LYM809 | maize\|10v1\|AI666115 | maize | 59 | 632 |
| LYM811 | maize\|10v1\|AI691232 | maize | 60 | 633 |
| LYM812 | maize\|10v1\|AI737934 | maize | 61 | 634 |
| LYM813 | maize\|10v1\|AI738334 | maize | 62 | 635 |
| LYM814 | maize\|10v1\|AI783250 | maize | 63 | 636 |
| LYM815 | maize\|10v1\|AI795752 | maize | 64 | 637 |
| LYM816 | maize\|10v1\|AI855369 | maize | 65 | 638 |
| LYM817 | maize\|10v1\|AI861138 | maize | 66 | 639 |
| LYM818 | maize\|10v1\|AI861258 | maize | 67 | 640 |
| LYM819 | maize\|10v1\|AI932148 | maize | 68 | 641 |
| LYM820 | maize\|10v1\|AI941699 | maize | 69 | 642 |
| LYM821 | maize\|10v1\|AI942003 | maize | 70 | 643 |
| LYM822 | maize\|10v1\|AI947519 | maize | 71 | 644 |
| LYM823 | maize\|10v1\|AI974875 | maize | 72 | 645 |
| LYM824 | maize\|10v1\|AI979448 | maize | 73 | 646 |
| LYM825 | maize\|10v1\|AI987278 | maize | 74 | 647 |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM826 | maize\|10v1\|AW352643 | maize | 75 | 648 |
| LYM827 | maize\|10v1\|AW400274 | maize | 76 | 649 |
| LYM828 | maize\|10v1\|AW562661 | maize | 77 | 650 |
| LYM829 | maize\|10v1\|BE056888 | maize | 78 | 651 |
| LYM830 | maize\|10v1\|BE345593 | maize | 79 | 652 |
| LYM831 | maize\|10v1\|BE509603 | maize | 80 | 653 |
| LYM832 | maize\|10v1\|BE510544 | maize | 81 | 654 |
| LYM834 | maize\|10v1\|BE552792 | maize | 82 | 655 |
| LYM835 | maize\|10v1\|BG458632 | maize | 83 | 656 |
| LYM836 | maize\|10v1\|BG837019 | maize | 84 | 657 |
| LYM837 | maize\|10v1\|BG838028 | maize | 85 | 658 |
| LYM838 | maize\|10v1\|BG873811 | maize | 86 | 659 |
| LYM839 | maize\|10v1\|BM080812 | maize | 87 | 660 |
| LYM840 | maize\|10v1\|BM338998 | maize | 88 | 661 |
| LYM841 | maize\|10v1\|BM382081 | maize | 89 | 662 |
| LYM842 | maize\|10v1\|BM382166 | maize | 90 | 663 |
| LYM843 | maize\|10v1\|BM500406 | maize | 91 | 664 |
| LYM844 | maize\|10v1\|CA403121 | maize | 92 | 665 |
| LYM845 | maize\|10v1\|CD001428 | maize | 93 | 666 |
| LYM846 | maize\|10v1\|CD944422 | maize | 94 | 667 |
| LYM847 | maize\|10v1\|CF050534 | maize | 95 | 668 |
| LYM848 | maize\|10v1\|CK145345 | maize | 96 | 669 |
| LYM849 | maize\|10v1\|CO453057 | maize | 97 | 670 |
| LYM850 | maize\|10v1\|CO453497 | maize | 98 | 671 |
| LYM851 | maize\|10v1\|DN204877 | maize | 99 | 672 |
| LYM852 | maize\|10v1\|DR796464 | maize | 100 | 673 |
| LYM853 | maize\|10v1\|DV533152 | maize | 101 | 674 |
| LYM856 | maize\|10v1\|SRR014550S0110996 | maize | 102 | 675 |
| LYM857 | maize\|10v1\|T12754 | maize | 103 | 676 |
| LYM858 | maize\|10v1\|T27550 | maize | 104 | 677 |
| LYM859 | maize\|10v1\|W49435 | maize | 105 | 678 |
| LYM860 | maize\|10v1\|AW447871 | maize | 106 | 679 |
| LYM861 | maize\|gb170\|AW787640 | maize | 107 | 680 |
| LYM863 | rice\|11v1\|AA753213 | rice | 108 | 681 |
| LYM864 | rice\|11v1\|AU069296 | rice | 109 | 682 |
| LYM865 | rice\|11v1\|AU083562 | rice | 110 | 683 |
| LYM865 | rice\|11v1\|AU083562 | rice | 110 | 838 |
| LYM866 | rice\|11v1\|AU093962 | rice | 111 | 684 |
| LYM867 | rice\|11v1\|AU100843 | rice | 112 | 685 |
| LYM868 | rice\|11v1\|AU175037 | rice | 113 | 686 |
| LYM869 | rice\|11v1\|BI799960 | rice | 114 | 687 |
| LYM870 | rice\|11v1\|BI803342 | rice | 115 | 688 |
| LYM871 | rice\|11v1\|BI805026 | rice | 116 | 689 |
| LYM872 | rice\|11v1\|BM038189 | rice | 117 | 690 |
| LYM873 | rice\|11v1\|CA764413 | rice | 118 | 691 |
| LYM874 | rice\|11v1\|CB639668 | rice | 119 | 692 |
| LYM875 | rice\|11v1\|CB966820 | rice | 120 | 693 |
| LYM876 | rice\|11v1\|CF335997 | rice | 121 | 694 |
| LYM877 | rice\|11v1\|CX117725 | rice | 122 | 695 |
| LYM878 | rice\|gb170\|OS01G04350 | rice | 123 | 696 |
| LYM879 | rice\|gb170\|OS02G52260 | rice | 124 | 697 |
| LYM880 | rice\|gb170\|OS06G28970 | rice | 125 | 698 |
| LYM881 | sorghum\|09v1\|SB01G027680 | sorghum | 126 | 699 |
| LYM882 | sorghum\|12v1\|SB02G034370 | sorghum | 127 | 700 |
| LYM883 | sorghum\|09v1\|SB03G007210 | sorghum | 128 | 701 |
| LYM884 | sorghum\|09v1\|SB03G025470 | sorghum | 129 | 702 |
| LYM885 | sorghum\|09v1\|SB04G034880 | sorghum | 130 | 703 |
| LYM886 | sorghum\|09v1\|SB05G025920 | sorghum | 131 | 704 |
| LYM887 | sorghum\|09v1\|SB06G022820 | sorghum | 132 | 705 |
| LYM888 | sorghum\|09v1\|SB06G025170 | sorghum | 133 | 706 |
| LYM889 | sorghum\|09v1\|SB07G027500 | sorghum | 134 | 707 |
| LYM890 | sorghum\|09v1\|SB07G029200 | sorghum | 135 | 708 |
| LYM891 | sorghum\|09v1\|SB07G029220 | sorghum | 136 | 709 |
| LYM892 | sorghum\|09v1\|SB08G004050 | sorghum | 137 | 710 |
| LYM893 | sorghum\|09v1\|SB08G015290 | sorghum | 138 | 711 |
| LYM894 | sorghum\|09v1\|SB08G018930 | sorghum | 139 | 712 |
| LYM895 | sorghum\|09v1\|SB09G019100 | sorghum | 140 | 713 |
| LYM896 | sorghum\|09v1\|SB09G025910 | sorghum | 141 | 714 |
| LYM897 | sorghum\|09v1\|SB10G015890 | sorghum | 142 | 715 |
| LYM898 | sorghum\|09v1\|SB10G028050 | sorghum | 143 | 716 |
| LYM899 | sorghum\|11v1\|AI724370 | sorghum | 144 | 717 |
| LYM900 | sorghum\|11v1\|BE352856 | sorghum | 145 | 718 |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM901 | sorghum\|11v1\|BE600925 | sorghum | 146 | 719 |
| LYM903 | sorghum\|11v1\|CF770485 | sorghum | 147 | 720 |
| LYM904 | sorghum\|11v1\|SB01G003940 | sorghum | 148 | 721 |
| LYM905 | sorghum\|11v1\|SB01G006390 | sorghum | 149 | 722 |
| LYM906 | sorghum\|11v1\|SB01G009270 | sorghum | 150 | 723 |
| LYM907 | sorghum\|11v1\|SB01G009850 | sorghum | 151 | 724 |
| LYM908 | sorghum\|11v1\|SB01G017960 | sorghum | 152 | 725 |
| LYM909 | sorghum\|11v1\|SB01G031760 | sorghum | 153 | 726 |
| LYM910 | sorghum\|11v1\|SB01G032620 | sorghum | 154 | 727 |
| LYM911 | sorghum\|11v1\|SB01G049670 | sorghum | 155 | 728 |
| LYM912 | sorghum\|11v1\|SB02G005100 | sorghum | 156 | 729 |
| LYM913 | sorghum\|11v1\|SB02G006600 | sorghum | 157 | 730 |
| LYM914 | sorghum\|11v1\|SB02G006860 | sorghum | 158 | 731 |
| LYM915 | sorghum\|11v1\|SB02G008120 | sorghum | 159 | 732 |
| LYM916 | sorghum\|11v1\|SB02G010770 | sorghum | 160 | 733 |
| LYM917 | sorghum\|11v1\|SB02G024590 | sorghum | 161 | 734 |
| LYM919 | sorghum\|11v1\|SB02G028880 | sorghum | 162 | 735 |
| LYM920 | sorghum\|11v1\|SB02G029540 | sorghum | 163 | 736 |
| LYM921 | sorghum\|11v1\|SB02G031540 | sorghum | 164 | 737 |
| LYM922 | sorghum\|11v1\|SB02G035470 | sorghum | 165 | 738 |
| LYM923 | sorghum\|11v1\|SB02G035610 | sorghum | 166 | 739 |
| LYM924 | sorghum\|11v1\|SB02G037800 | sorghum | 167 | 740 |
| LYM925 | sorghum\|11v1\|SB03G000890 | sorghum | 168 | 741 |
| LYM926 | sorghum\|11v1\|SB03G003830 | sorghum | 169 | 742 |
| LYM927 | sorghum\|11v1\|SB03G003950 | sorghum | 170 | 743 |
| LYM928 | sorghum\|11v1\|SB03G003970 | sorghum | 171 | 744 |
| LYM929 | sorghum\|11v1\|SB03G006010 | sorghum | 172 | 745 |
| LYM930 | sorghum\|11v1\|SB03G008850 | sorghum | 173 | 746 |
| LYM931 | sorghum\|11v1\|SB03G025480 | sorghum | 174 | 747 |
| LYM932 | sorghum\|11v1\|SB03G028290 | sorghum | 175 | 748 |
| LYM933 | sorghum\|11v1\|SB03G034070 | sorghum | 176 | 749 |
| LYM934 | sorghum\|11v1\|SB04G012430 | sorghum | 177 | 750 |
| LYM935 | sorghum\|11v1\|SB04G020630 | sorghum | 178 | 751 |
| LYM936 | sorghum\|11v1\|SB04G024070 | sorghum | 179 | 752 |
| LYM937 | sorghum\|11v1\|SB04G025070 | sorghum | 180 | 753 |
| LYM938 | sorghum\|11v1\|SB04G027350 | sorghum | 181 | 754 |
| LYM939 | sorghum\|11v1\|SB04G028930 | sorghum | 182 | 755 |
| LYM940 | sorghum\|11v1\|SB04G032490 | sorghum | 183 | 756 |
| LYM941 | sorghum\|12v1\|SB04G034810 | sorghum | 184 | 757 |
| LYM942 | sorghum\|11v1\|SB04G038610 | sorghum | 185 | 758 |
| LYM943 | sorghum\|11v1\|SB0514S002010 | sorghum | 186 | 759 |
| LYM944 | sorghum\|11v1\|SB05G010328 | sorghum | 187 | 760 |
| LYM945 | sorghum\|11v1\|SB05G020920 | sorghum | 188 | 761 |
| LYM946 | sorghum\|11v1\|SB06G001130 | sorghum | 189 | 762 |
| LYM947 | sorghum\|11v1\|SB06G016660 | sorghum | 190 | 763 |
| LYM948 | sorghum\|11v1\|SB06G027510 | sorghum | 191 | 764 |
| LYM949 | sorghum\|11v1\|SB06G032200 | sorghum | 192 | 765 |
| LYM950 | sorghum\|11v1\|SB07G004990 | sorghum | 193 | 766 |
| LYM951 | sorghum\|11v1\|SB07G022250 | sorghum | 194 | 767 |
| LYM952 | sorghum\|11v1\|SB07G023340 | sorghum | 195 | 768 |
| LYM953 | sorghum\|11v1\|SB08G000475 | sorghum | 196 | 769 |
| LYM954 | sorghum\|11v1\|SB08G001720 | sorghum | 197 | 770 |
| LYM955 | sorghum\|11v1\|SB08G016720 | sorghum | 198 | 771 |
| LYM956 | sorghum\|11v1\|SB08G017230 | sorghum | 199 | 772 |
| LYM957 | sorghum\|11v1\|SB09G020470 | sorghum | 200 | 773 |
| LYM958 | sorghum\|11v1\|SB09G022700 | sorghum | 201 | 774 |
| LYM959 | sorghum\|11v1\|SB09G024340 | sorghum | 202 | 775 |
| LYM960 | sorghum\|11v1\|SB09G029440 | sorghum | 203 | 776 |
| LYM961 | sorghum\|11v1\|SB10G007228 | sorghum | 204 | 777 |
| LYM962 | sorghum\|11v1\|SB10G012180 | sorghum | 205 | 778 |
| LYM963 | sorghum\|11v1\|SB10G012200 | sorghum | 206 | 779 |
| LYM964 | sorghum\|11v1\|SB10G020840 | sorghum | 207 | 780 |
| LYM965 | sorghum\|11v1\|SB10G022550 | sorghum | 208 | 781 |
| LYM966 | sorghum\|11v1\|SB10G023040 | sorghum | 209 | 782 |
| LYM967 | sorghum\|11v1\|SB10G031120 | sorghum | 210 | 783 |
| LYM972 | sorghum\|12v1\|SB02G018650 | sorghum | 211 | 784 |
| LYM974 | sorghum\|12v1\|SB03G035810 | sorghum | 212 | 785 |
| LYM975 | sorghum\|12v1\|SB03G042280 | sorghum | 213 | 786 |
| LYM976 | sorghum\|12v1\|SB04G034340 | sorghum | 214 | 787 |
| LYM977 | sorghum\|12v1\|SB07G002500 | sorghum | 215 | 788 |
| LYM979 | sorghum\|gb161.crp\|AW287671 | sorghum | 216 | 789 |
| LYM980 | soybean\|11v1\|GLYMA05G08810 | soybean | 217 | 790 |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM981 | soybean\|11v1\|GLYMA05G28910 | soybean | 218 | 791 |
| LYM982 | soybean\|11v1\|GLYMA05G34130 | soybean | 219 | 792 |
| LYM983 | soybean\|11v1\|GLYMA08G18720 | soybean | 220 | 793 |
| LYM984 | soybean\|11v1\|GLYMA14G05500 | soybean | 221 | 794 |
| LYM985 | soybean\|11v1\|GLYMA15G14460 | soybean | 222 | 795 |
| LYM986 | soybean\|11v1\|GLYMA16G01870 | soybean | 223 | 796 |
| LYM987 | soybean\|11v1\|GLYMA17G13930 | soybean | 224 | 797 |
| LYM988 | soybean\|11v1\|GLYMA20G02080 | soybean | 225 | 798 |
| LYM989 | tomato\|11v1\|BG127600 | tomato | 226 | 799 |
| LYM990 | tomato\|11v1\|BG626650 | tomato | 227 | 800 |
| LYM991 | wheat\|10v2\|BE217019 | wheat | 228 | 801 |
| LYM992 | wheat\|10v2\|BE398612 | wheat | 229 | 802 |
| LYM993 | wheat\|10v2\|BE400064 | wheat | 230 | 803 |
| LYM994 | wheat\|10v2\|BE400597 | wheat | 231 | 804 |
| LYM995 | wheat\|10v2\|BE403288 | wheat | 232 | 805 |
| LYM996 | wheat\|10v2\|BE415908 | wheat | 233 | 806 |
| LYM997 | wheat\|10v2\|BE417205 | wheat | 234 | 807 |
| LYM998 | wheat\|10v2\|BE418199 | wheat | 235 | 808 |
| LYM999 | wheat\|10v2\|BE426667 | wheat | 236 | 809 |
| LYM1000 | wheat\|10v2\|BE429087 | wheat | 237 | 810 |
| LYM1001 | wheat\|10v2\|BE488633 | wheat | 238 | 811 |
| LYM1002 | wheat\|10v2\|BE490379 | wheat | 239 | 812 |
| LYM1003 | wheat\|10v2\|BE590649 | wheat | 240 | 813 |
| LYM1004 | wheat\|10v2\|BG909921 | wheat | 241 | 814 |
| LYM1005 | wheat\|10v2\|BQ238355 | wheat | 242 | 815 |
| LYM1006 | wheat\|10v2\|BU099700 | wheat | 243 | 816 |
| LYM1007 | wheat\|10v2\|CD917055 | wheat | 244 | 817 |
| LYM1008 | rice\|gb170\|OS07G34610 | rice | 245 | 818 |
| LYM1009 | sorghum\|09v1\|SB10G027700 | sorghum | 246 | 819 |
| LYM1007_H2 | maize\|10v1\|CO526204 | maize | 247 | 820 |
| LYM817_H1 | maize\|10v1\|BF729515 | maize | 248 | 821 |
| LYM830_H4 | maize\|10v1\|CD953131 | maize | 249 | 822 |
| LYM888_H1 | foxtail_millet\|11v3\|PHY7SI009766M | foxtail_millet | 250 | 823 |
| LYM901_H1 | maize\|10v1\|BG320271 | maize | 251 | 824 |
| LYM964_H1 | maize\|10v1\|BG937347 | maize | 252 | 825 |
| LYM833 | maize\|10v1\|BE510873 | maize | 253 | — |
| LYM833 | maize\|10v1\|BE510873 | maize | 253 | 835 |
| LYM855 | maize\|10v1\|DW776976 | maize | 254 | — |
| LYM862 | maize\|gb170\|BE186191 | maize | 255 | — |
| LYM902 | sorghum\|11v1\|CF432100 | sorghum | 256 | — |
| LYM902 | sorghum\|11v1\|CF432100 | sorghum | 256 | — |
| LYM968 | sorghum\|12v1\|BF585660 | sorghum | 257 | — |
| LYM969 | sorghum\|12v1\|CD204994 | sorghum | 258 | — |
| LYM970 | sorghum\|12v1\|CD426798 | sorghum | 259 | — |
| LYM971 | sorghum\|12v1\|CF760983 | sorghum | 260 | — |
| LYM978 | sorghum\|12v1\|SB09G029126 | sorghum | 261 | — |
| LYM978 | sorghum\|12v1\|SB09G029126 | sorghum | 261 | — |
| LYM756 | barley\|10v2\|AV835159 | barley | 262 | 826 |
| LYM765 | brachypodium\|09v1\|BRADI1G61270 | brachypodium | 263 | 588 |
| LYM767 | brachypodium\|09v1\|DV475900 | brachypodium | 264 | 590 |
| LYM768 | brachypodium\|09v1\|DV484992 | brachypodium | 265 | 827 |
| LYM770 | brachypodium\|09v1\|DV488569 | brachypodium | 266 | 593 |
| LYM773 | brachypodium\|09v1\|GT766594 | brachypodium | 267 | 596 |
| LYM774 | foxtail_millet\|10v2\|FXTRMSLX00438373D2 | foxtail_millet | 268 | 597 |
| LYM778 | foxtail_millet\|11v3\|PHY7SI000720M | foxtail_millet | 269 | 828 |
| LYM780 | foxtail_millet\|11v3\|PHY7SI006329M | foxtail_millet | 270 | 603 |
| LYM782 | foxtail_millet\|11v3\|PHY7SI013054M | foxtail_millet | 271 | 605 |
| LYM784 | foxtail_millet\|11v3\|PHY7SI018849M | foxtail_millet | 272 | 607 |
| LYM785 | foxtail_millet\|11v3\|PHY7SI022017M | foxtail_millet | 273 | 829 |
| LYM787 | foxtail_millet\|11v3\|PHY7SI023441M | foxtail_millet | 274 | 830 |
| LYM788 | foxtail_millet\|11v3\|PHY7SI029348M | foxtail_millet | 275 | 831 |
| LYM793 | foxtail_millet\|11v3\|PHY7SI033179M | foxtail_millet | 276 | 616 |
| LYM802 | maize\|10v1\|AI491261 | maize | 277 | 625 |
| LYM803 | maize\|10v1\|AI491475 | maize | 278 | 626 |
| LYM813 | maize\|10v1\|AI738334 | maize | 279 | 832 |
| LYM815 | maize\|10v1\|AI795752 | maize | 280 | 637 |
| LYM819 | maize\|10v1\|AI932148 | maize | 281 | 833 |
| LYM831 | maize\|10v1\|BE509603 | maize | 282 | 834 |
| LYM838 | maize\|10v1\|BG873811 | maize | 283 | 836 |
| LYM856 | maize\|10v1\|SRR014550S0110996 | maize | 284 | 675 |
| LYM862 | maize\|gb170\|BE186191 | maize | 285 | 837 |
| LYM863 | rice\|11v1\|AA753213 | rice | 286 | 681 |

TABLE 1-continued

Identified genes for increasing yield, growth rate, vigor, biomass, growth rate, oil content,
fiber yield, fiber quality, abiotic stress tolerance, nitrogen use efficiency, water use efficiency
and fertilizer use efficiency of a plant

| Gene Name | Cluster Name | Organism | Polyn. SEQ ID NO: | Polyp. SEQ ID NO: |
|---|---|---|---|---|
| LYM872 | rice\|11v1\|BM038189 | rice | 287 | 839 |
| LYM876 | rice\|11v1\|CF335997 | rice | 288 | 840 |
| LYM882 | sorghum\|09v1\|SB02G034370 | sorghum | 289 | 700 |
| LYM890 | sorghum\|09v1\|SB07G029200 | sorghum | 290 | 841 |
| LYM893 | sorghum\|09v1\|SB08G015290 | sorghum | 291 | 842 |
| LYM896 | sorghum\|09v1\|SB09G025910 | sorghum | 292 | 714 |
| LYM899 | sorghum\|11v1\|AI724370 | sorghum | 293 | 843 |
| LYM902 | sorghum\|11v1\|CF432100 | sorghum | 294 | 844 |
| LYM908 | sorghum\|11v1\|SB01G017960 | sorghum | 295 | 725 |
| LYM910 | sorghum\|11v1\|SB01G032620 | sorghum | 296 | 845 |
| LYM914 | sorghum\|11v1\|SB02G006860 | sorghum | 297 | 846 |
| LYM917 | sorghum\|11v1\|SB02G024590 | sorghum | 298 | 847 |
| LYM921 | sorghum\|11v1\|SB02G031540 | sorghum | 299 | 737 |
| LYM932 | sorghum\|11v1\|SB03G028290 | sorghum | 300 | 748 |
| LYM934 | sorghum\|11v1\|SB04G012430 | sorghum | 301 | 848 |
| LYM937 | sorghum\|11v1\|SB04G025070 | sorghum | 302 | 849 |
| LYM938 | sorghum\|11v1\|SB04G027350 | sorghum | 303 | 754 |
| LYM939 | sorghum\|11v1\|SB04G028930 | sorghum | 304 | 755 |
| LYM941 | sorghum\|11v1\|SB04G034810 | sorghum | 305 | 757 |
| LYM943 | sorghum\|11v1\|SB0514S002010 | sorghum | 306 | 850 |
| LYM951 | sorghum\|11v1\|SB07G022250 | sorghum | 307 | 851 |
| LYM957 | sorghum\|11v1\|SB09G020470 | sorghum | 308 | 773 |
| LYM961 | sorghum\|11v1\|SB10G007228 | sorghum | 309 | 777 |
| LYM964 | sorghum\|11v1\|SB10G020840 | sorghum | 310 | 780 |
| LYM965 | sorghum\|11v1\|SB10G022550 | sorghum | 311 | 781 |
| LYM975 | sorghum\|11v1\|SB03G042280 | sorghum | 312 | 852 |
| LYM979 | sorghum\|gb161.crp\|AW287671 | sorghum | 313 | 853 |
| LYM982 | soybean\|11v1\|GLYMA05G34130 | soybean | 314 | 792 |
| LYM983 | soybean\|11v1\|GLYMA08G18720 | soybean | 315 | 854 |
| LYM984 | soybean\|11v1\|GLYMA14G05500 | soybean | 316 | 855 |
| LYM988 | soybean\|11v1\|GLYMA20G02080 | soybean | 317 | 798 |
| LYM994 | wheat\|10v2\|BE400597 | wheat | 318 | 856 |
| LYM998 | wheat\|10v2\|BE418199 | wheat | 319 | 808 |
| LYM999 | wheat\|10v2\|BE426667 | wheat | 320 | 857 |
| LYM1000 | wheat\|10v2\|BE429087 | wheat | 321 | 858 |
| LYM1001 | wheat\|10v2\|BE488633 | wheat | 322 | 859 |
| LYM1003 | wheat\|10v2\|BE590649 | wheat | 323 | 860 |
| LYM1004 | wheat\|10v2\|BG909921 | wheat | 324 | 861 |
| LYM1005 | wheat\|10v2\|BQ238355 | wheat | 325 | 815 |
| LYM1006 | wheat\|10v2\|BU099700 | wheat | 326 | 816 |
| LYM1007 | wheat\|10v2\|CD917055 | wheat | 327 | 862 |
| LYM1007_H2 | maize\|10v1\|CO526204 | maize | 328 | 820 |
| LYM817_H1 | maize\|10v1\|BF729515 | maize | 329 | 863 |
| LYM969 | sorghum\|12v1\|CD204994 | sorghum | 330 | — |
| LYM970 | sorghum\|12v1\|CD426798 | sorghum | 331 | — |
| LYM971 | sorghum\|12v1\|CF760983 | sorghum | 332 | — |
| LYM978 | sorghum\|12v1\|SB09G029126 | sorghum | 333 | — |
| LYM751 | arabidopsis\|10v1\|AT4G04640 | arabidopsis | 334 | 574 |
| LYM752 | arabidopsis\|10v1\|AT3G18850 | arabidopsis | 335 | 575 |
| LYM753 | arabidopsis\|10v1\|AT1G11390 | arabidopsis | 336 | 576 |
| LYM754 | arabidopsis\|10v1\|AT5G06800 | arabidopsis | 337 | 577 |
| LYM755 | barley\|10v2\|AV833513 | barley | 338 | 578 |
| LYM756 | barley\|10v2\|AV835159 | barley | 339 | 864 |
| LYM757 | barley\|10v2\|AV924606 | barley | 340 | 580 |
| LYM758 | barley\|10v2\|BE195600 | barley | 341 | 581 |
| LYM759 | barley\|10v2\|BE195715 | barley | 342 | 582 |
| LYM760 | barley\|10v2\|BE413175 | barley | 343 | 583 |
| LYM761 | barley\|10v2\|BE421023XX2 | barley | 344 | 584 |
| LYM762 | barley\|10v2\|BI947330 | barley | 345 | 585 |
| LYM763 | barley\|10v2\|BI953862 | barley | 346 | 586 |
| LYM764 | barley\|10v2\|BQ466718 | barley | 347 | 587 |
| LYM765 | brachypodium\|09v1\|BRADI1G61270 | brachypodium | 348 | 588 |
| LYM766 | brachypodium\|09v1\|DV475587 | brachypodium | 349 | 589 |
| LYM767 | brachypodium\|09v1\|DV475900 | brachypodium | 350 | 865 |
| LYM768 | brachypodium\|09v1\|DV484992 | brachypodium | 351 | 866 |
| LYM769 | brachypodium\|09v1\|DV487876 | brachypodium | 352 | 592 |
| LYM770 | brachypodium\|09v1\|DV488569 | brachypodium | 353 | 867 |
| LYM771 | brachypodium\|09v1\|GT764168 | brachypodium | 354 | 868 |
| LYM773 | brachypodium\|09v1\|GT766594 | brachypodium | 355 | 596 |
| LYM774 | foxtail_millet\|10v2\|FXTRMSLX00438373D2 | foxtail_millet | 356 | 597 |
| LYM775 | foxtail_millet\|11v3\|EC612534 | foxtail_millet | 357 | 598 |
| LYM776 | foxtail_millet\|11v3\|EC612958 | foxtail_millet | 358 | 869 |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM777 | foxtail_millet\|11v3\|EC613028 | foxtail_millet | 359 | 600 |
| LYM778 | foxtail_millet\|11v3\|PHY7SI000720M | foxtail_millet | 360 | 870 |
| LYM779 | foxtail_millet\|11v3\|PHY7SI003519M | foxtail_millet | 361 | 602 |
| LYM780 | foxtail_millet\|11v3\|PHY7SI006329M | foxtail_millet | 362 | 603 |
| LYM781 | foxtail_millet\|11v3\|PHY7SI008506M | foxtail_millet | 363 | 604 |
| LYM782 | foxtail_millet\|11v3\|PHY7SI013054M | foxtail_millet | 364 | 605 |
| LYM783 | foxtail_millet\|11v3\|PHY7SI017318M | foxtail_millet | 365 | 606 |
| LYM784 | foxtail_millet\|11v3\|PHY7SI018849M | foxtail_millet | 366 | 607 |
| LYM785 | foxtail_millet\|11v3\|PHY7SI022017M | foxtail_millet | 367 | 608 |
| LYM786 | foxtail_millet\|11v3\|PHY7SI022359M | foxtail_millet | 368 | 609 |
| LYM787 | foxtail_millet\|11v3\|PHY7SI023441M | foxtail_millet | 369 | 610 |
| LYM788 | foxtail_millet\|11v3\|PHY7SI029348M | foxtail_millet | 370 | 611 |
| LYM789 | foxtail_millet\|11v3\|PHY7SI029497M | foxtail_millet | 371 | 612 |
| LYM790 | foxtail_millet\|11v3\|PHY7SI030847M | foxtail_millet | 372 | 613 |
| LYM791 | foxtail_millet\|11v3\|PHY7SI031055M | foxtail_millet | 373 | 614 |
| LYM792 | foxtail_millet\|11v3\|PHY7SI031295M | foxtail_millet | 374 | 615 |
| LYM793 | foxtail_millet\|11v3\|PHY7SI033179M | foxtail_millet | 375 | 616 |
| LYM794 | foxtail_millet\|11v3\|PHY7SI037622M | foxtail_millet | 376 | 871 |
| LYM795 | foxtail_millet\|11v3\|PHY7SI037675M | foxtail_millet | 377 | 618 |
| LYM796 | foxtail_millet\|11v3\|PHY7SI038189M | foxtail_millet | 378 | 619 |
| LYM797 | foxtail_millet\|11v3\|SOLX00019413 | foxtail_millet | 379 | 620 |
| LYM798 | maize\|10v1\|AI372232 | maize | 380 | 621 |
| LYM799 | maize\|10v1\|AI372303 | maize | 381 | 622 |
| LYM800 | maize\|10v1\|AI396221 | maize | 382 | 872 |
| LYM801 | maize\|10v1\|AI438912 | maize | 383 | 873 |
| LYM802 | maize\|10v1\|AI491261 | maize | 384 | 625 |
| LYM803 | maize\|10v1\|AI491475 | maize | 385 | 626 |
| LYM804 | maize\|10v1\|AI600385 | maize | 386 | 627 |
| LYM805 | maize\|10v1\|AI603694 | maize | 387 | 874 |
| LYM806 | maize\|10v1\|AI649787 | maize | 388 | 875 |
| LYM807 | maize\|10v1\|AI665169 | maize | 389 | 630 |
| LYM808 | maize\|10v1\|AI665888 | maize | 390 | 876 |
| LYM809 | maize\|10v1\|AI666115 | maize | 391 | 877 |
| LYM811 | maize\|10v1\|AI691232 | maize | 392 | 878 |
| LYM812 | maize\|10v1\|AI737934 | maize | 393 | 879 |
| LYM813 | maize\|10v1\|AI738334 | maize | 394 | 880 |
| LYM814 | maize\|10v1\|AI783250 | maize | 395 | 881 |
| LYM815 | maize\|10v1\|AI795752 | maize | 396 | 637 |
| LYM816 | maize\|10v1\|AI855369 | maize | 397 | 882 |
| LYM818 | maize\|10v1\|AI861258 | maize | 398 | 640 |
| LYM819 | maize\|10v1\|AI932148 | maize | 399 | 883 |
| LYM820 | maize\|10v1\|AI941699 | maize | 400 | 884 |
| LYM821 | maize\|10v1\|AI942003 | maize | 401 | 643 |
| LYM823 | maize\|10v1\|AI974875 | maize | 402 | 645 |
| LYM824 | maize\|10v1\|AI979448 | maize | 403 | 885 |
| LYM825 | maize\|10v1\|AI987278 | maize | 404 | 886 |
| LYM826 | maize\|10v1\|AW352643 | maize | 405 | 648 |
| LYM827 | maize\|10v1\|AW400274 | maize | 406 | 649 |
| LYM828 | maize\|10v1\|AW562661 | maize | 407 | 650 |
| LYM829 | maize\|10v1\|BE056888 | maize | 408 | 651 |
| LYM831 | maize\|10v1\|BE509603 | maize | 409 | 887 |
| LYM832 | maize\|10v1\|BE510544 | maize | 410 | 888 |
| LYM834 | maize\|10v1\|BE552792 | maize | 411 | 889 |
| LYM835 | maize\|10v1\|BG458632 | maize | 412 | 890 |
| LYM836 | maize\|10v1\|BG837019 | maize | 413 | 891 |
| LYM837 | maize\|10v1\|BG838028 | maize | 414 | 658 |
| LYM838 | maize\|10v1\|BG873811 | maize | 415 | 892 |
| LYM839 | maize\|10v1\|BM080812 | maize | 416 | 660 |
| LYM840 | maize\|10v1\|BM338998 | maize | 417 | 661 |
| LYM841 | maize\|10v1\|BM382081 | maize | 418 | 893 |
| LYM842 | maize\|10v1\|BM382166 | maize | 419 | 663 |
| LYM843 | maize\|10v1\|BM500406 | maize | 420 | 894 |
| LYM844 | maize\|10v1\|CA403121 | maize | 421 | 895 |
| LYM845 | maize\|10v1\|CD001428 | maize | 422 | 896 |
| LYM846 | maize\|10v1\|CD944422 | maize | 423 | 897 |
| LYM847 | maize\|10v1\|CF050534 | maize | 424 | 898 |
| LYM848 | maize\|10v1\|CK145345 | maize | 425 | 669 |
| LYM849 | maize\|10v1\|CO453057 | maize | 426 | 899 |
| LYM851 | maize\|10v1\|DN204877 | maize | 427 | 672 |
| LYM852 | maize\|10v1\|DR796464 | maize | 428 | 900 |
| LYM853 | maize\|10v1\|DV533152 | maize | 429 | 674 |
| LYM856 | maize\|10v1\|SRR014550S0110996 | maize | 430 | 675 |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM857 | maize\|10v1\|T12754 | maize | 431 | 901 |
| LYM858 | maize\|10v1\|T27550 | maize | 432 | 677 |
| LYM859 | maize\|10v1\|W49435 | maize | 433 | 902 |
| LYM863 | rice\|11v1\|AA753213 | rice | 434 | 681 |
| LYM864 | rice\|11v1\|AU069296 | rice | 435 | 682 |
| LYM865 | rice\|11v1\|AU083562 | rice | 436 | 683 |
| LYM866 | rice\|11v1\|AU093962 | rice | 437 | 684 |
| LYM867 | rice\|11v1\|AU100843 | rice | 438 | 685 |
| LYM868 | rice\|11v1\|AU175037 | rice | 439 | 686 |
| LYM869 | rice\|11v1\|BI799960 | rice | 440 | 687 |
| LYM870 | rice\|11v1\|BI803342 | rice | 441 | 688 |
| LYM871 | rice\|11v1\|BI805026 | rice | 442 | 689 |
| LYM872 | rice\|11v1\|BM038189 | rice | 443 | 690 |
| LYM873 | rice\|11v1\|CA764413 | rice | 444 | 691 |
| LYM874 | rice\|11v1\|CB639668 | rice | 445 | 692 |
| LYM875 | rice\|11v1\|CB966820 | rice | 446 | 693 |
| LYM876 | rice\|11v1\|CF335997 | rice | 447 | 694 |
| LYM877 | rice\|11v1\|CX117725 | rice | 448 | 695 |
| LYM878 | rice\|gb170\|OS01G04350 | rice | 449 | 696 |
| LYM879 | rice\|gb170\|OS02G52260 | rice | 450 | 697 |
| LYM880 | rice\|gb170\|OS06G28970 | rice | 451 | 698 |
| LYM881 | sorghum\|09v1\|SB01G027680 | sorghum | 452 | 699 |
| LYM882 | sorghum\|09v1\|SB02G034370 | sorghum | 453 | 700 |
| LYM883 | sorghum\|09v1\|SB03G007210 | sorghum | 454 | 701 |
| LYM884 | sorghum\|09v1\|SB03G025470 | sorghum | 455 | 702 |
| LYM885 | sorghum\|09v1\|SB04G034880 | sorghum | 456 | 703 |
| LYM886 | sorghum\|09v1\|SB05G025920 | sorghum | 457 | 704 |
| LYM887 | sorghum\|09v1\|SB06G022820 | sorghum | 458 | 903 |
| LYM889 | sorghum\|09v1\|SB07G027500 | sorghum | 459 | 707 |
| LYM890 | sorghum\|09v1\|SB07G029200 | sorghum | 460 | 904 |
| LYM891 | sorghum\|09v1\|SB07G029220 | sorghum | 461 | 709 |
| LYM892 | sorghum\|09v1\|SB08G004050 | sorghum | 462 | 710 |
| LYM894 | sorghum\|09v1\|SB08G018930 | sorghum | 463 | 712 |
| LYM895 | sorghum\|09v1\|SB09G019100 | sorghum | 464 | 905 |
| LYM896 | sorghum\|09v1\|SB09G025910 | sorghum | 465 | 714 |
| LYM897 | sorghum\|09v1\|SB10G015890 | sorghum | 466 | 715 |
| LYM898 | sorghum\|09v1\|SB10G028050 | sorghum | 467 | 716 |
| LYM899 | sorghum\|11v1\|AI724370 | sorghum | 468 | 717 |
| LYM900 | sorghum\|11v1\|BE352856 | sorghum | 469 | 718 |
| LYM904 | sorghum\|11v1\|SB01G003940 | sorghum | 470 | 721 |
| LYM905 | sorghum\|11v1\|SB01G006390 | sorghum | 471 | 722 |
| LYM906 | sorghum\|11v1\|SB01G009270 | sorghum | 472 | 723 |
| LYM907 | sorghum\|11v1\|SB01G009850 | sorghum | 473 | 724 |
| LYM908 | sorghum\|11v1\|SB01G017960 | sorghum | 474 | 725 |
| LYM909 | sorghum\|11v1\|SB01G031760 | sorghum | 475 | 726 |
| LYM910 | sorghum\|11v1\|SB01G032620 | sorghum | 476 | 727 |
| LYM911 | sorghum\|11v1\|SB01G049670 | sorghum | 477 | 728 |
| LYM912 | sorghum\|11v1\|SB02G005100 | sorghum | 478 | 729 |
| LYM913 | sorghum\|11v1\|SB02G006600 | sorghum | 479 | 730 |
| LYM914 | sorghum\|11v1\|SB02G006860 | sorghum | 480 | 906 |
| LYM915 | sorghum\|11v1\|SB02G008120 | sorghum | 481 | 732 |
| LYM916 | sorghum\|11v1\|SB02G010770 | sorghum | 482 | 907 |
| LYM917 | sorghum\|11v1\|SB02G024590 | sorghum | 483 | 908 |
| LYM919 | sorghum\|11v1\|SB02G028880 | sorghum | 484 | 735 |
| LYM920 | sorghum\|11v1\|SB02G029540 | sorghum | 485 | 736 |
| LYM921 | sorghum\|11v1\|SB02G031540 | sorghum | 486 | 909 |
| LYM922 | sorghum\|11v1\|SB02G035470 | sorghum | 487 | 738 |
| LYM923 | sorghum\|11v1\|SB02G035610 | sorghum | 488 | 739 |
| LYM924 | sorghum\|11v1\|SB02G037800 | sorghum | 489 | 740 |
| LYM925 | sorghum\|11v1\|SB03G000890 | sorghum | 490 | 741 |
| LYM926 | sorghum\|11v1\|SB03G003830 | sorghum | 491 | 742 |
| LYM927 | sorghum\|11v1\|SB03G003950 | sorghum | 492 | 743 |
| LYM928 | sorghum\|11v1\|SB03G003970 | sorghum | 493 | 744 |
| LYM929 | sorghum\|11v1\|SB03G006010 | sorghum | 494 | 745 |
| LYM930 | sorghum\|11v1\|SB03G008850 | sorghum | 495 | 746 |
| LYM931 | sorghum\|11v1\|SB03G025480 | sorghum | 496 | 747 |
| LYM932 | sorghum\|11v1\|SB03G028290 | sorghum | 497 | 748 |
| LYM933 | sorghum\|11v1\|SB03G034070 | sorghum | 498 | 749 |
| LYM934 | sorghum\|11v1\|SB04G012430 | sorghum | 499 | 750 |
| LYM935 | sorghum\|11v1\|SB04G020630 | sorghum | 500 | 751 |
| LYM936 | sorghum\|11v1\|SB04G024070 | sorghum | 501 | 752 |
| LYM937 | sorghum\|11v1\|SB04G025070 | sorghum | 502 | 753 |

TABLE 1-continued

Identified genes for increasing yield, growth rate, vigor, biomass, growth rate, oil content,
fiber yield, fiber quality, abiotic stress tolerance, nitrogen use efficiency, water use efficiency
and fertilizer use efficiency of a plant

| Gene Name | Cluster Name | Organism | Polyn. SEQ ID NO: | Polyp. SEQ ID NO: |
| --- | --- | --- | --- | --- |
| LYM938 | sorghum\|11v1\|SB04G027350 | sorghum | 503 | 754 |
| LYM939 | sorghum\|11v1\|SB04G028930 | sorghum | 504 | 755 |
| LYM940 | sorghum\|11v1\|SB04G032490 | sorghum | 505 | 756 |
| LYM941 | sorghum\|12v1\|SB04G034810 | sorghum | 506 | 757 |
| LYM942 | sorghum\|11v1\|SB04G038610 | sorghum | 507 | 910 |
| LYM943 | sorghum\|11v1\|SB0514S002010 | sorghum | 508 | 911 |
| LYM944 | sorghum\|11v1\|SB05G010328 | sorghum | 509 | 760 |
| LYM945 | sorghum\|11v1\|SB05G020920 | sorghum | 510 | 761 |
| LYM946 | sorghum\|11v1\|SB06G001130 | sorghum | 511 | 912 |
| LYM947 | sorghum\|11v1\|SB06G016660 | sorghum | 512 | 763 |
| LYM948 | sorghum\|11v1\|SB06G027510 | sorghum | 513 | 764 |
| LYM949 | sorghum\|11v1\|SB06G032200 | sorghum | 514 | 765 |
| LYM950 | sorghum\|11v1\|SB07G004990 | sorghum | 515 | 766 |
| LYM952 | sorghum\|11v1\|SB07G023340 | sorghum | 516 | 768 |
| LYM953 | sorghum\|11v1\|SB08G000475 | sorghum | 517 | 769 |
| LYM954 | sorghum\|11v1\|SB08G001720 | sorghum | 518 | 770 |
| LYM955 | sorghum\|11v1\|SB08G016720 | sorghum | 519 | 771 |
| LYM956 | sorghum\|11v1\|SB08G017230 | sorghum | 520 | 913 |
| LYM957 | sorghum\|11v1\|SB09G020470 | sorghum | 521 | 914 |
| LYM958 | sorghum\|11v1\|SB09G022700 | sorghum | 522 | 774 |
| LYM959 | sorghum\|11v1\|SB09G024340 | sorghum | 523 | 775 |
| LYM960 | sorghum\|11v1\|SB09G029440 | sorghum | 524 | 776 |
| LYM961 | sorghum\|12v1\|SB10G007228 | sorghum | 525 | 915 |
| LYM962 | sorghum\|11v1\|SB10G012180 | sorghum | 526 | 778 |
| LYM963 | sorghum\|11v1\|SB10G012200 | sorghum | 527 | 779 |
| LYM965 | sorghum\|11v1\|SB10G022550 | sorghum | 528 | 781 |
| LYM966 | sorghum\|11v1\|SB10G023040 | sorghum | 529 | 782 |
| LYM967 | sorghum\|11v1\|SB10G031120 | sorghum | 530 | 783 |
| LYM972 | sorghum\|12v1\|SB02G018650 | sorghum | 531 | 784 |
| LYM974 | sorghum\|12v1\|SB03G035810 | sorghum | 532 | 916 |
| LYM975 | sorghum\|12v1\|SB03G042280 | sorghum | 533 | 786 |
| LYM976 | sorghum\|12v1\|SB04G034340 | sorghum | 534 | 787 |
| LYM977 | sorghum\|12v1\|SB07G002500 | sorghum | 535 | 788 |
| LYM979 | sorghum\|gb161.crp\|AW287671 | sorghum | 536 | 789 |
| LYM980 | soybean\|11v1\|GLYMA05G08810 | soybean | 537 | 917 |
| LYM981 | soybean\|11v1\|GLYMA05G28910 | soybean | 538 | 791 |
| LYM982 | soybean\|11v1\|GLYMA05G34130 | soybean | 539 | 792 |
| LYM983 | soybean\|11v1\|GLYMA08G18720 | soybean | 540 | 854 |
| LYM984 | soybean\|11v1\|GLYMA14G05500 | soybean | 541 | 794 |
| LYM985 | soybean\|11v1\|GLYMA15G14460 | soybean | 542 | 795 |
| LYM986 | soybean\|11v1\|GLYMA16G01870 | soybean | 543 | 796 |
| LYM987 | soybean\|11v1\|GLYMA17G13930 | soybean | 544 | 797 |
| LYM988 | soybean\|11v1\|GLYMA20G02080 | soybean | 545 | 798 |
| LYM989 | tomato\|11v1\|BG127600 | tomato | 546 | 799 |
| LYM990 | tomato\|11v1\|BG626650 | tomato | 547 | 918 |
| LYM991 | wheat\|10v2\|BE217019 | wheat | 548 | 919 |
| LYM992 | wheat\|10v2\|BE398612 | wheat | 549 | 920 |
| LYM993 | wheat\|10v2\|BE400064 | wheat | 550 | 803 |
| LYM994 | wheat\|10v2\|BE400597 | wheat | 551 | 921 |
| LYM995 | wheat\|10v2\|BE403288 | wheat | 552 | 922 |
| LYM996 | wheat\|10v2\|BE415908 | wheat | 553 | 806 |
| LYM997 | wheat\|10v2\|BE417205 | wheat | 554 | 923 |
| LYM998 | wheat\|10v2\|BE418199 | wheat | 555 | 924 |
| LYM999 | wheat\|10v2\|BE426667 | wheat | 556 | 925 |
| LYM1000 | wheat\|10v2\|BE429087 | wheat | 557 | 926 |
| LYM1002 | wheat\|10v2\|BE490379 | wheat | 558 | 927 |
| LYM1003 | wheat\|10v2\|BE590649 | wheat | 559 | 813 |
| LYM1004 | wheat\|10v2\|BG909921 | wheat | 560 | 928 |
| LYM1005 | wheat\|10v2\|BQ238355 | wheat | 561 | 929 |
| LYM1006 | wheat\|10v2\|BU099700 | wheat | 562 | 930 |
| LYM1008 | rice\|gb170\|OS07G34610 | rice | 563 | 818 |
| LYM1009 | sorghum\|09v1\|SB10G027700 | sorghum | 564 | 819 |
| LYM1007_H2 | maize\|10v1\|CO526204 | maize | 565 | 820 |
| LYM817_H1 | maize\|10v1\|BF729515 | maize | 566 | 821 |
| LYM830_H4 | maize\|10v1\|CD953131 | maize | 567 | 822 |
| LYM888_H1 | foxtail_millet\|11v3\|PHY7SI009766M | foxtail_millet | 568 | 823 |
| LYM901_H1 | maize\|10v1\|BG320271 | maize | 569 | 824 |
| LYM964_H1 | maize\|10v1\|BG937347 | maize | 570 | 825 |
| LYM833 | maize\|10v1\|BE510873 | maize | 571 | — |

TABLE 1-continued

Identified genes for increasing yield, growth rate, vigor, biomass, growth rate, oil content, fiber yield, fiber quality, abiotic stress tolerance, nitrogen use efficiency, water use efficiency and fertilizer use efficiency of a plant

| Gene Name | Cluster Name | Organism | Polyn. SEQ ID NO: | Polyp. SEQ ID NO: |
|---|---|---|---|---|
| LYM862 | maize\|gb170\|BE186191 | maize | 572 | — |
| LYM970 | sorghum\|12v1\|CD426798 | sorghum | 573 | — |

Table 1:
Provided are the identified genes, their annotation, organism and polynucleotide and polypeptide sequence identifiers. "polyn." = polynucleotide; "polyp." = polypeptide.

Example 2

Identification of Homologous Sequences that Increase Yield, Fiber Yield, Fiber Quality, Growth Rate, Biomass, Oil Content, Vigor, ABST, and/or NUE of a Plant The concepts of orthology and paralogy have recently been applied to functional to characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes affecting plant yield, fiber yield, fiber quality, oil yield, oil content, seed yield, growth rate, vigor, biomass, abiotic stress tolerance, and fertilizer use efficiency (FUE) and/or nitrogen use efficiency of a plant, all sequences were aligned using the BLAST (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data was analyzed and the EST libraries were classified using a fixed vocabulary of custom terms such as developmental stages (e.g., genes showing similar expression profile through development with up regulation at specific stage, such as at the seed filling stage) and/or plant organ (e.g., genes showing similar expression profile across their organs with up regulation at specific organs such as seed). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, similarities in the sequence level-identical amino acids in the protein domains and similarity in expression profiles.

The search and identification of homologous genes involves the screening of sequence information available, for example, in public databases such as the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Binen et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), Arabidopsis (*Arabidopsis thaliana*), maize (*Zea mays*), cotton (*Gossypium*), Oilseed rape (*Brassica napus*), Rice (*Oryza sativa*), Sugar cane (*Saccharum officinarum*), Sorghum (*Sorghum bicolor*), Soybean (*Glycine max*), Sunflower (*Helianthus annuus*), Tomato (*Lycopersicon esculentum*), Wheat (*Triticum aestivum*).

The above-mentioned analyses for sequence homology can be carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 1 (Example 1 above) were identified from the databases using BLAST software with the Blastp and tBlastn algorithms as filters for the first stage, and the needle (EMBOSS package) or Frame+algorithm alignment for the second stage. Local identity (Blast alignments) was defined with a very permissive cutoff—60% Identity on a span of 60% of the sequences lengths because it is used only as a filter for the global alignment stage. The default filtering of the Blast package was not utilized (by setting the parameter "—F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the blastp filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the tblastn filter):
GenCore 6.0 OneModel application utilizing the Frame+ algorithm with the following parameters: model=frame+_p2n.model mode=qglobal -q=protein. sequence -db=nucleotide.sequence. The rest of the parameters are unchanged from the default options described hereinabove.

The query polypeptide sequences were SEQ ID NOs: 574-930 (which are encoded by the polynucleotides SEQ ID NOs: 1-573, shown in Table 1 above) and the identified orthologous and homologous sequences having at least 80% global sequence identity are provided in Table 2, below. These homologous genes are expected to increase plant yield, seed yield, oil yield, oil content, growth rate, fiber yield, fiber quality, biomass, vigor, ABST and/or NUE of a plant.

TABLE 2

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| arabidopsis_lyrata\|09v1\|JGIAL023362_P1 | 931 | 6266 | 574 | LYM751 | 97.1 | globlastp |
| thellungiella_halophilum\|11v1\|DN773323 | 932 | 6267 | 574 | LYM751 | 94.9 | globlastp |
| thellungiella\|gb167\|DN773323 | 933 | 6267 | 574 | LYM751 | 94.9 | globlastp |
| b_juncea\|10v2\|E6ANDIZ01A75MZ | 934 | 6268 | 574 | LYM751 | 94.4 | globlastp |
| thellungiella_parvulum\|11v1\|DN773323 | 935 | 6269 | 574 | LYM751 | 94.4 | globlastp |
| b_oleracea\|gb161\|EH417750_P1 | 936 | 6270 | 574 | LYM751 | 94.1 | globlastp |
| b_rapa\|11v1\|DY008952_P1 | 937 | 6270 | 574 | LYM751 | 94.1 | globlastp |
| b_rapa\|11v1\|L47845_P1 | 938 | 6270 | 574 | LYM751 | 94.1 | globlastp |
| canola\|11v1\|DY030660_P1 | 939 | 6270 | 574 | LYM751 | 94.1 | globlastp |
| canola\|11v1\|EE490523_P1 | 940 | 6270 | 574 | LYM751 | 94.1 | globlastp |
| b_juncea\|12v1\|E6ANDIZ01A62GI_P1 | 941 | 6271 | 574 | LYM751 | 93.9 | globlastp |
| b_rapa\|11v1\|DQ023572_P1 | 942 | 6272 | 574 | LYM751 | 93.9 | globlastp |
| radish\|gb164\|EV526057 | 943 | 6273 | 574 | LYM751 | 93.9 | globlastp |
| b_juncea\|12v1\|E6ANDIZ01BPMRK_T1 | 944 | 6274 | 574 | LYM751 | 93.88 | glotblastn |
| wheat\|12v3\|ERR125556X186637D1_P1 | 945 | 6275 | 574 | LYM751 | 93.6 | globlastp |
| b_rapa\|11v1\|AI352862_P1 | 946 | 6276 | 574 | LYM751 | 93.6 | globlastp |
| canola\|11v1\|AI352862_P1 | 947 | 6277 | 574 | LYM751 | 93.4 | globlastp |
| b_juncea\|12v1\|E6ANDIZ01A0ZC6_T1 | 948 | 6278 | 574 | LYM751 | 93.35 | glotblastn |
| canola\|11v1\|EG019476_T1 | 949 | 6279 | 574 | LYM751 | 93.35 | glotblastn |
| b_juncea\|12v1\|E6ANDIZ01A75MZ_P1 | 950 | 6280 | 574 | LYM751 | 90.9 | globlastp |
| b_juncea\|12v1\|E6ANDIZ01A71AV_P1 | 951 | 6281 | 574 | LYM751 | 90.7 | globlastp |
| b_rapa\|11v1\|CD812412_T1 | 952 | 6282 | 574 | LYM751 | 90.43 | glotblastn |
| b_juncea\|12v1\|E6ANDIZ01A6348_T1 | 953 | 6283 | 574 | LYM751 | 88.06 | glotblastn |
| b_juncea\|10v2\|E6ANDIZ01A0ZC6 | 954 | 6284 | 574 | LYM751 | 87.7 | globlastp |
| humulus\|11v1\|EX516222_P1 | 955 | 6285 | 574 | LYM751 | 87.6 | globlastp |
| oak\|10v1\|CU657693_P1 | 956 | 6286 | 574 | LYM751 | 87.3 | globlastp |
| cleome_spinosa\|10v1\|SRR015531S0000138_P1 | 957 | 6287 | 574 | LYM751 | 87.1 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| cucurbita\|11v1\|SRR091276X103307_P1 | 958 | 6288 | 574 | LYM751 | 87 | globlastp |
| euonymus\|11v1\|SRR070038X106880_T1 | 959 | 6289 | 574 | LYM751 | 86.77 | glotblastn |
| cannabis\|12v1\|EW700918_P1 | 960 | 6290 | 574 | LYM751 | 86.6 | globlastp |
| cannabis\|12v1\|GR220939_P1 | 961 | 6290 | 574 | LYM751 | 86.6 | globlastp |
| cleome_gynandra\|10v1\|SRR015532S0001086_P1 | 962 | 6291 | 574 | LYM751 | 86.6 | globlastp |
| watermelon\|11v1\|AM723678 | 963 | 6292 | 574 | LYM751 | 86.5 | globlastp |
| cucumber\|09v1\|AM723678_P1 | 964 | 6293 | 574 | LYM751 | 86.4 | globlastp |
| cleome_gynandra\|10v1\|SRR015532S0000163_P1 | 965 | 6294 | 574 | LYM751 | 86.1 | globlastp |
| chestnut\|gb170\|SRR006296S0024515_P1 | 966 | 6295 | 574 | LYM751 | 86 | globlastp |
| melon\|10v1\|AM726011_P1 | 967 | 6296 | 574 | LYM751 | 85.9 | globlastp |
| bean\|12v1\|CB539285_P1 | 968 | 6297 | 574 | LYM751 | 85.8 | globlastp |
| bean\|gb167\|BQ481664 | 969 | 6297 | 574 | LYM751 | 85.8 | globlastp |
| cowpea\|12v1\|DQ312300_P1 | 970 | 6298 | 574 | LYM751 | 85.8 | globlastp |
| cowpea\|gb166\|DQ312300 | 971 | 6298 | 574 | LYM751 | 85.8 | globlastp |
| soybean\|11v1\|GLYMA15G11490 | 972 | 6299 | 574 | LYM751 | 85.8 | globlastp |
| eucalyptus\|11v2\|ES588455_P1 | 973 | 6300 | 574 | LYM751 | 85.7 | globlastp |
| cleome_spinosa\|10v1\|SRR015531S0007993_P1 | 974 | 6301 | 574 | LYM751 | 85.5 | globlastp |
| potato\|10v1\|BE920389_P1 | 975 | 6302 | 574 | LYM751 | 85.5 | globlastp |
| soybean\|11v1\|GLYMA13G27490 | 976 | 6303 | 574 | LYM751 | 85.5 | globlastp |
| watermelon\|11v1\|AI563256 | 977 | 6304 | 574 | LYM751 | 85.3 | globlastp |
| watermelon\|11v1\|VMEL01644112791469 | 978 | 6304 | 574 | LYM751 | 85.3 | globlastp |
| solanum_phureja\|09v1\|SPHBG123447 | 979 | 6305 | 574 | LYM751 | 85.2 | globlastp |
| grape\|11v1\|BM437544_P1 | 980 | 6306 | 574 | LYM751 | 85.1 | globlastp |
| cucumber\|09v1\|AI563256_P1 | 981 | 6307 | 574 | LYM751 | 84.8 | globlastp |
| cassava\|09v1\|CK643169_P1 | 982 | 6308 | 574 | LYM751 | 84.7 | globlastp |
| cotton\|11v1\|CA993222_P1 | 983 | 6309 | 574 | LYM751 | 84.7 | globlastp |
| peanut\|10v1\|GO260768_P1 | 984 | 6310 | 574 | LYM751 | 84.7 | globlastp |
| pigeonpea\|11v1\|DV105917_P1 | 985 | 6311 | 574 | LYM751 | 84.7 | globlastp |
| tabernaemontana\|11v1\|SRR098689X100698 | 986 | 6312 | 574 | LYM751 | 84.7 | globlastp |
| tomato\|11v1\|X17274 | 987 | 6313 | 574 | LYM751 | 84.7 | globlastp |
| cacao\|10v1\|CF974214_P1 | 988 | 6314 | 574 | LYM751 | 84.6 | globlastp |
| pteridium\|11v1\|SRR043594X133705 | 989 | 6314 | 574 | LYM751 | 84.6 | globlastp |
| catharanthus\|11v1\|EG554139_P1 | 990 | 6315 | 574 | LYM751 | 84.5 | globlastp |
| amsonia\|11v1\|SRR098688X100486_P1 | 991 | 6316 | 574 | LYM751 | 84.4 | globlastp |
| triphysaria\|10v1\|EX982462 | 992 | 6317 | 574 | LYM751 | 84.4 | globlastp |
| pepper\|12v1\|BM062957_P1 | 993 | 6318 | 574 | LYM751 | 84.2 | globlastp |
| pepper\|gb171\|BM062957 | 994 | 6318 | 574 | LYM751 | 84.2 | globlastp |
| gossypium_raimondii\|12v1\|CA993222_P1 | 995 | 6319 | 574 | LYM751 | 84.1 | globlastp |
| cotton\|11v1\|CD486220_P1 | 996 | 6320 | 574 | LYM751 | 84.1 | globlastp |
| poplar\|10v1\|BI068643_P1 | 997 | 6321 | 574 | LYM751 | 84.1 | globlastp |
| euphorbia\|11v1\|DV122755_T1 | 998 | 6322 | 574 | LYM751 | 84.08 | glotblastn |
| phyla\|11v2\|SRR099035X100031_P1 | 999 | 6323 | 574 | LYM751 | 84 | globlastp |
| vinca\|11v1\|SRR098690X102138 | 1000 | 6324 | 574 | LYM751 | 84 | globlastp |
| castorbean\|11v1\|XM_002518431_P1 | 1001 | 6325 | 574 | LYM751 | 83.9 | globlastp |
| platanus\|11v1\|SRR096786X103394_P1 | 1002 | 6326 | 574 | LYM751 | 83.9 | globlastp |
| prunus\|10v1\|AY347857 | 1003 | 6327 | 574 | LYM751 | 83.9 | globlastp |
| tobacco\|gb162\|X17274 | 1004 | 6328 | 574 | LYM751 | 83.9 | globlastp |
| tripterygium\|11v1\|SRR098677X101209 | 1005 | 6329 | 574 | LYM751 | 83.9 | globlastp |
| peanut\|10v1\|EL966472_T1 | 1006 | 6330 | 574 | LYM751 | 83.55 | glotblastn |
| coffea\|10v1\|DV672006_P1 | 1007 | 6331 | 574 | LYM751 | 83.3 | globlastp |
| poppy\|11v1\|SRR030259.106509_P1 | 1008 | 6332 | 574 | LYM751 | 83.2 | globlastp |
| petunia\|gb171\|CV298491_T1 | 1009 | 6333 | 574 | LYM751 | 83.11 | glotblastn |
| arnica\|11v1\|SRR099034X102427_P1 | 1010 | 6334 | 574 | LYM751 | 83.1 | globlastp |
| lettuce\|10v1\|DW045282 | 1011 | 6335 | 574 | LYM751 | 83 | globlastp |
| lettuce\|12v1\|DW045282_P1 | 1012 | 6335 | 574 | LYM751 | 83 | globlastp |
| poppy\|11v1\|SRR030259.115103_P1 | 1013 | 6336 | 574 | LYM751 | 83 | globlastp |
| poppy\|11v1\|SRR030260.376233_P1 | 1014 | 6337 | 574 | LYM751 | 83 | globlastp |
| b_juncea\|12v1\|E6ANDIZ01A3WOT_P1 | 1015 | 6338 | 574 | LYM751 | 82.9 | globlastp |
| kiwi\|gb166\|FG407911_P1 | 1016 | 6339 | 574 | LYM751 | 82.9 | globlastp |
| aristolochia\|10v1\|FD748841_P1 | 1017 | 6340 | 574 | LYM751 | 82.8 | globlastp |
| chickpea\|11v1\|FE668708_P1 | 1018 | 6341 | 574 | LYM751 | 82.8 | globlastp |
| chickpea\|11v1\|SRR133517.102130_P1 | 1019 | 6341 | 574 | LYM751 | 82.8 | globlastp |
| cotton\|11v1\|CO072733_P1 | 1020 | 6342 | 574 | LYM751 | 82.8 | globlastp |
| monkeyflower\|10v1\|DV206004_P1 | 1021 | 6343 | 574 | LYM751 | 82.8 | globlastp |
| antirrhinum\|gb166\|AJ559671_P1 | 1022 | 6344 | 574 | LYM751 | 82.7 | globlastp |
| apple\|11v1\|CN862073_P1 | 1023 | 6345 | 574 | LYM751 | 82.7 | globlastp |
| utricularia\|11v1\|SRR094438.100336 | 1024 | 6346 | 574 | LYM751 | 82.7 | globlastp |
| sunflower\|12v1\|CD845663_P1 | 1025 | 6347 | 574 | LYM751 | 82.6 | globlastp |
| sunflower\|12v1\|BU672088_P1 | 1026 | 6348 | 574 | LYM751 | 82.5 | globlastp |
| sunflower\|12v1\|BU672096_P1 | 1027 | 6348 | 574 | LYM751 | 82.5 | globlastp |
| cynara\|gb167\|GE595263_P1 | 1028 | 6349 | 574 | LYM751 | 82.5 | globlastp |
| sunflower\|10v1\|BU672088 | 1029 | 6348 | 574 | LYM751 | 82.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| tragopogon\|10v1\|SRR020205S0001119 | 1030 | 6350 | 574 | LYM751 | 82.5 | globlastp |
| sunflower\|12v1\|CD845846_P1 | 1031 | 6351 | 574 | LYM751 | 82.4 | globlastp |
| apple\|11v1\|AY347857_P1 | 1032 | 6352 | 574 | LYM751 | 82.4 | globlastp |
| cichorium\|gb17\|EH686426_P1 | 1033 | 6353 | 574 | LYM751 | 82.4 | globlastp |
| flaveria\|11v1\|SRR149229.132285_P1 | 1034 | 6354 | 574 | LYM751 | 82.3 | globlastp |
| ambrosia\|11v1\|SRR346935.120209_T1 | 1035 | 6355 | 574 | LYM751 | 82.28 | glotblastn |
| sunflower\|12v1\|CF076851_P1 | 1036 | 6356 | 574 | LYM751 | 82.2 | globlastp |
| ambrosia\|11v1\|SRR346935.122226_P1 | 1037 | 6357 | 574 | LYM751 | 82.2 | globlastp |
| ambrosia\|11v1\|SRR346935.197579_P1 | 1038 | 6358 | 574 | LYM751 | 82.2 | globlastp |
| ambrosia\|11v1\|SRR346935.124419_T1 | 1039 | 6359 | 574 | LYM751 | 82.18 | glotblastn |
| nasturtium\|11v1\|SRR032558.150981_T1 | 1040 | 6360 | 574 | LYM751 | 82.06 | glotblastn |
| arnica\|11v1\|SRR099034X137499_T1 | 1041 | 6361 | 574 | LYM751 | 82.01 | glotblastn |
| flaveria\|11v1\|SRR149229.10109_T1 | 1042 | 6362 | 574 | LYM751 | 82.01 | glotblastn |
| sunflower\|12v1\|DY933738_P1 | 1043 | 6363 | 574 | LYM751 | 82 | globlastp |
| flaveria\|11v1\|SRR149229.103759_P1 | 1044 | 6364 | 574 | LYM751 | 82 | globlastp |
| flaveria\|11v1\|SRR149229.161784_P1 | 1045 | 6365 | 574 | LYM751 | 82 | globlastp |
| flaveria\|11v1\|SRR149229.175158_P1 | 1046 | 6364 | 574 | LYM751 | 82 | globlastp |
| flaveria\|11v1\|SRR149229.293083XX1_P1 | 1047 | 6364 | 574 | LYM751 | 82 | globlastp |
| lotus\|09v1\|BP048539_P1 | 1048 | 6366 | 574 | LYM751 | 82 | globlastp |
| plantago\|11v2\|SRR066374X104031_P1 | 1049 | 6367 | 574 | LYM751 | 81.9 | globlastp |
| citrus\|gb166\|CF417522 | 1050 | 6368 | 574 | LYM751 | 81.7 | globlastp |
| euphorbia\|11v1\|DV125484_P1 | 1051 | 6369 | 574 | LYM751 | 81.7 | globlastp |
| orange\|11v1\|CF417522_P1 | 1052 | 6370 | 574 | LYM751 | 81.7 | globlastp |
| primula\|11v1\|SRR098679X103136_P1 | 1053 | 6371 | 574 | LYM751 | 81.7 | globlastp |
| medicago\|12v1\|AW127589_P1 | 1054 | 6372 | 574 | LYM751 | 81.6 | globlastp |
| artemisia\|10v1\|SRR019254S0375017_P1 | 1055 | 6373 | 574 | LYM751 | 81.5 | globlastp |
| guizotia\|10v1\|GE557538_P1 | 1056 | 6374 | 574 | LYM751 | 81.5 | globlastp |
| ambrosia\|11v1\|SRR346935.330186_T1 | 1057 | 6355 | 574 | LYM751 | 81.48 | glotblastn |
| clementine\|11v1\|CF417522_P1 | 1058 | 6375 | 574 | LYM751 | 81.2 | globlastp |
| flaveria\|11v1\|SRR149229.115649_P1 | 1059 | 6376 | 574 | LYM751 | 81.2 | globlastp |
| sunflower\|12v1\|CD847337_P1 | 1060 | 6377 | 574 | LYM751 | 81 | globlastp |
| strawberry\|11v1\|DY669569 | 1061 | 6378 | 574 | LYM751 | 81 | globlastp |
| b_juncea\|12v1\|E6ANDIZ01AP3RS_T1 | 1062 | 6379 | 574 | LYM751 | 80.64 | glotblastn |
| aquilegia\|10v2\|DR912979_P1 | 1063 | 6380 | 574 | LYM751 | 80.4 | globlastp |
| blueberry\|12v1\|SRR353283X18736D1_P1 | 1064 | 6381 | 574 | LYM751 | 80.4 | globlastp |
| aquilegia\|10v1\|DR912979 | 1065 | 6380 | 574 | LYM751 | 80.4 | globlastp |
| ginseng\|10v1\|DV553576_T1 | 1066 | 6382 | 574 | LYM751 | 80.21 | glotblastn |
| flax\|11v1\|CV478254_P1 | 1067 | 6383 | 574 | LYM751 | 80.2 | globlastp |
| sunflower\|12v1\|CD845832_T1 | 1068 | 6384 | 574 | LYM751 | 80.05 | glotblastn |
| blueberry\|12v1\|SRR353282X74478D1_P1 | 1069 | 6385 | 574 | LYM751 | 80 | globlastp |
| arabidopsis_lyrata\|09v1\|JGIAL010431_P1 | 1070 | 6386 | 575 | LYM752 | 96 | globlastp |
| thellungiella_halophilum\|11v1\|EHJGI11002584 | 1071 | 6387 | 575 | LYM752 | 89.5 | globlastp |
| thellungiella_parvulum\|11v1\|EPCRP012283 | 1072 | 6388 | 575 | LYM752 | 89.5 | globlastp |
| b_rapa\|11v1\|EE469914_P1 | 1073 | 6389 | 575 | LYM752 | 86.1 | globlastp |
| radish\|gb164\|EV526932 | 1074 | 6390 | 575 | LYM752 | 86.1 | globlastp |
| b_rapa\|11v1\|CD824807_P1 | 1075 | 6391 | 575 | LYM752 | 86 | globlastp |
| canola\|11v1\|EV085377XX1_T1 | 1076 | 6392 | 575 | LYM752 | 85.94 | glotblastn |
| canola\|11v1\|EE484099XX1_P1 | 1077 | 6393 | 575 | LYM752 | 85.4 | globlastp |
| arabidopsis_lyrata\|09v1\|JGIAL001164_P1 | 1078 | 6394 | 576 | LYM753 | 96.5 | globlastp |
| thellungiella_halophilum\|11v1\|BY803760 | 1079 | 6395 | 576 | LYM753 | 91.1 | globlastp |
| thellungiella_parvulum\|11v1\|BY803760 | 1080 | 6396 | 576 | LYM753 | 90.6 | globlastp |
| b_rapa\|11v1\|CX281819_P1 | 1081 | 6397 | 576 | LYM753 | 87 | globlastp |
| b_rapa\|11v1\|ES922028_P1 | 1082 | 6398 | 576 | LYM753 | 83.3 | globlastp |
| arabidopsis_lyrata\|09v1\|JGIAL020359_P1 | 1083 | 6399 | 577 | LYM754 | 89.3 | globlastp |
| thellungiella_parvulum\|11v1\|EPCRP026641 | 1084 | 6400 | 577 | LYM754 | 82.5 | globlastp |
| thellungiella_halophilum\|11v1\|EHJGI11025655 | 1085 | 6401 | 577 | LYM754 | 82.4 | globlastp |
| rye\|12v1\|DRR001012.184600_P1 | 1086 | 6402 | 578 | LYM755 | 88 | globlastp |
| wheat\|12v3\|CA717945_P1 | 1087 | 6403 | 578 | LYM755 | 80.7 | globlastp |
| rye\|12v1\|DRR001012.130018_P1 | 1088 | 6404 | 579 | LYM756 | 85.6 | globlastp |
| wheat\|10v2\|CA633943 | 1089 | 6405 | 580 | LYM757 | 98.3 | globlastp |
| wheat\|12v3\|CA715440_P1 | 1090 | 6405 | 580 | LYM757 | 98.3 | globlastp |
| rye\|12v1\|DRR001012.114622_T1 | 1091 | 6406 | 580 | LYM757 | 96.29 | glotblastn |
| oat\|11v1\|GO586711_P1 | 1092 | 6407 | 580 | LYM757 | 91.4 | globlastp |
| brachypodium\|12v1\|BRADI4G30170_P1 | 1093 | 6408 | 580 | LYM757 | 89.7 | globlastp |
| brachypodium\|09v1\|GT830518 | 1094 | 6408 | 580 | LYM757 | 89.7 | globlastp |
| wheat\|12v3\|CA633943_P1 | 1095 | 6409 | 580 | LYM757 | 81.1 | globlastp |
| foxtail_millet\|11v3\|PHY7SI030336M_P1 | 1096 | 6410 | 580 | LYM757 | 80.2 | globlastp |
| foxtail_millet\|11v3\|PHY7SI030336M_P1 | 1096 | 6410 | 908 | LYM917 | 88.1 | globlastp |
| brachypodium\|12v1\|BRADI2G49960_P1 | 1097 | 581 | 581 | LYM758 | 100 | globlastp |
| rye\|12v1\|DRR001012.130172_P1 | 1098 | 581 | 581 | LYM758 | 100 | globlastp |
| rye\|12v1\|DRR001012.146388_P1 | 1099 | 581 | 581 | LYM758 | 100 | globlastp |
| rye\|12v1\|DRR001012.221652_P1 | 1100 | 581 | 581 | LYM758 | 100 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| rye\|12v1\|DRR001012.224245_P1 | 1101 | 581 | 581 | LYM758 | 100 | globlastp |
| rye\|12v1\|DRR001012.488493_P1 | 1102 | 581 | 581 | LYM758 | 100 | globlastp |
| rye\|12v1\|DRR001012.594926_P1 | 1103 | 581 | 581 | LYM758 | 100 | globlastp |
| rye\|12v1\|DRR001013.256395_P1 | 1104 | 581 | 581 | LYM758 | 100 | globlastp |
| rye\|12v1\|DRR001014.126908_P1 | 1105 | 581 | 581 | LYM758 | 100 | globlastp |
| rye\|12v1\|DRR001014.300033_P1 | 1106 | 581 | 581 | LYM758 | 100 | globlastp |
| rye\|12v1\|DRR001014.545707_P1 | 1107 | 581 | 581 | LYM758 | 100 | globlastp |
| rye\|12v1\|DRR001015.160247_T1 | 1108 | 6411 | 581 | LYM758 | 100 | glotblastn |
| brachypodium\|09v1\|GT758955 | 1109 | 581 | 581 | LYM758 | 100 | globlastp |
| leymus\|gb166\|CD808991_P1 | 1110 | 581 | 581 | LYM758 | 100 | globlastp |
| pseudoroegneria\|gb167\|FF361642 | 1111 | 581 | 581 | LYM758 | 100 | globlastp |
| wheat\|10v2\|BE403370 | 1112 | 581 | 581 | LYM758 | 100 | globlastp |
| wheat\|12v3\|BE403370_P1 | 1113 | 581 | 581 | LYM758 | 100 | globlastp |
| rye\|12v1\|BE705105_T1 | 1114 | 6412 | 581 | LYM758 | 98.59 | glotblastn |
| oat\|11v1\|GO586664_P1 | 1115 | 6413 | 581 | LYM758 | 97.2 | globlastp |
| rye\|12v1\|DRR001013.164661_T1 | 1116 | 6414 | 581 | LYM758 | 97.18 | glotblastn |
| rye\|gb164\|BE705105 | 1117 | 6415 | 581 | LYM758 | 97.18 | glotblastn |
| cenchrus\|gb166\|EB657753_P1 | 1118 | 6416 | 581 | LYM758 | 95.8 | globlastp |
| millet\|10v1\|EVO454PM068121_P1 | 1119 | 6416 | 581 | LYM758 | 95.8 | globlastp |
| oat\|11v1\|GR358308_P1 | 1120 | 6417 | 581 | LYM758 | 95.8 | globlastp |
| sorghum\|11v1\|SB03G034720 | 1121 | 6418 | 581 | LYM758 | 95.8 | globlastp |
| sorghum\|12v1\|SB03G034720_P1 | 1122 | 6418 | 581 | LYM758 | 95.8 | globlastp |
| rye\|12v1\|DRR001012.104441_T1 | 1123 | 6419 | 581 | LYM758 | 95.77 | glotblastn |
| rye\|12v1\|DRR001013.108488_T1 | 1124 | 6420 | 581 | LYM758 | 95.77 | glotblastn |
| foxtail_millet\|11v3\|PHY7SI004637M_P1 | 1125 | 6421 | 581 | LYM758 | 94.4 | globlastp |
| maize\|10v1\|AI711895_P1 | 1126 | 6421 | 581 | LYM758 | 94.4 | globlastp |
| maize\|10v1\|AW065858_P1 | 1127 | 6421 | 581 | LYM758 | 94.4 | globlastp |
| oat\|11v1\|GO587667_P1 | 1128 | 6422 | 581 | LYM758 | 94.4 | globlastp |
| sugarcane\|10v1\|CA078583 | 1129 | 6421 | 581 | LYM758 | 94.4 | globlastp |
| cynodon\|10v1\|ES298414_P1 | 1130 | 6423 | 581 | LYM758 | 93 | globlastp |
| rice\|11v1\|AA754219 | 1131 | 6424 | 581 | LYM758 | 93 | globlastp |
| switchgrass\|gb167\|DN145338 | 1132 | 6425 | 581 | LYM758 | 93 | globlastp |
| switchgrass\|gb167\|FE606246 | 1133 | 6425 | 581 | LYM758 | 93 | globlastp |
| switchgrass\|gb167\|FL832406 | 1134 | 6425 | 581 | LYM758 | 93 | globlastp |
| rice\|11v1\|AA754236 | 1135 | 6426 | 581 | LYM758 | 92.96 | glotblastn |
| lovegrass\|gb167\|EH188740_T1 | 1136 | 6427 | 581 | LYM758 | 91.55 | glotblastn |
| sugarcane\|10v1\|CA111174 | 1137 | 6428 | 581 | LYM758 | 91.5 | globlastp |
| sorghum\|12v1\|SB03G033700_P1 | 1138 | 6429 | 581 | LYM758 | 90.1 | globlastp |
| sorghum\|11v1\|SB03G033700 | 1139 | 6429 | 581 | LYM758 | 90.1 | globlastp |
| banana\|12v1\|FL657646_P1 | 1140 | 6430 | 581 | LYM758 | 87.3 | globlastp |
| banana\|10v1\|FL657646 | 1141 | 6430 | 581 | LYM758 | 87.3 | globlastp |
| switchgrass\|gb167\|FL778380 | 1142 | 6431 | 581 | LYM758 | 87.3 | globlastp |
| wheat\|10v2\|CA688824 | 1143 | 6432 | 581 | LYM758 | 85.92 | glotblastn |
| oil_palm\|11v1\|EY397254_P1 | 1144 | 6433 | 581 | LYM758 | 85.9 | globlastp |
| oil_palm\|11v1\|EL684517_P1 | 1145 | 6434 | 581 | LYM758 | 84.5 | globlastp |
| aristolochia\|10v1\|SRR039082S0428868_P1 | 1146 | 6435 | 581 | LYM758 | 83.1 | globlastp |
| catharanthus\|11v1\|SRR098691X369077_P1 | 1147 | 6436 | 581 | LYM758 | 83.1 | globlastp |
| rye\|12v1\|DRR001015.154487_P1 | 1148 | 6437 | 581 | LYM758 | 81.7 | globlastp |
| zostera\|10v1\|AM771402 | 1149 | 6438 | 581 | LYM758 | 81.7 | globlastp |
| rye\|12v1\|DRR001012.774508_T1 | 1150 | 6439 | 581 | LYM758 | 81.69 | glotblastn |
| phyla\|11v2\|SRR099035X101778_T1 | 1151 | 6440 | 581 | LYM758 | 81.69 | glotblastn |
| rose\|12v1\|BQ105477_P1 | 1152 | 6441 | 581 | LYM758 | 80.3 | globlastp |
| antirrhinum\|gb166\|AJ558301_P1 | 1153 | 6442 | 581 | LYM758 | 80.3 | globlastp |
| citrus\|gb166\|CF832487 | 1154 | 6443 | 581 | LYM758 | 80.3 | globlastp |
| clementine\|11v1\|CF832487_P1 | 1155 | 6443 | 581 | LYM758 | 80.3 | globlastp |
| orange\|11v1\|CF832487_P1 | 1155 | 6443 | 581 | LYM758 | 80.3 | globlastp |
| cleome_spinosa\|10v1\|SRR015531S0028686_P1 | 1156 | 6444 | 581 | LYM758 | 80.3 | globlastp |
| euphorbia\|11v1\|DV134274_P1 | 1157 | 6445 | 581 | LYM758 | 80.3 | globlastp |
| kiwi\|gb166\|FG431736_P1 | 1158 | 6446 | 581 | LYM758 | 80.3 | globlastp |
| rose\|10v1\|BQ105477 | 1159 | 6441 | 581 | LYM758 | 80.3 | globlastp |
| silene\|11v1\|GH292520 | 1160 | 6447 | 581 | LYM758 | 80.3 | globlastp |
| strawberry\|11v1\|CO378885 | 1161 | 6441 | 581 | LYM758 | 80.3 | globlastp |
| tabernaemontana\|11v1\|SRR098689X112196 | 1162 | 6448 | 581 | LYM758 | 80.3 | globlastp |
| walnuts\|gb166\|CV195810 | 1163 | 6449 | 581 | LYM758 | 80.3 | globlastp |
| sesame\|12v1\|SESI12V1376535_T1 | 1164 | 6450 | 581 | LYM758 | 80.28 | glotblastn |
| orobanche\|10v1\|SRR023189S0010027_T1 | 1165 | 6451 | 581 | LYM758 | 80.28 | glotblastn |
| spurge\|gb161\|DV134274 | 1166 | 6452 | 581 | LYM758 | 80.28 | glotblastn |
| barley\|12v1\|AK360558_P1 | 1167 | 6453 | 582 | LYM759 | 99.6 | globlastp |
| barley\|12v1\|AK360558_T1 | 1167 | 6453 | 850 | LYM943 | 80 | glotblastn |
| wheat\|12v3\|BM134503_P1 | 1168 | 6454 | 582 | LYM759 | 93.6 | globlastp |
| wheat\|12v3\|BE403587_P1 | 1169 | 6455 | 582 | LYM759 | 93.3 | globlastp |
| wheat\|10v2\|BQ802657 | 1170 | 6456 | 582 | LYM759 | 89.5 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| rye\|12v1\|DRR001012.151131_P1 | 1171 | 6457 | 582 | LYM759 | 87.6 | globlastp |
| rice\|11v1\|AU166707 | 1172 | 6458 | 582 | LYM759 | 80.5 | globlastp |
| rice\|11v1\|AU166707 | 1172 | 6458 | 911 | LYM943 | 87.6 | globlastp |
| wheat\|10v2\|BF293973 | 1173 | 583 | 583 | LYM760 | 100 | globlastp |
| wheat\|12v3\|BE398972_P1 | 1174 | 583 | 583 | LYM760 | 100 | globlastp |
| pseudoroegneria\|gb167\|FF354342 | 1175 | 6459 | 583 | LYM760 | 99.4 | globlastp |
| rye\|12v1\|BE704993_P1 | 1176 | 6460 | 583 | LYM760 | 98.8 | globlastp |
| rye\|gb164\|BE704993 | 1177 | 6461 | 583 | LYM760 | 97.09 | glotblastn |
| brachypodium\|12v1\|BRADI3G41150_P1 | 1178 | 6462 | 583 | LYM760 | 95.3 | globlastp |
| brachypodium\|09v1\|GT787781 | 1179 | 6462 | 583 | LYM760 | 95.3 | globlastp |
| oat\|11v1\|CN821190_P1 | 1180 | 6463 | 583 | LYM760 | 95.3 | globlastp |
| oat\|11v1\|GO586798_P1 | 1181 | 6463 | 583 | LYM760 | 95.3 | globlastp |
| oat\|11v1\|CN820758_P1 | 1182 | 6464 | 583 | LYM760 | 92.4 | globlastp |
| oat\|11v1\|GO597456_P1 | 1183 | 6464 | 583 | LYM760 | 92.4 | globlastp |
| oat\|11v1\|GR365193_P1 | 1184 | 6464 | 583 | LYM760 | 92.4 | globlastp |
| barley\|10v2\|BE420659 | 1185 | 6465 | 583 | LYM760 | 91.9 | globlastp |
| barley\|12v1\|BE420659_P1 | 1186 | 6465 | 583 | LYM760 | 91.9 | globlastp |
| rye\|12v1\|BE494862_P1 | 1187 | 6466 | 583 | LYM760 | 91.3 | globlastp |
| rye\|12v1\|BE705319_P1 | 1188 | 6466 | 583 | LYM760 | 91.3 | globlastp |
| pseudoroegneria\|gb167\|FF366349 | 1189 | 6467 | 583 | LYM760 | 91.3 | globlastp |
| wheat\|10v2\|CA602318 | 1190 | 6467 | 583 | LYM760 | 91.3 | globlastp |
| wheat\|12v3\|BE438334_P1 | 1191 | 6467 | 583 | LYM760 | 91.3 | globlastp |
| wheat\|10v2\|CJ534050 | 1192 | 6467 | 583 | LYM760 | 91.3 | globlastp |
| brachypodium\|12v1\|BRADI4G08667_P1 | 1193 | 6468 | 583 | LYM760 | 90.7 | globlastp |
| brachypodium\|09v1\|DV476606 | 1194 | 6468 | 583 | LYM760 | 90.7 | globlastp |
| rye\|gb164\|BE705327 | 1195 | 6469 | 583 | LYM760 | 90.12 | glotblastn |
| millet\|10v1\|CD726222_P1 | 1196 | 6470 | 583 | LYM760 | 88.4 | globlastp |
| rye\|12v1\|DRR001012.456975_T1 | 1197 | 6471 | 583 | LYM760 | 88.37 | glotblastn |
| cynodon\|10v1\|DN987159_P1 | 1198 | 6472 | 583 | LYM760 | 87.8 | globlastp |
| millet\|10v1\|EVO454PM027223_P1 | 1199 | 6473 | 583 | LYM760 | 87.8 | globlastp |
| lovegrass\|gb167\|EH191978_T1 | 1200 | 6474 | 583 | LYM760 | 86.63 | glotblastn |
| millet\|10v1\|EVO454PM008828_P1 | 1201 | 6475 | 583 | LYM760 | 86.6 | globlastp |
| foxtail_millet\|11v3\|PHY7SI014536M_P1 | 1202 | 6476 | 583 | LYM760 | 86 | globlastp |
| maize\|10v1\|AA011851_P1 | 1203 | 6477 | 583 | LYM760 | 86 | globlastp |
| millet\|10v1\|EVO454PM008753_P1 | 1204 | 6478 | 583 | LYM760 | 86 | globlastp |
| sugarcane\|10v1\|BQ530765 | 1205 | 6479 | 583 | LYM760 | 86 | globlastp |
| sugarcane\|10v1\|BQ536245 | 1206 | 6477 | 583 | LYM760 | 86 | globlastp |
| sugarcane\|10v1\|CA072146 | 1207 | 6477 | 583 | LYM760 | 86 | globlastp |
| switchgrass\|gb167\|FE611493 | 1208 | 6480 | 583 | LYM760 | 86 | globlastp |
| switchgrass\|gb167\|FL891045 | 1209 | 6481 | 583 | LYM760 | 86 | globlastp |
| onion\|12v1\|SRR073447X116647D1_P1 | 1210 | 6482 | 583 | LYM760 | 85.5 | globlastp |
| cenchrus\|gb166\|EB653351_P1 | 1211 | 6483 | 583 | LYM760 | 85.5 | globlastp |
| foxtail_millet\|11v3\|PHY7SI026922M_P1 | 1212 | 6484 | 583 | LYM760 | 85.5 | globlastp |
| maize\|10v1\|AI491555_P1 | 1213 | 6485 | 583 | LYM760 | 85.5 | globlastp |
| sorghum\|11v1\|SB01G001610 | 1214 | 6486 | 583 | LYM760 | 85.5 | globlastp |
| sorghum\|12v1\|SB01G001610_P1 | 1215 | 6486 | 583 | LYM760 | 85.5 | globlastp |
| switchgrass\|gb167\|DN141339 | 1216 | 6487 | 583 | LYM760 | 85.5 | globlastp |
| switchgrass\|gb167\|DN150793 | 1217 | 6487 | 583 | LYM760 | 85.5 | globlastp |
| switchgrass\|gb167\|FE606438 | 1218 | 6488 | 583 | LYM760 | 85.5 | globlastp |
| switchgrass\|gb167\|FE612240 | 1219 | 6488 | 583 | LYM760 | 85.5 | globlastp |
| switchgrass\|gb167\|FE641132 | 1220 | 6489 | 583 | LYM760 | 85.5 | globlastp |
| switchgrass\|gb167\|FL732190 | 1221 | 6490 | 583 | LYM760 | 85.5 | globlastp |
| cenchrus\|gb166\|EB660679_P1 | 1222 | 6491 | 583 | LYM760 | 84.9 | globlastp |
| foxtail_millet\|11v3\|EC612322_P1 | 1223 | 6492 | 583 | LYM760 | 84.9 | globlastp |
| sorghum\|11v1\|SB01G001600 | 1224 | 6493 | 583 | LYM760 | 84.9 | globlastp |
| sorghum\|12v1\|SB01G001600_P1 | 1225 | 6493 | 583 | LYM760 | 84.9 | globlastp |
| sorghum\|11v1\|SB09G006420 | 1226 | 6494 | 583 | LYM760 | 84.9 | globlastp |
| sorghum\|12v1\|SB09G006420_P1 | 1227 | 6494 | 583 | LYM760 | 84.9 | globlastp |
| sugarcane\|10v1\|CA083286 | 1228 | 6491 | 583 | LYM760 | 84.9 | globlastp |
| switchgrass\|gb167\|FE649592 | 1229 | 6495 | 583 | LYM760 | 84.9 | globlastp |
| chelidonium\|11v1\|SRR084752X105066_T1 | 1230 | 6496 | 583 | LYM760 | 84.88 | glotblastn |
| eschscholzia\|11v1\|CD480828_T1 | 1231 | 6497 | 583 | LYM760 | 84.88 | glotblastn |
| poppy\|11v1\|FE965353_T1 | 1232 | 6498 | 583 | LYM760 | 84.88 | glotblastn |
| poppy\|11v1\|FE965826_T1 | 1233 | 6498 | 583 | LYM760 | 84.88 | glotblastn |
| poppy\|11v1\|FE967490_T1 | 1234 | 6498 | 583 | LYM760 | 84.88 | glotblastn |
| poppy\|11v1\|SRR030259.101305_T1 | 1235 | 6498 | 583 | LYM760 | 84.88 | glotblastn |
| plantago\|11v2\|SRR066373X100642_P1 | 1236 | 6499 | 583 | LYM760 | 84.6 | globlastp |
| ginger\|gb164\|DY355808_T1 | 1237 | 6500 | 583 | LYM760 | 84.57 | glotblastn |
| onion\|12v1\|CF452777_P1 | 1238 | 6501 | 583 | LYM760 | 84.4 | globlastp |
| epimedium\|11v1\|SRR013502.10841_T1 | 1239 | 6502 | 583 | LYM760 | 84.39 | glotblastn |
| poppy\|11v1\|SRR030259.203246_T1 | 1240 | 6503 | 583 | LYM760 | 84.3 | glotblastn |
| apple\|11v1\|CN489689_T1 | 1241 | 6504 | 583 | LYM760 | 84.3 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| apple\|11v1\|CN489825_T1 | 1242 | 6505 | 583 | LYM760 | 84.3 | glotblastn |
| chelidonium\|11v1\|SRR084752X105632_T1 | 1243 | 6506 | 583 | LYM760 | 84.3 | glotblastn |
| foxtail_millet\|11v3\|PHY7SI011178M_P1 | 1244 | 6507 | 583 | LYM760 | 84.3 | globlastp |
| liquorice\|gb171\|FS240816_T1 | 1245 | 6508 | 583 | LYM760 | 84.3 | glotblastn |
| prunus\|10v1\|BU645557 | 1246 | 6509 | 583 | LYM760 | 84.3 | glotblastn |
| rice\|11v1\|AA750434 | 1247 | 6510 | 583 | LYM760 | 84.3 | globlastp |
| petunia\|gb171\|AF307336_P1 | 1248 | 6511 | 583 | LYM760 | 84 | globlastp |
| lotus\|09v1\|LLAW163870_P1 | 1249 | 6512 | 583 | LYM760 | 83.8 | globlastp |
| banana\|12v1\|FF558252_T1 | 1250 | 6513 | 583 | LYM760 | 83.72 | glotblastn |
| epimedium\|11v1\|SRR013502.14602_T1 | 1251 | 6514 | 583 | LYM760 | 83.72 | glotblastn |
| amorphophallus\|11v2\|SRR089351X108632_T1 | 1252 | 6515 | 583 | LYM760 | 83.72 | glotblastn |
| banana\|10v1\|FF558252 | 1253 | 6516 | 583 | LYM760 | 83.72 | glotblastn |
| cowpea\|12v1\|FC460686_T1 | 1254 | 6517 | 583 | LYM760 | 83.72 | glotblastn |
| cowpea\|gb166\|FC460686 | 1255 | 6517 | 583 | LYM760 | 83.72 | glotblastn |
| cyamopsis\|10v1\|EG978840_T1 | 1256 | 6518 | 583 | LYM760 | 83.72 | glotblastn |
| eschscholzia\|11v1\|CD479044_T1 | 1257 | 6519 | 583 | LYM760 | 83.72 | glotblastn |
| hornbeam\|12v1\|SRR364455.100948_T1 | 1258 | 6520 | 583 | LYM760 | 83.72 | glotblastn |
| hornbeam\|12v1\|SRR364455.101115_T1 | 1259 | 6521 | 583 | LYM760 | 83.72 | glotblastn |
| hornbeam\|12v1\|SRR364455.103182_T1 | 1260 | 6522 | 583 | LYM760 | 83.72 | glotblastn |
| kiwi\|gb166\|FG405238_T1 | 1261 | 6523 | 583 | LYM760 | 83.72 | glotblastn |
| liquorice\|gb171\|FS240713_T1 | 1262 | 6518 | 583 | LYM760 | 83.72 | glotblastn |
| oil_palm\|11v1\|EL608800_T1 | 1263 | 6524 | 583 | LYM760 | 83.72 | glotblastn |
| onion\|gb162\|CF442326 | 1264 | 6525 | 583 | LYM760 | 83.72 | glotblastn |
| peanut\|10v1\|CD038156_T1 | 1265 | 6526 | 583 | LYM760 | 83.72 | glotblastn |
| peanut\|10v1\|EG030378_T1 | 1266 | 6526 | 583 | LYM760 | 83.72 | glotblastn |
| peanut\|10v1\|GO335088_T1 | 1267 | 6527 | 583 | LYM760 | 83.72 | glotblastn |
| pigeonpea\|11v1\|GR467931_T1 | 1268 | 6528 | 583 | LYM760 | 83.72 | glotblastn |
| poppy\|11v1\|SRR030263.159893_T1 | 1269 | 6529 | 583 | LYM760 | 83.72 | glotblastn |
| poppy\|11v1\|SRR096789.107029_T1 | 1270 | 6530 | 583 | LYM760 | 83.72 | glotblastn |
| soybean\|11v1\|GLYMA08G10910 | 1271 | 6528 | 583 | LYM760 | 83.72 | glotblastn |
| tripterygium\|11v1\|SRR098677X102616 | 1272 | 6531 | 583 | LYM760 | 83.72 | glotblastn |
| foxtail_millet\|11v3\|PHY7SI014532M_P1 | 1273 | 6532 | 583 | LYM760 | 83.7 | globlastp |
| fraxinus\|11v1\|SRR058827.102209_P1 | 1274 | 6533 | 583 | LYM760 | 83.7 | globlastp |
| fraxinus\|11v1\|SRR058827.11888_P1 | 1275 | 6534 | 583 | LYM760 | 83.7 | globlastp |
| maize\|10v1\|AI600402_P1 | 1276 | 6535 | 583 | LYM760 | 83.7 | globlastp |
| rice\|11v1\|BI804985 | 1277 | 6536 | 583 | LYM760 | 83.7 | globlastp |
| ipomoea_batatas\|10v1\|BU692415_P1 | 1278 | 6537 | 583 | LYM760 | 83.4 | globlastp |
| basilicum\|10v1\|DY339498_P1 | 1279 | 6538 | 583 | LYM760 | 83.2 | globlastp |
| clover\|gb162\|BB917557_P1 | 1280 | 6539 | 583 | LYM760 | 83.2 | globlastp |
| eggplant\|10v1\|FS005230_P1 | 1281 | 6540 | 583 | LYM760 | 83.2 | globlastp |
| eggplant\|10v1\|FS011678_P1 | 1282 | 6540 | 583 | LYM760 | 83.2 | globlastp |
| potato\|10v1\|AJ489101_P1 | 1283 | 6538 | 583 | LYM760 | 83.2 | globlastp |
| solanum_phureja\|09v1\|SPHBG125159 | 1284 | 6538 | 583 | LYM760 | 83.2 | globlastp |
| tomato\|11v1\|BG125159 | 1285 | 6538 | 583 | LYM760 | 83.2 | globlastp |
| banana\|12v1\|BBS245T3_T1 | 1286 | 6541 | 583 | LYM760 | 83.14 | glotblastn |
| banana\|12v1\|ES433523_T1 | 1287 | 6542 | 583 | LYM760 | 83.14 | glotblastn |
| bean\|12v1\|CA847656_T1 | 1288 | 6543 | 583 | LYM760 | 83.14 | glotblastn |
| bean\|12v1\|CA897616_T1 | 1289 | 6544 | 583 | LYM760 | 83.14 | glotblastn |
| blueberry\|12v1\|SRR353282X14831D1_T1 | 1290 | 6545 | 583 | LYM760 | 83.14 | glotblastn |
| avocado\|10v1\|CK754785_T1 | 1291 | 6546 | 583 | LYM760 | 83.14 | glotblastn |
| bean\|gb167\|CA847656 | 1292 | 6547 | 583 | LYM760 | 83.14 | glotblastn |
| bean\|gb167\|CA897616 | 1293 | 6544 | 583 | LYM760 | 83.14 | glotblastn |
| bean\|gb167\|CA904078 | 1294 | 6544 | 583 | LYM760 | 83.14 | glotblastn |
| cacao\|10v1\|CU471664_T1 | 1295 | 6548 | 583 | LYM760 | 83.14 | glotblastn |
| chestnut\|gb170\|SRR006295S0002430_T1 | 1296 | 6549 | 583 | LYM760 | 83.14 | glotblastn |
| eschscholzia\|11v1\|CD479815XX2_T1 | 1297 | 6550 | 583 | LYM760 | 83.14 | glotblastn |
| euonymus\|11v1\|SRR070038X107205_T1 | 1298 | 6551 | 583 | LYM760 | 83.14 | glotblastn |
| euonymus\|11v1\|SRR070038X171037_T1 | 1299 | 6551 | 583 | LYM760 | 83.14 | glotblastn |
| euphorbia\|11v1\|BP959924_T1 | 1300 | 6552 | 583 | LYM760 | 83.14 | glotblastn |
| fraxinus\|11v1\|SRR058827.120211_T1 | 1301 | 6553 | 583 | LYM760 | 83.14 | glotblastn |
| ginseng\|10v1\|DV554399_T1 | 1302 | 6554 | 583 | LYM760 | 83.14 | glotblastn |
| jatropha\|09v1\|GO247326_T1 | 1303 | 6555 | 583 | LYM760 | 83.14 | glotblastn |
| liriodendron\|gb166\|CK755401_T1 | 1304 | 6556 | 583 | LYM760 | 83.14 | glotblastn |
| momordica\|10v1\|SRR071315S0014872_T1 | 1305 | 6557 | 583 | LYM760 | 83.14 | glotblastn |
| oak\|10v1\|DN949931_T1 | 1306 | 6549 | 583 | LYM760 | 83.14 | glotblastn |
| phalaenopsis\|11v1\|CB034562_T1 | 1307 | 6558 | 583 | LYM760 | 83.14 | glotblastn |
| platanus\|11v1\|SRR096786X10585_T1 | 1308 | 6559 | 583 | LYM760 | 83.14 | glotblastn |
| pteridium\|11v1\|SRR043594X112734 | 1309 | 6560 | 583 | LYM760 | 83.14 | glotblastn |
| sarracenia\|11v1\|SRR192669.121911 | 1310 | 6561 | 583 | LYM760 | 83.14 | glotblastn |
| scabiosa\|11v1\|SRR063723X102735 | 1311 | 6562 | 583 | LYM760 | 83.14 | glotblastn |
| soybean\|11v1\|GLYMA11G37160 | 1312 | 6563 | 583 | LYM760 | 83.14 | glotblastn |
| walnuts\|gb166\|CV196571 | 1313 | 6564 | 583 | LYM760 | 83.14 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| blueberry\|12v1\|CV190133_T1 | 1314 | 6545 | 583 | LYM760 | 83.14 | glotblastn |
| beet\|12v1\|EG549457_P1 | 1315 | 6565 | 583 | LYM760 | 83.1 | globlastp |
| gerbera\|09v1\|AJ760267_P1 | 1316 | 6566 | 583 | LYM760 | 83.1 | globlastp |
| maize\|10v1\|T15303_P1 | 1317 | 6567 | 583 | LYM760 | 83.1 | globlastp |
| orobanche\|10v1\|SRR023189S0003215_P1 | 1318 | 6568 | 583 | LYM760 | 83.1 | globlastp |
| orobanche\|10v1\|SRR023189S0005703_P1 | 1319 | 6568 | 583 | LYM760 | 83.1 | globlastp |
| triphysaria\|10v1\|BM357603 | 1320 | 6569 | 583 | LYM760 | 83.1 | globlastp |
| triphysaria\|10v1\|EX994468 | 1321 | 6570 | 583 | LYM760 | 83.1 | globlastp |
| sesame\|12v1\|BU670239_P1 | 1322 | 6571 | 583 | LYM760 | 82.9 | globlastp |
| antirrhinum\|gb166\|AJ787072_P1 | 1323 | 6572 | 583 | LYM760 | 82.9 | globlastp |
| primula\|11v1\|SRR098679X100806_P1 | 1324 | 6573 | 583 | LYM760 | 82.9 | globlastp |
| salvia\|10v1\|CV162996 | 1325 | 6574 | 583 | LYM760 | 82.9 | globlastp |
| rye\|gb164\|BE587543 | 1326 | 6575 | 583 | LYM760 | 82.86 | glotblastn |
| onion\|12v1\|CF442326_P1 | 1327 | 6576 | 583 | LYM760 | 82.8 | globlastp |
| plantago\|11v2\|SRR066373X130260_P1 | 1328 | 6577 | 583 | LYM760 | 82.8 | globlastp |
| tamarix\|gb166\|EH048696 | 1329 | 6578 | 583 | LYM760 | 82.8 | globlastp |
| trigonella\|11v1\|SRR066194X103772 | 1330 | 6579 | 583 | LYM760 | 82.7 | globlastp |
| artemisia\|10v1\|EY032503_P1 | 1331 | 6580 | 583 | LYM760 | 82.6 | globlastp |
| artemisia\|10v1\|EY045520_P1 | 1332 | 6581 | 583 | LYM760 | 82.6 | globlastp |
| cichorium\|gb1V1\|EH694244_P1 | 1333 | 6582 | 583 | LYM760 | 82.6 | globlastp |
| dandelion\|10v1\|DY815726_P1 | 1334 | 6583 | 583 | LYM760 | 82.6 | globlastp |
| amborella\|12v3\|FD427538_T1 | 1335 | 6584 | 583 | LYM760 | 82.56 | glotblastn |
| gossypium_raimondii\|12v1\|AI726781_T1 | 1336 | 6585 | 583 | LYM760 | 82.56 | glotblastn |
| banana\|10v1\|BBS245T3 | 1337 | 6586 | 583 | LYM760 | 82.56 | glotblastn |
| banana\|10v1\|ES433523 | 1338 | 6587 | 583 | LYM760 | 82.56 | glotblastn |
| beech\|11v1\|SRR006293.1092_T1 | 1339 | 6588 | 583 | LYM760 | 82.56 | glotblastn |
| blueberry\|10v1\|CV190133 | 1340 | 6589 | 583 | LYM760 | 82.56 | glotblastn |
| cacao\|10v1\|CU469928_T1 | 1341 | 6590 | 583 | LYM760 | 82.56 | glotblastn |
| chestnut\|gb170\|SRR006295S0001290_T1 | 1342 | 6591 | 583 | LYM760 | 82.56 | glotblastn |
| chestnut\|gb170\|SRR006295S0001391_T1 | 1343 | 6592 | 583 | LYM760 | 82.56 | glotblastn |
| cucumber\|09v1\|CO995698_T1 | 1344 | 6593 | 583 | LYM760 | 82.56 | glotblastn |
| eucalyptus\|11v2\|CT980338_T1 | 1345 | 6594 | 583 | LYM760 | 82.56 | glotblastn |
| eucalyptus\|11v2\|CU397857_T1 | 1346 | 6595 | 583 | LYM760 | 82.56 | glotblastn |
| kiwi\|gb166\|FG412372_T1 | 1347 | 6596 | 583 | LYM760 | 82.56 | glotblastn |
| kiwi\|gb166\|FG421221_T1 | 1348 | 6597 | 583 | LYM760 | 82.56 | glotblastn |
| liriodendron\|gb166\|CO997662_T1 | 1349 | 6598 | 583 | LYM760 | 82.56 | glotblastn |
| lotus\|09v1\|BW595673_T1 | 1350 | 6599 | 583 | LYM760 | 82.56 | glotblastn |
| maritime_pine\|10v1\|AL750805_T1 | 1351 | 6600 | 583 | LYM760 | 82.56 | glotblastn |
| melon\|10v1\|EB715618_T1 | 1352 | 6593 | 583 | LYM760 | 82.56 | glotblastn |
| nuphar\|gb166\|CK756234_T1 | 1353 | 6601 | 583 | LYM760 | 82.56 | glotblastn |
| oak\|10v1\|FP029565_T1 | 1354 | 6592 | 583 | LYM760 | 82.56 | glotblastn |
| phalaenopsis\|11v1\|CB032564_T1 | 1355 | 6602 | 583 | LYM760 | 82.56 | glotblastn |
| phalaenopsis\|11v1\|SRR125771.100200_T1 | 1356 | 6603 | 583 | LYM760 | 82.56 | glotblastn |
| platanus\|11v1\|SRR096786X10287_T1 | 1357 | 6604 | 583 | LYM760 | 82.56 | glotblastn |
| prunus\|10v1\|DY637688 | 1358 | 6605 | 583 | LYM760 | 82.56 | glotblastn |
| rhizophora\|10v1\|SRR005792S0001536 | 1359 | 6606 | 583 | LYM760 | 82.56 | glotblastn |
| sarracenia\|11v1\|SRR192669.103387 | 1360 | 6607 | 583 | LYM760 | 82.56 | glotblastn |
| scabiosa\|11v1\|SRR063723X101324 | 1361 | 6608 | 583 | LYM760 | 82.56 | glotblastn |
| spruce\|11v1\|ES246598 | 1362 | 6609 | 583 | LYM760 | 82.56 | glotblastn |
| spruce\|11v1\|EX308935 | 1363 | 6609 | 583 | LYM760 | 82.56 | glotblastn |
| spruce\|11v1\|EX357474 | 1364 | 6609 | 583 | LYM760 | 82.56 | glotblastn |
| gossypium_raimondii\|12v1\|DN828085_T1 | 1365 | — | 583 | LYM760 | 82.56 | glotblastn |
| antirrhinum\|gb166\|AJ559208_P1 | 1366 | 6610 | 583 | LYM760 | 82.3 | globlastp |
| antirrhinum\|gb166\|AJ789315_P1 | 1367 | 6611 | 583 | LYM760 | 82.3 | globlastp |
| chickpea\|11v1\|FE670095_P1 | 1368 | 6612 | 583 | LYM760 | 82.2 | globlastp |
| ipomoea_batatas\|10v1\|BM878747_P1 | 1369 | 6613 | 583 | LYM760 | 82.2 | globlastp |
| ipomoea_nil\|10v1\|BJ554125_P1 | 1370 | 6614 | 583 | LYM760 | 82.2 | globlastp |
| nasturtium\|11v1\|SRR032558.103763_P1 | 1371 | 6615 | 583 | LYM760 | 82.1 | globlastp |
| platanus\|11v1\|SRR096786X113985_T1 | 1372 | 6616 | 583 | LYM760 | 82.08 | glotblastn |
| sunflower\|12v1\|AJ828516_P1 | 1373 | 6617 | 583 | LYM760 | 82 | globlastp |
| sunflower\|12v1\|CD851489_P1 | 1374 | 6618 | 583 | LYM760 | 82 | globlastp |
| sunflower\|12v1\|CD852373_P1 | 1375 | 6617 | 583 | LYM760 | 82 | globlastp |
| sunflower\|12v1\|CD854468_P1 | 1376 | 6618 | 583 | LYM760 | 82 | globlastp |
| sunflower\|12v1\|EE609512_P1 | 1377 | 6617 | 583 | LYM760 | 82 | globlastp |
| acacia\|10v1\|FS584657_P1 | 1378 | 6619 | 583 | LYM760 | 82 | globlastp |
| arnica\|11v1\|SRR099034X102961_P1 | 1379 | 6620 | 583 | LYM760 | 82 | globlastp |
| artemisia\|10v1\|EY046512_P1 | 1380 | 6621 | 583 | LYM760 | 82 | globlastp |
| beet\|gb162\|BQ588905 | 1381 | 6622 | 583 | LYM760 | 82 | globlastp |
| cichorium\|gb171\|DT213405_P1 | 1382 | 6623 | 583 | LYM760 | 82 | globlastp |
| cirsium\|11v1\|SRR346952.107453_P1 | 1383 | 6624 | 583 | LYM760 | 82 | globlastp |
| sunflower\|10v1\|CD851489 | 1384 | 6618 | 583 | LYM760 | 82 | globlastp |
| sunflower\|10v1\|CD852373 | 1385 | 6617 | 583 | LYM760 | 82 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| tea\|10v1\|CV014416 | 1386 | 6625 | 583 | LYM760 | 82 | globlastp |
| amborella\|12v3\|CK757653_T1 | 1387 | 6626 | 583 | LYM760 | 81.98 | glotblastn |
| blueberry\|12v1\|SRR353282X10932D1_T1 | 1388 | 6627 | 583 | LYM760 | 81.98 | glotblastn |
| gossypium_raimondii\|12v1\|AI731084_T1 | 1389 | 6628 | 583 | LYM760 | 81.98 | glotblastn |
| medicago\|12v1\|AW257287_T1 | 1390 | 6629 | 583 | LYM760 | 81.98 | glotblastn |
| rose\|12v1\|EC586189_T1 | 1391 | 6630 | 583 | LYM760 | 81.98 | glotblastn |
| apple\|11v1\|CN443881_T1 | 1392 | 6631 | 583 | LYM760 | 81.98 | glotblastn |
| avocado\|10v1\|CO999693_T1 | 1393 | 6632 | 583 | LYM760 | 81.98 | glotblastn |
| canola\|11v1\|CN726169_T1 | 1394 | 6633 | 583 | LYM760 | 81.98 | glotblastn |
| cassava\|09v1\|CK643505_T1 | 1395 | 6634 | 583 | LYM760 | 81.98 | glotblastn |
| cedrus1\|11v1\|SRR065007X101528_T1 | 1396 | 6635 | 583 | LYM760 | 81.98 | glotblastn |
| cotton\|11v1\|AI731084_T1 | 1397 | 6636 | 583 | LYM760 | 81.98 | glotblastn |
| cotton\|11v1\|SRR032367.118019_T1 | 1398 | 6637 | 583 | LYM760 | 81.98 | glotblastn |
| cotton\|11v1\|SRR032879.529482_T1 | 1399 | 6638 | 583 | LYM760 | 81.98 | glotblastn |
| cucurbita\|11v1\|SRR091276X127712_T1 | 1400 | 6639 | 583 | LYM760 | 81.98 | glotblastn |
| cycas\|gb166\|CB088887_T1 | 1401 | 6640 | 583 | LYM760 | 81.98 | glotblastn |
| eschscholzia\|11v1\|SRR014116.108111_T1 | 1402 | 6641 | 583 | LYM760 | 81.98 | glotblastn |
| euonymus\|11v1\|SRR070038X113623_T1 | 1403 | 6642 | 583 | LYM760 | 81.98 | glotblastn |
| euonymus\|11v1\|SRR070038X136443_T1 | 1404 | 6643 | 583 | LYM760 | 81.98 | glotblastn |
| euphorbia\|11v1\|SRR098678X119547_T1 | 1405 | 6644 | 583 | LYM760 | 81.98 | glotblastn |
| grape\|11v1\|GSVIVT01008528001_T1 | 1406 | 6645 | 583 | LYM760 | 81.98 | glotblastn |
| guizotia\|10v1\|GE569571_T1 | 1407 | 6646 | 583 | LYM760 | 81.98 | glotblastn |
| oak\|10v1\|DB998592_T1 | 1408 | 6647 | 583 | LYM760 | 81.98 | glotblastn |
| pine\|10v2\|AI812509_T1 | 1409 | 6648 | 583 | LYM760 | 81.98 | glotblastn |
| pseudotsuga\|10v1\|SRR065119S0008449 | 1410 | 6649 | 583 | LYM760 | 81.98 | glotblastn |
| rose\|10v1\|EC586189 | 1411 | 6630 | 583 | LYM760 | 81.98 | glotblastn |
| strawberry\|11v1\|EX658002 | 1412 | 6650 | 583 | LYM760 | 81.98 | glotblastn |
| tea\|10v1\|CV013703 | 1413 | 6651 | 583 | LYM760 | 81.98 | glotblastn |
| valeriana\|11v1\|SRR099039X105420 | 1414 | 6652 | 583 | LYM760 | 81.98 | glotblastn |
| amborella\|12v31SRR038635.14415_T1 | 1415 | 6653 | 583 | LYM760 | 81.98 | glotblastn |
| acacia\|10v1\|FS584933_T1 | 1416 | — | 583 | LYM760 | 81.98 | glotblastn |
| watermelon\|11v1\|CO995698 | 1417 | — | 583 | LYM760 | 81.98 | glotblastn |
| sesame\|12v1\|BU667815_T1 | 1418 | — | 583 | LYM760 | 81.98 | glotblastn |
| blueberry\|12v1\|SRR353282X52680D1_T1 | 1419 | 6654 | 583 | LYM760 | 81.82 | glotblastn |
| sarracenia\|11v1\|SRR192669.103766 | 1420 | 6655 | 583 | LYM760 | 81.82 | glotblastn |
| cotton\|11v1\|AI728710_P1 | 1421 | 6656 | 583 | LYM760 | 81.8 | globlastp |
| pigeonpea\|11v1\|SRR054580X126641_P1 | 1422 | 6657 | 583 | LYM760 | 81.8 | globlastp |
| poplar\|10v1\|AI162577_P1 | 1423 | 6658 | 583 | LYM760 | 81.8 | globlastp |
| poplar\|10v1\|AI162657_P1 | 1424 | 6659 | 583 | LYM760 | 81.8 | globlastp |
| silene\|11v1\|SRR096785X119114 | 1425 | 6660 | 583 | LYM760 | 81.8 | globlastp |
| tragopogon\|10v1\|SRR020205S0004726 | 1426 | 6661 | 583 | LYM760 | 81.8 | globlastp |
| vinca\|11v1\|SRR098690X100575 | 1427 | 6662 | 583 | LYM760 | 81.8 | globlastp |
| vinca\|11v1\|SRR098690X10889 | 1428 | 6662 | 583 | LYM760 | 81.8 | globlastp |
| vinca\|11v1\|SRR098690X119425 | 1429 | 6662 | 583 | LYM760 | 81.8 | globlastp |
| melon\|10v1\|DV632761_T1 | 1430 | 6663 | 583 | LYM760 | 81.71 | glotblastn |
| petunia\|gb171\|CV299961_P1 | 1431 | 6664 | 583 | LYM760 | 81.7 | globlastp |
| petunia\|gb171\|FN002496_P1 | 1432 | 6665 | 583 | LYM760 | 81.7 | globlastp |
| phyla\|11v2\|SRR099035X102586_P1 | 1433 | 6666 | 583 | LYM760 | 81.7 | globlastp |
| salvia\|10v1\|CV168187 | 1434 | 6667 | 583 | LYM760 | 81.7 | globlastp |
| tobacco\|gb162\|EB444842 | 1435 | 6668 | 583 | LYM760 | 81.7 | globlastp |
| banana\|12v1\|MAGEN2012036119_P1 | 1436 | 6669 | 583 | LYM760 | 81.6 | globlastp |
| chickpea\|11v1\|GR392014_P1 | 1437 | 6670 | 583 | LYM760 | 81.6 | globlastp |
| ginger\|gb164\|DY369971_P1 | 1438 | 6671 | 583 | LYM760 | 81.6 | globlastp |
| ipomoea_nil\|10v1\|BJ555420_P1 | 1439 | 6672 | 583 | LYM760 | 81.6 | globlastp |
| petunia\|gb171\|FN000702_P1 | 1440 | 6673 | 583 | LYM760 | 81.6 | globlastp |
| pineapple\|10v1\|DT337877_P1 | 1441 | 6674 | 583 | LYM760 | 81.6 | globlastp |
| utricularia\|11v1\|SRR094438.101660 | 1442 | 6675 | 583 | LYM760 | 81.6 | globlastp |
| pepper\|12v1\|BM066089_P1 | 1443 | 6676 | 583 | LYM760 | 81.5 | globlastp |
| castorbean\|11v1\|EE257151_P1 | 1444 | 6677 | 583 | LYM760 | 81.5 | globlastp |
| fagopyrum\|11v1\|SRR063689X104383_T1 | 1445 | 6678 | 583 | LYM760 | 81.5 | glotblastn |
| pepper\|12v1\|BM064355_P1 | 1446 | 6679 | 583 | LYM760 | 81.5 | globlastp |
| pepper\|gb171\|BM064355 | 1447 | 6679 | 583 | LYM760 | 81.5 | globlastp |
| poplar\|10v1\|AI165586_P1 | 1448 | 6680 | 583 | LYM760 | 81.5 | globlastp |
| safflower\|gb162\|EL379716 | 1449 | 6681 | 583 | LYM760 | 81.5 | globlastp |
| b_juncea\|12v1\|E6ANDIZ01A9U3Q_T1 | 1450 | 6682 | 583 | LYM760 | 81.4 | glotblastn |
| rose\|12v1\|BQ105820_T1 | 1451 | 6683 | 583 | LYM760 | 81.4 | glotblastn |
| spruce\|11v1\|SRR065813X10900_T1 | 1452 | 6684 | 583 | LYM760 | 81.4 | glotblastn |
| sunflower\|12v1\|CD850938_T1 | 1453 | 6685 | 583 | LYM760 | 81.4 | glotblastn |
| sunflower\|12v1\|EE650833_T1 | 1454 | 6685 | 583 | LYM760 | 81.4 | glotblastn |
| sunflower\|12v1\|EL434488_P1 | 1455 | 6686 | 583 | LYM760 | 81.4 | globlastp |
| abies\|11v2\|SRR098676X11068_T1 | 1456 | 6687 | 583 | LYM760 | 81.4 | glotblastn |
| apple\|11v1\|CK900598_T1 | 1457 | 6688 | 583 | LYM760 | 81.4 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| apple|11v1|CN444412_T1 | 1458 | 6688 | 583 | LYM760 | 81.4 | glotblastn |
| aristolochia|10v1|SRR039082S0121028_T1 | 1459 | 6689 | 583 | LYM760 | 81.4 | glotblastn |
| b_juncea|10v2|E6ANDIZ01BJUO1 | 1460 | 6690 | 583 | LYM760 | 81.4 | glotblastn |
| beech|11v1|SRR006293.25156_T1 | 1461 | 6691 | 583 | LYM760 | 81.4 | glotblastn |
| canola|11v1|EE481490_T1 | 1462 | 6692 | 583 | LYM760 | 81.4 | glotblastn |
| centaurea|gb166|EH737751_P1 | 1463 | 6693 | 583 | LYM760 | 81.4 | globlastp |
| cleome_gynandra|10v1|SRR015532S0009161_T1 | 1464 | 6694 | 583 | LYM760 | 81.4 | glotblastn |
| cotton|11v1|AI726781_T1 | 1465 | 6695 | 583 | LYM760 | 81.4 | glotblastn |
| cotton|11v1|AI730604_T1 | 1466 | 6696 | 583 | LYM760 | 81.4 | glotblastn |
| cotton|11v1|ES802837_T1 | 1467 | 6696 | 583 | LYM760 | 81.4 | glotblastn |
| cucurbita|11v1|SRR091276X208189_T1 | 1468 | 6697 | 583 | LYM760 | 81.4 | glotblastn |
| flaveria|11v1|SRR149229.195822_P1 | 1469 | 6698 | 583 | LYM760 | 81.4 | globlastp |
| flaveria|11v1|SRR149232.163368_P1 | 1470 | 6698 | 583 | LYM760 | 81.4 | globlastp |
| ginseng|10v1|CN847512_T1 | 1471 | 6699 | 583 | LYM760 | 81.4 | glotblastn |
| grape|11v1|GSVIVT01010449001_T1 | 1472 | 6700 | 583 | LYM760 | 81.4 | glotblastn |
| humulus|11v1|EX518043_T1 | 1473 | 6701 | 583 | LYM760 | 81.4 | glotblastn |
| iceplant|gb164|BE035426_T1 | 1474 | 6702 | 583 | LYM760 | 81.4 | glotblastn |
| iceplant|gb164|BE036443_P1 | 1475 | 6703 | 583 | LYM760 | 81.4 | globlastp |
| lovegrass|gb167|EH195466_T1 | 1476 | 6704 | 583 | LYM760 | 81.4 | glotblastn |
| nuphar|gb166|CD473899_P1 | 1477 | 6705 | 583 | LYM760 | 81.4 | globlastp |
| pineapple|10v1|CO731901_T1 | 1478 | 6706 | 583 | LYM760 | 81.4 | glotblastn |
| prunus|10v1|BU040310 | 1479 | 6707 | 583 | LYM760 | 81.4 | glotblastn |
| radish|gb164|EW716260 | 1480 | 6708 | 583 | LYM760 | 81.4 | glotblastn |
| radish|gb164|EX766114 | 1481 | 6709 | 583 | LYM760 | 81.4 | glotblastn |
| rose|10v1|BQ105820 | 1482 | 6710 | 583 | LYM760 | 81.4 | glotblastn |
| spurge|gb161|BE095334 | 1483 | 6711 | 583 | LYM760 | 81.4 | glotblastn |
| sunflower|10v1|CD850938 | 1484 | 6685 | 583 | LYM760 | 81.4 | glotblastn |
| thellungiella_halophilum|11v1|BY805261 | 1485 | 6712 | 583 | LYM760 | 81.4 | glotblastn |
| thellungiella|gb167|BY805261 | 1486 | 6712 | 583 | LYM760 | 81.4 | glotblastn |
| trigonella|11v1|SRR066194X101290 | 1487 | 6713 | 583 | LYM760 | 81.4 | glotblastn |
| tripterygium|11v1|SRR098677X102922 | 1488 | 6714 | 583 | LYM760 | 81.4 | glotblastn |
| tripterygium|11v1|SRR098677X103255 | 1489 | 6715 | 583 | LYM760 | 81.4 | glotblastn |
| tripterygium|11v1|SRR098677X119093 | 1490 | 6716 | 583 | LYM760 | 81.4 | glotblastn |
| valeriana|11v1|SRR099039X110308 | 1491 | 6717 | 583 | LYM760 | 81.4 | glotblastn |
| kiwi|gb166|FG417979_T1 | 1492 | 6718 | 583 | LYM760 | 81.25 | glotblastn |
| gossypium_raimondii|12v1|AI726699_P1 | 1493 | 6719 | 583 | LYM760 | 81.2 | globlastp |
| gossypium_raimondii|12v1|DN828085_P1 | 1494 | 6720 | 583 | LYM760 | 81.2 | globlastp |
| catharanthus|11v1|SRR098691X109336_P1 | 1495 | 6721 | 583 | LYM760 | 81.2 | globlastp |
| cotton|11v1|AI726699_P1 | 1496 | 6722 | 583 | LYM760 | 81.2 | globlastp |
| cotton|11v1|DW509312_P1 | 1497 | 6723 | 583 | LYM760 | 81.2 | globlastp |
| cotton|11v1|SRR032367.343758_P1 | 1498 | 6724 | 583 | LYM760 | 81.2 | globlastp |
| humulus|11v1|GD243842_P1 | 1499 | 6725 | 583 | LYM760 | 81.2 | globlastp |
| aquilegia|10v2|JGIAC009868_T1 | 1500 | 6726 | 583 | LYM760 | 81.14 | glotblastn |
| abies|11v2|SRR098676X110388_T1 | 1501 | 6727 | 583 | LYM760 | 81.14 | glotblastn |
| watermelon|11v1|AA660016 | 1502 | 6728 | 583 | LYM760 | 81.14 | glotblastn |
| cynara|gb167|GE587696_P1 | 1503 | 6729 | 583 | LYM760 | 81.1 | globlastp |
| dandelion|10v1|DR400958_P1 | 1504 | 6730 | 583 | LYM760 | 81.1 | globlastp |
| lettuce|10v1|DW044441 | 1505 | 6731 | 583 | LYM760 | 81.1 | globlastp |
| lettuce|10v1|DW103855 | 1506 | 6731 | 583 | LYM760 | 81.1 | globlastp |
| salvia|10v1|FE536201 | 1507 | 6732 | 583 | LYM760 | 81.1 | globlastp |
| tobacco|gb162|BP192588 | 1508 | 6733 | 583 | LYM760 | 81.1 | globlastp |
| tobacco|gb162|EB445168 | 1509 | 6734 | 583 | LYM760 | 81.1 | globlastp |
| lettuce|12v1|DW044441_P1 | 1510 | 6731 | 583 | LYM760 | 81.1 | globlastp |
| arnica|11v1|SRR099034X110535_P1 | 1511 | 6735 | 583 | LYM760 | 81 | globlastp |
| tobacco|gb162|EB446475 | 1512 | 6736 | 583 | LYM760 | 81 | globlastp |
| fagopyrum|11v1|SRR063689X100111_T1 | 1513 | 6737 | 583 | LYM760 | 80.92 | glotblastn |
| fagopyrum|11v1|SRR063689X110740_T1 | 1514 | 6738 | 583 | LYM760 | 80.92 | glotblastn |
| fagopyrum|11v1|SRR063689X129362_T1 | 1515 | 6737 | 583 | LYM760 | 80.92 | glotblastn |
| fagopyrum|11v1|SRR063703X101431_T1 | 1516 | 6737 | 583 | LYM760 | 80.92 | glotblastn |
| fagopyrum|11v1|SRR063703X103062_T1 | 1517 | 6739 | 583 | LYM760 | 80.92 | glotblastn |
| fagopyrum|11v1|SRR063703X121725_T1 | 1518 | 6737 | 583 | LYM760 | 80.92 | glotblastn |
| flax|11v1|JG017829_T1 | 1519 | 6740 | 583 | LYM760 | 80.92 | glotblastn |
| maize|10v1|CF002266_T1 | 1520 | 6741 | 583 | LYM760 | 80.92 | glotblastn |
| acacia|10v1|FS588114_P1 | 1521 | 6742 | 583 | LYM760 | 80.9 | globlastp |
| centaurea|gb166|EH740933_P1 | 1522 | 6743 | 583 | LYM760 | 80.9 | globlastp |
| citrus|gb166|BQ623787 | 1523 | 6744 | 583 | LYM760 | 80.9 | globlastp |
| nasturtium|11v1|SRR032558.100234_P1 | 1524 | 6745 | 583 | LYM760 | 80.9 | globlastp |
| aquilegia|10v2|DT731294_T1 | 1525 | 6746 | 583 | LYM760 | 80.81 | glotblastn |
| cannabis|12v1|EW701382_T1 | 1526 | 6747 | 583 | LYM760 | 80.81 | glotblastn |
| sunflower|12v1|AJ318272_T1 | 1527 | 6748 | 583 | LYM760 | 80.81 | glotblastn |
| sunflower|12v1|DY928337_T1 | 1528 | 6749 | 583 | LYM760 | 80.81 | glotblastn |
| sunflower|12v1|GE518018_T1 | 1529 | 6750 | 583 | LYM760 | 80.81 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| ambrosia\|11v1\|GR935645_T1 | 1530 | 6751 | 583 | LYM760 | 80.81 | glotblastn |
| ambrosia\|11v1\|SRR346935.164677_T1 | 1531 | 6752 | 583 | LYM760 | 80.81 | glotblastn |
| aquilegia\|10v1\|DT731294 | 1532 | 6746 | 583 | LYM760 | 80.81 | glotblastn |
| aristolochia\|10v1\|FD755672_T1 | 1533 | 6753 | 583 | LYM760 | 80.81 | glotblastn |
| b_juncea\|10v2\|E6ANDIZ01AKJXR | 1534 | 6754 | 583 | LYM760 | 80.81 | glotblastn |
| canola\|11v1\|DY001355_T1 | 1535 | 6755 | 583 | LYM760 | 80.81 | glotblastn |
| clementine\|11v1\|BQ623787_T1 | 1536 | 6756 | 583 | LYM760 | 80.81 | glotblastn |
| cucurbita\|11v1\|SRR091276X10045_T1 | 1537 | 6757 | 583 | LYM760 | 80.81 | glotblastn |
| eucalyptus\|11v2\|CU398525_T1 | 1538 | 6758 | 583 | LYM760 | 80.81 | glotblastn |
| euonymus\|11v1\|SRR070038X116892_T1 | 1539 | 6759 | 583 | LYM760 | 80.81 | glotblastn |
| euonymus\|11v1\|SRR070038X118444_T1 | 1540 | 6760 | 583 | LYM760 | 80.81 | glotblastn |
| euphorbia\|11v1\|BE095334_T1 | 1541 | 6761 | 583 | LYM760 | 80.81 | glotblastn |
| flaveria\|11v1\|SRR149229.13816_T1 | 1542 | 6762 | 583 | LYM760 | 80.81 | glotblastn |
| flaveria\|11v1\|SRR149232.133716_T1 | 1543 | 6763 | 583 | LYM760 | 80.81 | glotblastn |
| fraxinus\|11v1\|SRR058827.121069_T1 | 1544 | 6764 | 583 | LYM760 | 80.81 | glotblastn |
| lettuce\|10v1\|DW075551 | 1545 | 6765 | 583 | LYM760 | 80.81 | glotblastn |
| nasturtium\|11v1\|GH164168_T1 | 1546 | 6766 | 583 | LYM760 | 80.81 | glotblastn |
| oil_palm\|11v1\|EL930302_T1 | 1547 | 6767 | 583 | LYM760 | 80.81 | glotblastn |
| orange\|11v1\|BQ623787_T1 | 1548 | 6768 | 583 | LYM760 | 80.81 | glotblastn |
| pine\|10v2\|AA556795_T1 | 1549 | 6769 | 583 | LYM760 | 80.81 | glotblastn |
| pseudotsuga\|10v1\|SRR065119S0004645 | 1550 | 6770 | 583 | LYM760 | 80.81 | glotblastn |
| spruce\|11v1\|ES250811 | 1551 | 6771 | 583 | LYM760 | 80.81 | glotblastn |
| spruce\|11v1\|ES255391 | 1552 | 6771 | 583 | LYM760 | 80.81 | glotblastn |
| strawberry\|11v1\|CO381871 | 1553 | 6772 | 583 | LYM760 | 80.81 | glotblastn |
| thellungiella_parvulum\|11v1\|BY805261 | 1554 | 6773 | 583 | LYM760 | 80.81 | glotblastn |
| thellungiella_parvulum\|11v1\|DN773781 | 1555 | 6774 | 583 | LYM760 | 80.81 | glotblastn |
| walnuts\|gb166\|EL895959 | 1556 | 6775 | 583 | LYM760 | 80.81 | glotblastn |
| canola\|11v1\|CN737592_T1 | 1557 | — | 583 | LYM760 | 80.81 | glotblastn |
| beet\|12v1\|BE590426_P1 | 1558 | 6776 | 583 | LYM760 | 80.8 | globlastp |
| sunflower\|12v1\|DY938990_P1 | 1559 | 6777 | 583 | LYM760 | 80.8 | globlastp |
| b_rapa\|11v1\|BG544511_P1 | 1560 | 6778 | 583 | LYM760 | 80.8 | globlastp |
| basilicum\|10v1\|DY329036_P1 | 1561 | 6779 | 583 | LYM760 | 80.8 | globlastp |
| beet\|gb162\|BE590426 | 1562 | 6776 | 583 | LYM760 | 80.8 | globlastp |
| cynara\|gb167\|GE586094_P1 | 1563 | 6780 | 583 | LYM760 | 80.8 | globlastp |
| hevea\|10v1\|EC603246_P1 | 1564 | 6781 | 583 | LYM760 | 80.8 | globlastp |
| hevea\|10v1\|EC609673_P1 | 1565 | 6782 | 583 | LYM760 | 80.8 | globlastp |
| papaya\|gb165\|EX280996_P1 | 1566 | 6783 | 583 | LYM760 | 80.8 | globlastp |
| sesame\|10v1\|BU667815 | 1567 | 6784 | 583 | LYM760 | 80.8 | globlastp |
| tragopogon\|10v1\|SRR020205S0025254 | 1568 | 6785 | 583 | LYM760 | 80.8 | globlastp |
| cannabis\|12v1\|GR220602_P1 | 1569 | 6786 | 583 | LYM760 | 80.7 | globlastp |
| cannabis\|12v1\|JK498389_P1 | 1570 | 6786 | 583 | LYM760 | 80.7 | globlastp |
| gossypium_raimondii\|12v1\|AI728710_P1 | 1571 | 6787 | 583 | LYM760 | 80.7 | globlastp |
| b_oleracea\|gb161\|DY025916_P1 | 1572 | 6788 | 583 | LYM760 | 80.7 | globlastp |
| b_rapa\|11v1\|BQ704964_P1 | 1573 | 6788 | 583 | LYM760 | 80.7 | globlastp |
| basilicum\|10v1\|DY332795_P1 | 1574 | 6789 | 583 | LYM760 | 80.7 | globlastp |
| canola\|11v1\|DW997169_P1 | 1575 | 6788 | 583 | LYM760 | 80.7 | globlastp |
| catharanthus\|11v1\|EG556654_P1 | 1576 | 6790 | 583 | LYM760 | 80.7 | globlastp |
| radish\|gb164\|EV537345 | 1577 | 6788 | 583 | LYM760 | 80.7 | globlastp |
| radish\|gb164\|EX747874 | 1578 | 6788 | 583 | LYM760 | 80.7 | globlastp |
| radish\|gb164\|EX749498 | 1579 | 6788 | 583 | LYM760 | 80.7 | globlastp |
| silene\|11v1\|GH293494 | 1580 | 6791 | 583 | LYM760 | 80.7 | globlastp |
| utricularia\|11v1\|SRR094438.102275 | 1581 | 6792 | 583 | LYM760 | 80.7 | globlastp |
| castorbean\|11v1\|T15167_T1 | 1582 | 6793 | 583 | LYM760 | 80.68 | glotblastn |
| sunflower\|12v1\|CD846736_P1 | 1583 | 6794 | 583 | LYM760 | 80.6 | globlastp |
| sunflower\|12v1\|CD850173_P1 | 1584 | 6794 | 583 | LYM760 | 80.6 | globlastp |
| sunflower\|12v1\|CD855076_P1 | 1585 | 6794 | 583 | LYM760 | 80.6 | globlastp |
| sunflower\|12v1\|DY925154_P1 | 1586 | 6794 | 583 | LYM760 | 80.6 | globlastp |
| sunflower\|12v1\|DY927936_P1 | 1587 | 6794 | 583 | LYM760 | 80.6 | globlastp |
| sunflower\|12v1\|DY953142_P1 | 1588 | 6794 | 583 | LYM760 | 80.6 | globlastp |
| sunflower\|12v1\|EE648809_P1 | 1589 | 6794 | 583 | LYM760 | 80.6 | globlastp |
| arabidopsis_lyrata\|09v1\|JGIAL006912_P1 | 1590 | 6795 | 583 | LYM760 | 80.6 | globlastp |
| arabidopsis\|10v1\|AT1G67430_P1 | 1591 | 6795 | 583 | LYM760 | 80.6 | globlastp |
| arnica\|11v1\|SRR099034X100741_P1 | 1592 | 6796 | 583 | LYM760 | 80.6 | globlastp |
| centaurea\|gb166\|EH713924_P1 | 1593 | 6794 | 583 | LYM760 | 80.6 | globlastp |
| centaurea\|gb166\|EH780592_P1 | 1594 | 6797 | 583 | LYM760 | 80.6 | globlastp |
| cichorium\|gb171\|EH701895_P1 | 1595 | 6798 | 583 | LYM760 | 80.6 | globlastp |
| cirsium\|11v1\|SRR346952.1007410_P1 | 1596 | 6797 | 583 | LYM760 | 80.6 | globlastp |
| cirsium\|11v1\|SRR346952.161970_P1 | 1597 | 6799 | 583 | LYM760 | 80.6 | globlastp |
| citrus\|gb166\|CB290698 | 1598 | 6800 | 583 | LYM760 | 80.6 | globlastp |
| clementine\|11v1\|CB290698_P1 | 1599 | 6800 | 583 | LYM760 | 80.6 | globlastp |
| dandelion\|10v1\|DR398698_P1 | 1600 | 6801 | 583 | LYM760 | 80.6 | globlastp |
| dandelion\|10v1\|DR399764_P1 | 1601 | 6802 | 583 | LYM760 | 80.6 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| guizotia\|10v1\|GE552271_P1 | 1602 | 6803 | 583 | LYM760 | 80.6 | globlastp |
| orange\|11v1\|CB290698_P1 | 1603 | 6800 | 583 | LYM760 | 80.6 | globlastp |
| potato\|10v1\|BG351152_P1 | 1604 | 6804 | 583 | LYM760 | 80.6 | globlastp |
| safflower\|gb162\|EL386625 | 1605 | 6797 | 583 | LYM760 | 80.6 | globlastp |
| safflower\|gb162\|EL401251 | 1606 | 6794 | 583 | LYM760 | 80.6 | globlastp |
| solanum_phureja\|09v1\|SPHBG123303 | 1607 | 6804 | 583 | LYM760 | 80.6 | globlastp |
| sunflower\|10v1\|AJ318272 | 1608 | 6794 | 583 | LYM760 | 80.6 | globlastp |
| sunflower\|10v1\|CD850173 | 1609 | 6794 | 583 | LYM760 | 80.6 | globlastp |
| thellungiella\|gb167\|DN773781 | 1610 | 6795 | 583 | LYM760 | 80.6 | globlastp |
| tobacco\|gb162\|CV016200 | 1611 | 6805 | 583 | LYM760 | 80.6 | globlastp |
| tomato\|11v1\|BG123303 | 1612 | 6804 | 583 | LYM760 | 80.6 | globlastp |
| tragopogon\|10v1\|SRR020205S0009230 | 1613 | 6806 | 583 | LYM760 | 80.6 | globlastp |
| lettuce\|12v1\|DW049745_P1 | 1614 | 6807 | 583 | LYM760 | 80.6 | globlastp |
| lettuce\|12v1\|DW045042_P1 | 1615 | 6808 | 583 | LYM760 | 80.6 | globlastp |
| cucumber\|09v1\|AA660016_T1 | 1616 | 6809 | 583 | LYM760 | 80.57 | glotblastn |
| cucurbita\|11v1\|SRR091276X120491_T1 | 1617 | 6809 | 583 | LYM760 | 80.57 | glotblastn |
| momordica\|10v1\|SRR071315S0003083_T1 | 1618 | 6809 | 583 | LYM760 | 80.57 | glotblastn |
| coffea\|10v1\|DV666509_P1 | 1619 | 6810 | 583 | LYM760 | 80.5 | globlastp |
| coffea\|10v1\|DV674637_P1 | 1620 | 6811 | 583 | LYM760 | 80.5 | globlastp |
| olea\|11v1\|SRR014463.10512_P1 | 1621 | 6812 | 583 | LYM760 | 80.5 | globlastp |
| flax\|11v1\|EU830075_T1 | 1622 | 6813 | 583 | LYM760 | 80.35 | glotblastn |
| flax\|11v1\|EU830387_T1 | 1623 | 6814 | 583 | LYM760 | 80.35 | glotblastn |
| poplar\|10v1\|AI162014_P1 | 1624 | 6815 | 583 | LYM760 | 80.3 | globlastp |
| amborella\|12v3\|FD427902_T1 | 1625 | 6816 | 583 | LYM760 | 80.23 | glotblastn |
| sunflower\|12v1\|EL431286_T1 | 1626 | 6817 | 583 | LYM760 | 80.23 | glotblastn |
| ambrosia\|11v1\|SRR346935.425356_T1 | 1627 | 6818 | 583 | LYM760 | 80.23 | glotblastn |
| amorphophallus\|11v2\|SRR089351X100299_T1 | 1628 | 6819 | 583 | LYM760 | 80.23 | glotblastn |
| arabidopsis_lyrata\|09v1\|JGIAL002851_T1 | 1629 | 6820 | 583 | LYM760 | 80.23 | glotblastn |
| beech\|11v1\|SRR006293.28167XX1_T1 | 1630 | 6821 | 583 | LYM760 | 80.23 | glotblastn |
| ceratodon\|10v1\|SRR074890S0025602_T1 | 1631 | 6822 | 583 | LYM760 | 80.23 | glotblastn |
| cirsium\|11v1\|SRR349641.191835_T1 | 1632 | 6823 | 583 | LYM760 | 80.23 | glotblastn |
| cleome_gynandra\|10v1\|SRR015532S0005085_T1 | 1633 | 6824 | 583 | LYM760 | 80.23 | glotblastn |
| cleome_gynandra\|10v1\|SRR015532S0005454_T1 | 1634 | 6825 | 583 | LYM760 | 80.23 | glotblastn |
| cleome_spinosa\|10v1\|SRR015531S0002479_T1 | 1635 | 6826 | 583 | LYM760 | 80.23 | glotblastn |
| cleome_spinosa\|10v1\|SRR015531S0003287_T1 | 1636 | 6827 | 583 | LYM760 | 80.23 | glotblastn |
| flax\|11v1\|JG018497_T1 | 1637 | 6828 | 583 | LYM760 | 80.23 | glotblastn |
| gnetum\|10v1\|SRR064399S0002979_T1 | 1638 | 6829 | 583 | LYM760 | 80.23 | glotblastn |
| orobanche\|10v1\|SRR023189S0006942_T1 | 1639 | 6830 | 583 | LYM760 | 80.23 | glotblastn |
| sequoia\|10v1\|SRR065044S0353008 | 1640 | 6831 | 583 | LYM760 | 80.23 | glotblastn |
| spruce\|11v1\|EX346846 | 1641 | 6832 | 583 | LYM760 | 80.23 | glotblastn |
| tea\|10v1\|CV013558 | 1642 | 6833 | 583 | LYM760 | 80.23 | glotblastn |
| zamia\|gb166\|DY035739 | 1643 | 6834 | 583 | LYM760 | 80.23 | glotblastn |
| bupleurum\|11v1\|SRR301254.122823_P1 | 1644 | 6835 | 583 | LYM760 | 80.2 | globlastp |
| amborella\|gb166\|CD482310 | 1645 | 6836 | 583 | LYM760 | 80.2 | globlastp |
| cassava\|09v1\|BM259943_P1 | 1646 | 6837 | 583 | LYM760 | 80.2 | globlastp |
| kiwi\|gb166\|FG412389_P1 | 1647 | 6838 | 583 | LYM760 | 80.2 | globlastp |
| lettuce\|10v1\|DW073199 | 1648 | 6839 | 583 | LYM760 | 80.2 | globlastp |
| triphysaria\|10v1\|EY125462 | 1649 | 6840 | 583 | LYM760 | 80.2 | globlastp |
| parthenium\|10v1\|GW778655_T1 | 1650 | 6841 | 583 | LYM760 | 80.11 | glotblastn |
| b_juncea\|12v1\|E6ANDIZ01BO715_P1 | 1651 | 6842 | 583 | LYM760 | 80.1 | globlastp |
| amsonia\|11v1\|SRR098688X103603_P1 | 1652 | 6843 | 583 | LYM760 | 80.1 | globlastp |
| arabidopsis\|10v1\|AT1G27400_P1 | 1653 | 6844 | 583 | LYM760 | 80.1 | globlastp |
| b_juncea\|10v2\|E6ANDIZ01A6R62 | 1654 | 6845 | 583 | LYM760 | 80.1 | globlastp |
| b_juncea\|12v1\|E6ANDIZ01A6R62_P1 | 1655 | 6846 | 583 | LYM760 | 80.1 | globlastp |
| b_juncea\|10v2\|E6ANDIZ01AKD99 | 1656 | 6847 | 583 | LYM760 | 80.1 | globlastp |
| b_oleracea\|gb161\|DY029388_P1 | 1657 | 6842 | 583 | LYM760 | 80.1 | globlastp |
| b_rapa\|11v1\|CN726169_P1 | 1658 | 6848 | 583 | LYM760 | 80.1 | globlastp |
| canola\|11v1\|DY004122_P1 | 1659 | 6845 | 583 | LYM760 | 80.1 | globlastp |
| canola\|11v1\|EE452534_P1 | 1660 | 6849 | 583 | LYM760 | 80.1 | globlastp |
| chickpea\|11v1\|DY475110_P1 | 1661 | 6850 | 583 | LYM760 | 80.1 | globlastp |
| cotton\|11v1\|DT052081_P1 | 1662 | 6851 | 583 | LYM760 | 80.1 | globlastp |
| cowpea\|12v1\|FC458243_P1 | 1663 | 6852 | 583 | LYM760 | 80.1 | globlastp |
| cowpea\|gb166\|FC458243 | 1664 | 6852 | 583 | LYM760 | 80.1 | globlastp |
| eschscholzia\|11v1\|SRR014116.103967_P1 | 1665 | 6853 | 583 | LYM760 | 80.1 | globlastp |
| primula\|11v1\|SRR098679X100127_P1 | 1666 | 6854 | 583 | LYM760 | 80.1 | globlastp |
| silene\|11v1\|GH294402 | 1667 | 6855 | 583 | LYM760 | 80.1 | globlastp |
| soybean\|11v1\|GLYMA05G27940 | 1668 | 6856 | 583 | LYM760 | 80.1 | globlastp |
| soybean\|11v1\|GLYMA1SG01110 | 1669 | 6857 | 583 | LYM760 | 80.1 | globlastp |
| b_juncea\|12v1\|E6ANDIZ01A0C3E_P1 | 1670 | 6858 | 583 | LYM760 | 80 | globlastp |
| b_juncea\|12v1\|E6ANDIZ01AM4DV_P1 | 1671 | 6858 | 583 | LYM760 | 80 | globlastp |
| b_juncea\|12v1\|E6ANDIZ01ANXW0_P1 | 1672 | 6858 | 583 | LYM760 | 80 | globlastp |
| b_juncea\|12v1\|E6ANDIZ01AWDS5_P1 | 1673 | 6859 | 583 | LYM760 | 80 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
| --- | --- | --- | --- | --- | --- | --- |
| b_juncea|10v2|E6ANDIZ01A0C3E | 1674 | 6860 | 583 | LYM760 | 80 | globlastp |
| b_juncea|10v2|E6ANDIZ01A3DQO | 1675 | 6859 | 583 | LYM760 | 80 | globlastp |
| b_juncea|12v1|E6ANDIZ01A3DQO_P1 | 1676 | 6859 | 583 | LYM760 | 80 | globlastp |
| b_juncea|10v2|E6ANDIZ01A3XY5 | 1677 | 6861 | 583 | LYM760 | 80 | globlastp |
| b_juncea|12v1|E6ANDIZ01A3XY5_P1 | 1678 | 6861 | 583 | LYM760 | 80 | globlastp |
| b_juncea|10v2|E6ANDIZ01A5KPT | 1679 | 6858 | 583 | LYM760 | 80 | globlastp |
| b_juncea|12v1|E6ANDIZ01ATGH3_P1 | 1680 | 6858 | 583 | LYM760 | 80 | globlastp |
| b_juncea|10v2|E6ANDIZ01A5XLM | 1681 | 6858 | 583 | LYM760 | 80 | globlastp |
| b_oleracea|gb161|AM391790_P1 | 1682 | 6861 | 583 | LYM760 | 80 | globlastp |
| b_oleracea|gb161|DY026970_P1 | 1683 | 6858 | 583 | LYM760 | 80 | globlastp |
| b_oleracea|gb161|DY029962_P1 | 1684 | 6859 | 583 | LYM760 | 80 | globlastp |
| b_rapa|11v1|BG543767_P1 | 1685 | 6858 | 583 | LYM760 | 80 | globlastp |
| b_rapa|11v1|CD818250_P1 | 1686 | 6859 | 583 | LYM760 | 80 | globlastp |
| b_rapa|11v1|H07611_P1 | 1687 | 6858 | 583 | LYM760 | 80 | globlastp |
| basilicum|10v1|DY326830_P1 | 1688 | 6862 | 583 | LYM760 | 80 | globlastp |
| canola|11v1|CN726551_P1 | 1689 | 6859 | 583 | LYM760 | 80 | globlastp |
| canola|11v1|CN735186_P1 | 1690 | 6858 | 583 | LYM760 | 80 | globlastp |
| canola|11v1|EE452828_P1 | 1691 | 6859 | 583 | LYM760 | 80 | globlastp |
| canola|11v1|EG020820_P1 | 1692 | 6858 | 583 | LYM760 | 80 | globlastp |
| canola|11v1|H07611_P1 | 1693 | 6858 | 583 | LYM760 | 80 | globlastp |
| canola|11v1|SRR019556.21715_P1 | 1694 | 6859 | 583 | LYM760 | 80 | globlastp |
| centaurea|gb166|EH767316_P1 | 1695 | 6863 | 583 | LYM760 | 80 | globlastp |
| cirsium|11v1|SRR346952.1012081_P1 | 1696 | 6863 | 583 | LYM760 | 80 | globlastp |
| cynara|gb167|GE587076_P1 | 1697 | 6864 | 583 | LYM760 | 80 | globlastp |
| eggplant|10v1|FS013580_P1 | 1698 | 6865 | 583 | LYM760 | 80 | globlastp |
| flaveria|11v1|SRR149229.101440_P1 | 1699 | 6866 | 583 | LYM760 | 80 | globlastp |
| flaveria|11v1|SRR149229.113654_P1 | 1700 | 6866 | 583 | LYM760 | 80 | globlastp |
| flaveria|11v1|SRR149232.102658_P1 | 1701 | 6867 | 583 | LYM760 | 80 | globlastp |
| flaveria|11v1|SRR149232.111287_P1 | 1702 | 6866 | 583 | LYM760 | 80 | globlastp |
| flaveria|11v1|SRR149232.245026_P1 | 1703 | 6866 | 583 | LYM760 | 80 | globlastp |
| flaveria|11v1|SRR149238.144124_P1 | 1704 | 6866 | 583 | LYM760 | 80 | globlastp |
| flaveria|11v1|SRR149241.225905_P1 | 1705 | 6866 | 583 | LYM760 | 80 | globlastp |
| gerbera|09v1|AJ750610_P1 | 1706 | 6868 | 583 | LYM760 | 80 | globlastp |
| lettuce|10v1|DW045042 | 1707 | 6869 | 583 | LYM760 | 80 | globlastp |
| lettuce|10v1|DW049745 | 1708 | 6870 | 583 | LYM760 | 80 | globlastp |
| lettuce|10v1|DW075725 | 1709 | 6871 | 583 | LYM760 | 80 | globlastp |
| nicotiana_benthamiana|gb162|AY310814_P1 | 1710 | 6872 | 583 | LYM760 | 80 | globlastp |
| radish|gb164|EV526201 | 1711 | 6859 | 583 | LYM760 | 80 | globlastp |
| radish|gb164|EV535578 | 1712 | 6858 | 583 | LYM760 | 80 | globlastp |
| radish|gb164|EV535936 | 1713 | 6858 | 583 | LYM760 | 80 | globlastp |
| radish|gb164|EV539372 | 1714 | 6859 | 583 | LYM760 | 80 | globlastp |
| radish|gb164|EV543431 | 1715 | 6859 | 583 | LYM760 | 80 | globlastp |
| radish|gb164|EV569419 | 1716 | 6858 | 583 | LYM760 | 80 | globlastp |
| radish|gb164|EW715038 | 1717 | 6858 | 583 | LYM760 | 80 | globlastp |
| radish|gb164|EX762567 | 1718 | 6858 | 583 | LYM760 | 80 | globlastp |
| radish|gb164|T25178 | 1719 | 6858 | 583 | LYM760 | 80 | globlastp |
| thellungiella_halophilum|11v1|DN773781 | 1720 | 6873 | 583 | LYM760 | 80 | globlastp |
| b_juncea|12v1|E6ANDIZ01A5KPT_P1 | 1721 | 6858 | 583 | LYM760 | 80 | globlastp |
| rye|12v1|DRR001012.103769_P1 | 1722 | 584 | 584 | LYM761 | 100 | globlastp |
| leymus|gb166|EG374599_P1 | 1723 | 584 | 584 | LYM761 | 100 | globlastp |
| pseudoroegneria|gb167|FF341403 | 1724 | 584 | 584 | LYM761 | 100 | globlastp |
| wheat|10v2|BE404105 | 1725 | 584 | 584 | LYM761 | 100 | globlastp |
| wheat|12v3|BF293365_P1 | 1726 | 584 | 584 | LYM761 | 100 | globlastp |
| oat|11v1|GO584904_P1 | 1727 | 6874 | 584 | LYM761 | 99.7 | globlastp |
| brachypodium|12v1|BRADI2G09950_P1 | 1728 | 6875 | 584 | LYM761 | 99 | globlastp |
| brachypodium|09v1|DV470849 | 1729 | 6875 | 584 | LYM761 | 99 | globlastp |
| rice|11v1|BI804875 | 1730 | 6876 | 584 | LYM761 | 98 | globlastp |
| rye|12v1|BE586462_P1 | 1731 | 6877 | 584 | LYM761 | 97.7 | globlastp |
| foxtail_millet|11v3|PHY7SI022760M_P1 | 1732 | 6878 | 584 | LYM761 | 97.7 | globlastp |
| maize|10v1|AI600466_P1 | 1733 | 6879 | 584 | LYM761 | 97.7 | globlastp |
| maize|10v1|AI932141_P1 | 1734 | 6879 | 584 | LYM761 | 97.7 | globlastp |
| millet|10v1|EVO454PM049230_P1 | 1735 | 6878 | 584 | LYM761 | 97.7 | globlastp |
| rice|11v1|BE229872 | 1736 | 6880 | 584 | LYM761 | 97.7 | globlastp |
| sorghum|11v1|SB03G010550 | 1737 | 6879 | 584 | LYM761 | 97.7 | globlastp |
| sorghum|12v1|SB03G010550_P1 | 1738 | 6879 | 584 | LYM761 | 97.7 | globlastp |
| wheat|10v2|CA618629 | 1739 | 6879 | 584 | LYM761 | 97.7 | globlastp |
| cenchrus|gb166|EB662075_P1 | 1740 | 6881 | 584 | LYM761 | 97.4 | globlastp |
| foxtail_millet|11v3|PHY7SI002354M_P1 | 1741 | 6882 | 584 | LYM761 | 97.4 | globlastp |
| millet|10v1|CD725293_P1 | 1742 | 6883 | 584 | LYM761 | 97.4 | globlastp |
| pseudoroegneria|gb167|FF352048 | 1743 | 6884 | 584 | LYM761 | 97.4 | globlastp |
| switchgrass|gb167|FE604142 | 1744 | 6885 | 584 | LYM761 | 97.4 | globlastp |
| brachypodium|12v1|BRADI2G27390_P1 | 1745 | 6886 | 584 | LYM761 | 97.1 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| barley\|10v2\|AW983457 | 1746 | 6887 | 584 | LYM761 | 97.1 | globlastp |
| barley\|12v1\|AW983457_P1 | 1747 | 6887 | 584 | LYM761 | 97.1 | globlastp |
| brachypodium\|09v1\|DV481918 | 1748 | 6886 | 584 | LYM761 | 97.1 | globlastp |
| oat\|11v1\|CN815657_P1 | 1749 | 6888 | 584 | LYM761 | 97.1 | globlastp |
| oat\|11v1\|GO585484_P1 | 1750 | 6888 | 584 | LYM761 | 97.1 | globlastp |
| oil_palm\|11v1\|EL687548XX2_P1 | 1751 | 6889 | 584 | LYM761 | 96.1 | globlastp |
| oil_palm\|11v1\|SRR190698.105189_P1 | 1752 | 6890 | 584 | LYM761 | 95.8 | globlastp |
| phalaenopsis\|11v1\|CB032900_P1 | 1753 | 6891 | 584 | LYM761 | 95.5 | globlastp |
| phalaenopsis\|11v1\|CK859204_P1 | 1754 | 6892 | 584 | LYM761 | 95.5 | globlastp |
| phalaenopsis\|11v1\|SRR125771.1004357_P1 | 1755 | 6892 | 584 | LYM761 | 95.5 | globlastp |
| platanus\|11v1\|SRR096786X104162_P1 | 1756 | 6893 | 584 | LYM761 | 95.5 | globlastp |
| cynodon\|10v1\|ES296906_P1 | 1757 | 6894 | 584 | LYM761 | 95.4 | globlastp |
| aristolochia\|10v1\|FD748603_T1 | 1758 | 6895 | 584 | LYM761 | 95.13 | glotblastn |
| chelidonium\|11v1\|SRR084752X117571_P1 | 1759 | 6896 | 584 | LYM761 | 95.1 | globlastp |
| amborella\|12v3\|FD443451_P1 | 1760 | 6897 | 584 | LYM761 | 94.8 | globlastp |
| avocado\|10v1\|CO997948_P1 | 1761 | 6898 | 584 | LYM761 | 94.8 | globlastp |
| eschscholzia\|11v1\|CD478331_P1 | 1762 | 6899 | 584 | LYM761 | 94.8 | globlastp |
| grape\|11v1\|GSVIVT01009529001_P1 | 1763 | 6900 | 584 | LYM761 | 94.8 | globlastp |
| pineapple\|10v1\|CO730960_P1 | 1764 | 6901 | 584 | LYM761 | 94.8 | globlastp |
| tripterygium\|11v1\|SRR098677X117527 | 1765 | 6902 | 584 | LYM761 | 94.8 | globlastp |
| abies\|11v2\|SRR098676X117154_P1 | 1766 | 6903 | 584 | LYM761 | 94.5 | globlastp |
| cleome_spinosa\|10v1\|GR930993_P1 | 1767 | 6904 | 584 | LYM761 | 94.5 | globlastp |
| eschscholzia\|11v1\|CD477110_P1 | 1768 | 6905 | 584 | LYM761 | 94.5 | globlastp |
| euonymus\|11v1\|SRR070038X117498_P1 | 1769 | 6906 | 584 | LYM761 | 94.5 | globlastp |
| euonymus\|11v1\|SRR070038X117555_P1 | 1770 | 6907 | 584 | LYM761 | 94.5 | globlastp |
| oil_palm\|11v1\|EL687223_P1 | 1771 | 6908 | 584 | LYM761 | 94.5 | globlastp |
| pseudotsuga\|10v1\|SRR065119S0049055 | 1772 | 6909 | 584 | LYM761 | 94.5 | globlastp |
| amborella\|12v3\|CO995671_P1 | 1773 | 6910 | 584 | LYM761 | 94.5 | globlastp |
| amorphophallus\|11v2\|SRR089351X90293_T1 | 1774 | 6911 | 584 | LYM761 | 94.48 | glotblastn |
| amborella\|gb166\|CO995671 | 1775 | 6912 | 584 | LYM761 | 94.2 | globlastp |
| bean\|gb167\|CA898184 | 1776 | 6913 | 584 | LYM761 | 94.2 | globlastp |
| cedrus\|11v1\|SRR065007X105359_P1 | 1777 | 6914 | 584 | LYM761 | 94.2 | globlastp |
| cowpea\|12v1\|FF543235_P1 | 1778 | 6915 | 584 | LYM761 | 94.2 | globlastp |
| cowpea\|gb166\|FF543235 | 1779 | 6915 | 584 | LYM761 | 94.2 | globlastp |
| eucalyptus\|11v2\|CD668395_P1 | 1780 | 6916 | 584 | LYM761 | 94.2 | globlastp |
| eucalyptus\|11v2\|SRR001659X1320_P1 | 1781 | 6917 | 584 | LYM761 | 94.2 | globlastp |
| lotus\|09v1\|BI416350_P1 | 1782 | 6918 | 584 | LYM761 | 94.2 | globlastp |
| maritime_pine\|10v1\|AL750324_P1 | 1783 | 6919 | 584 | LYM761 | 94.2 | globlastp |
| maritime_pine\|10v1\|BX249218_P1 | 1784 | 6920 | 584 | LYM761 | 94.2 | globlastp |
| podocarpus\|10v1\|SRR065014S0015418_P1 | 1785 | 6921 | 584 | LYM761 | 94.2 | globlastp |
| silene\|11v1\|SRR096785X105188 | 1786 | 6922 | 584 | LYM761 | 94.2 | globlastp |
| spruce\|11v1\|ES871484 | 1787 | 6923 | 584 | LYM761 | 94.2 | globlastp |
| spruce\|11v1\|FD746099 | 1788 | 6924 | 584 | LYM761 | 94.2 | globlastp |
| strawberry\|11v1\|EX679318 | 1789 | 6925 | 584 | LYM761 | 94.2 | globlastp |
| trigonella\|11v1\|SRR066194X134943 | 1790 | 6926 | 584 | LYM761 | 94.2 | globlastp |
| valeriana\|11v1\|SRR099039X101649 | 1791 | 6927 | 584 | LYM761 | 94.2 | globlastp |
| bean\|12v1\|CA898184_P1 | 1792 | 6928 | 584 | LYM761 | 93.9 | globlastp |
| beet\|12v1\|BQ583044_P1 | 1793 | 6929 | 584 | LYM761 | 93.9 | globlastp |
| medicago\|12v1\|AW684787_P1 | 1794 | 6930 | 584 | LYM761 | 93.9 | globlastp |
| chickpea\|11v1\|GR397003_P1 | 1795 | 6931 | 584 | LYM761 | 93.9 | globlastp |
| cucumber\|09v1\|DV632703_P1 | 1796 | 6932 | 584 | LYM761 | 93.9 | globlastp |
| cucurbita\|11v1\|SRR091276X102725_P1 | 1797 | 6932 | 584 | LYM761 | 93.9 | globlastp |
| euphorbia\|11v1\|SRR098678X117105_P1 | 1798 | 6933 | 584 | LYM761 | 93.9 | globlastp |
| melon\|10v1\|DV632703_P1 | 1799 | 6932 | 584 | LYM761 | 93.9 | globlastp |
| nasturtium\|11v1\|SRR032558.10039_P1 | 1800 | 6934 | 584 | LYM761 | 93.9 | globlastp |
| pigeonpea\|11v1\|SRR054580X103416_P1 | 1801 | 6935 | 584 | LYM761 | 93.9 | globlastp |
| platanus\|11v1\|AM260494_P1 | 1802 | 6936 | 584 | LYM761 | 93.9 | globlastp |
| poppy\|11v1\|FE967728_P1 | 1803 | 6937 | 584 | LYM761 | 93.9 | globlastp |
| petunia\|gb171\|CV293346_T1 | 1804 | 6938 | 584 | LYM761 | 93.85 | glotblastn |
| banana\|10v1\|FF559953 | 1805 | 6939 | 584 | LYM761 | 93.83 | glotblastn |
| spruce\|11v1\|SRR064180X11339 | 1806 | 6940 | 584 | LYM761 | 93.83 | glotblastn |
| pine\|10v2\|AA556633_P1 | 1807 | 6941 | 584 | LYM761 | 93.8 | globlastp |
| pseudotsuga\|10v1\|SRR065119S0006420 | 1808 | 6942 | 584 | LYM761 | 93.8 | globlastp |
| sciadopitys\|10v1\|SRR065035S0011319 | 1809 | 6943 | 584 | LYM761 | 93.8 | globlastp |
| sciadopitys\|10v1\|SRR065035S0012671 | 1810 | 6944 | 584 | LYM761 | 93.8 | globlastp |
| spruce\|11v1\|ES253402 | 1811 | 6945 | 584 | LYM761 | 93.8 | globlastp |
| banana\|12v1\|FF559953_P1 | 1812 | 6946 | 584 | LYM761 | 93.6 | globlastp |
| banana\|12v1\|FL663121_P1 | 1813 | 6947 | 584 | LYM761 | 93.6 | globlastp |
| cassava\|09v1\|CK644284_P1 | 1814 | 6948 | 584 | LYM761 | 93.6 | globlastp |
| cassava\|09v1\|DV441654_P1 | 1815 | 6948 | 584 | LYM761 | 93.6 | globlastp |
| poplar\|10v1\|AI165910_P1 | 1816 | 6949 | 584 | LYM761 | 93.6 | globlastp |
| spurge\|gb161\|DV133266 | 1817 | 6950 | 584 | LYM761 | 93.6 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| fagopyrum\|11v1\|SRR063689X104468_P1 | 1818 | 6951 | 584 | LYM761 | 93.5 | globlastp |
| fagopyrum\|11v1\|SRR063689X107322_P1 | 1819 | 6952 | 584 | LYM761 | 93.5 | globlastp |
| fagopyrum\|11v1\|SRR063703X103420_P1 | 1820 | 6952 | 584 | LYM761 | 93.5 | globlastp |
| sequoia\|10v1\|SRR065044S0005740 | 1821 | 6953 | 584 | LYM761 | 93.5 | globlastp |
| soybean\|11v1\|GLYMA15G09410 | 1822 | 6954 | 584 | LYM761 | 93.5 | globlastp |
| watermelon\|11v1\|DV632703 | 1823 | 6955 | 584 | LYM761 | 93.5 | globlastp |
| spruce\|11v1\|SRR065813X144751 | 1824 | 6956 | 584 | LYM761 | 93.49 | glotblastn |
| beech\|11v1\|SRR006293.2274_P1 | 1825 | 6957 | 584 | LYM761 | 93.3 | globlastp |
| cacao\|10v1\|CU471773_P1 | 1826 | 6958 | 584 | LYM761 | 93.3 | globlastp |
| castorbean\|11v1\|GE636853_P1 | 1827 | 6959 | 584 | LYM761 | 93.3 | globlastp |
| chestnut\|gb170\|SRR006295S0049579_P1 | 1828 | 6957 | 584 | LYM761 | 93.3 | globlastp |
| eucalyptus\|11v2\|CD668505_P1 | 1829 | 6958 | 584 | LYM761 | 93.3 | globlastp |
| euphorbia\|11v1\|BP959110_P1 | 1830 | 6960 | 584 | LYM761 | 93.3 | globlastp |
| ipomoea_batatas\|10v1\|BU690606_P1 | 1831 | 6961 | 584 | LYM761 | 93.3 | globlastp |
| ipomoea_nil\|10v1\|BJ554440_P1 | 1832 | 6961 | 584 | LYM761 | 93.3 | globlastp |
| kiwi\|gb166\|FG397486_P1 | 1833 | 6962 | 584 | LYM761 | 93.3 | globlastp |
| monkeyflower\|10v1\|GO962777_P1 | 1834 | 6963 | 584 | LYM761 | 93.3 | globlastp |
| oak\|10v1\|FP027306_P1 | 1835 | 6957 | 584 | LYM761 | 93.3 | globlastp |
| poplar\|10v1\|AI164613_P1 | 1836 | 6964 | 584 | LYM761 | 93.3 | globlastp |
| strawberry\|11v1\|EX672717 | 1837 | 6965 | 584 | LYM761 | 93.3 | globlastp |
| tobacco\|gb162\|CV020789 | 1838 | 6966 | 584 | LYM761 | 93.3 | globlastp |
| b_juncea\|12v1\|E6ANDIZ01A494N_P1 | 1839 | 6967 | 584 | LYM761 | 93.2 | globlastp |
| b_juncea\|12v1\|E6ANDIZ01AGZJS_P1 | 1840 | 6967 | 584 | LYM761 | 93.2 | globlastp |
| arabidopsis_lyrata\|09v1\|JGIAL022049_P1 | 1841 | 6968 | 584 | LYM761 | 93.2 | globlastp |
| arabidopsis\|10v1\|AT5G23540_P1 | 1842 | 6967 | 584 | LYM761 | 93.2 | globlastp |
| b_oleracea\|gb161\|AM388952_P1 | 1843 | 6967 | 584 | LYM761 | 93.2 | globlastp |
| b_rapa\|11v1\|CB686301_P1 | 1844 | 6967 | 584 | LYM761 | 93.2 | globlastp |
| b_rapa\|11v1\|CD823354_P1 | 1845 | 6967 | 584 | LYM761 | 93.2 | globlastp |
| basilicum\|10v1\|DY334229_P1 | 1846 | 6969 | 584 | LYM761 | 93.2 | globlastp |
| canola\|11v1\|CN826001_P1 | 1847 | 6967 | 584 | LYM761 | 93.2 | globlastp |
| canola\|11v1\|DQ539632_P1 | 1848 | 6967 | 584 | LYM761 | 93.2 | globlastp |
| canola\|11v1\|DY007504_P1 | 1849 | 6967 | 584 | LYM761 | 93.2 | globlastp |
| canola\|11v1\|EE426872_P1 | 1850 | 6967 | 584 | LYM761 | 93.2 | globlastp |
| canola\|11v1\|SRR341920.119703_P1 | 1851 | 6967 | 584 | LYM761 | 93.2 | globlastp |
| catharanthus\|11v1\|SRR098691X100100_P1 | 1852 | 6970 | 584 | LYM761 | 93.2 | globlastp |
| cephalotaxus\|11v1\|SRR064395X103975_P1 | 1853 | 6971 | 584 | LYM761 | 93.2 | globlastp |
| chelidonium\|11v1\|SRR084752X103974_P1 | 1854 | 6972 | 584 | LYM761 | 93.2 | globlastp |
| eucalyptus\|11v2\|SRR001658X1580_T1 | 1855 | 6973 | 584 | LYM761 | 93.2 | glotblastn |
| flax\|11v1\|JG023044_P1 | 1856 | 6974 | 584 | LYM761 | 93.2 | globlastp |
| peanut\|10v1\|EG373509_P1 | 1857 | 6975 | 584 | LYM761 | 93.2 | globlastp |
| poppy\|11v1\|FE965832_P1 | 1858 | 6976 | 584 | LYM761 | 93.2 | globlastp |
| radish\|gb164\|EV529326 | 1859 | 6967 | 584 | LYM761 | 93.2 | globlastp |
| radish\|gb164\|EV552094 | 1860 | 6967 | 584 | LYM761 | 93.2 | globlastp |
| radish\|gb164\|EY904193 | 1861 | 6967 | 584 | LYM761 | 93.2 | globlastp |
| soybean\|11v1\|GLYMA13G29660 | 1862 | 6977 | 584 | LYM761 | 93.2 | globlastp |
| taxus\|10v1\|SRR032523S0003275 | 1863 | 6971 | 584 | LYM761 | 93.2 | globlastp |
| thellungiella_parvulum\|11v1\|BY810024 | 1864 | 6968 | 584 | LYM761 | 93.2 | globlastp |
| medicago\|12v1\|AL374232_P1 | 1865 | 6978 | 584 | LYM761 | 93 | globlastp |
| aquilegia\|10v2\|DR912285_P1 | 1866 | 6979 | 584 | LYM761 | 92.9 | globlastp |
| blueberry\|12v1\|CF811583_P1 | 1867 | 6980 | 584 | LYM761 | 92.9 | globlastp |
| gossypium_raimondii\|12v1\|AI055710_P1 | 1868 | 6981 | 584 | LYM761 | 92.9 | globlastp |
| sunflower\|12v1\|DY921007_P1 | 1869 | 6982 | 584 | LYM761 | 92.9 | globlastp |
| aquilegia\|10v1\|DR912285 | 1870 | 6979 | 584 | LYM761 | 92.9 | globlastp |
| bean\|gb167\|CA905882 | 1871 | 6983 | 584 | LYM761 | 92.9 | globlastp |
| canola\|11v1\|DY006116_P1 | 1872 | 6984 | 584 | LYM761 | 92.9 | globlastp |
| cotton\|11v1\|AI055710_P1 | 1873 | 6981 | 584 | LYM761 | 92.9 | globlastp |
| flaveria\|11v1\|SRR149232.167012_P1 | 1874 | 6985 | 584 | LYM761 | 92.9 | globlastp |
| kiwi\|gb166\|FG407888_P1 | 1875 | 6986 | 584 | LYM761 | 92.9 | globlastp |
| orobanche\|10v1\|SRR023189S0006640_P1 | 1876 | 6987 | 584 | LYM761 | 92.9 | globlastp |
| peanut\|10v1\|CD037544_P1 | 1877 | 6988 | 584 | LYM761 | 92.9 | globlastp |
| pepper\|12v1\|AA840785_P1 | 1878 | 6989 | 584 | LYM761 | 92.9 | globlastp |
| pepper\|gb171\|AA840785 | 1879 | 6989 | 584 | LYM761 | 92.9 | globlastp |
| phyla\|11v2\|SRR099035X113382_P1 | 1880 | 6990 | 584 | LYM761 | 92.9 | globlastp |
| potato\|10v1\|BF154050_P1 | 1881 | 6991 | 584 | LYM761 | 92.9 | globlastp |
| radish\|gb164\|EV545465 | 1882 | 6992 | 584 | LYM761 | 92.9 | globlastp |
| radish\|gb164\|EV568754 | 1883 | 6992 | 584 | LYM761 | 92.9 | globlastp |
| rhizophora\|10v1\|SRR005792S0005536 | 1884 | 6993 | 584 | LYM761 | 92.9 | globlastp |
| sequoia\|10v1\|SRR065044S0010204 | 1885 | 6994 | 584 | LYM761 | 92.9 | globlastp |
| solanum_phureja\|09v1\|SPHBG130845 | 1886 | 6991 | 584 | LYM761 | 92.9 | globlastp |
| soybean\|11v1\|GLYMA14G08940 | 1887 | 6995 | 584 | LYM761 | 92.9 | globlastp |
| soybean\|11v1\|GLYMA17G36230 | 1888 | 6995 | 584 | LYM761 | 92.9 | globlastp |
| sunflower\|10v1\|DY921007 | 1889 | 6982 | 584 | LYM761 | 92.9 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| thellungiella_halophilum|11v1|BY810024 | 1890 | 6996 | 584 | LYM761 | 92.9 | globlastp |
| thellungiella_halophilum|11v1|EHJGI11006582 | 1891 | 6997 | 584 | LYM761 | 92.9 | globlastp |
| triphysaria|10v1|EY004052 | 1892 | 6998 | 584 | LYM761 | 92.88 | glotblastn |
| phalaenopsis|11v1|CO742280_T1 | 1893 | 6999 | 584 | LYM761 | 92.86 | glotblastn |
| zostera|10v1|AM769404 | 1894 | 7000 | 584 | LYM761 | 92.8 | globlastp |
| trigonella|11v1|SRR066194X116021 | 1895 | 7001 | 584 | LYM761 | 92.7 | globlastp |
| blueberry|12v1|CV190849_P1 | 1896 | 7002 | 584 | LYM761 | 92.6 | globlastp |
| gossypium_raimondii|12v1|AI055112_P1 | 1897 | 7003 | 584 | LYM761 | 92.6 | globlastp |
| ambrosia|11v1|SRR346935.10035_P1 | 1898 | 7004 | 584 | LYM761 | 92.6 | globlastp |
| cirsium|11v1|SRR346952.1012919_P1 | 1899 | 7005 | 584 | LYM761 | 92.6 | globlastp |
| cirsium|11v1|SRR346952.1015021_P1 | 1900 | 7005 | 584 | LYM761 | 92.6 | globlastp |
| cirsium|11v1|SRR346952.103254_P1 | 1901 | 7005 | 584 | LYM761 | 92.6 | globlastp |
| citrus|gb166|BQ623230 | 1902 | 7006 | 584 | LYM761 | 92.6 | globlastp |
| clementine|11v1|BQ623230_P1 | 1903 | 7006 | 584 | LYM761 | 92.6 | globlastp |
| cotton|11v1|AI055012_P1 | 1904 | 7003 | 584 | LYM761 | 92.6 | globlastp |
| cowpea|12v1|FF385269_P1 | 1905 | 7007 | 584 | LYM761 | 92.6 | globlastp |
| cowpea|gb166|FF385269 | 1906 | 7007 | 584 | LYM761 | 92.6 | globlastp |
| cynara|gb167|GE581068_P1 | 1907 | 7008 | 584 | LYM761 | 92.6 | globlastp |
| flaveria|11v1|SRR149229.161654_P1 | 1908 | 7009 | 584 | LYM761 | 92.6 | globlastp |
| flaveria|11v1|SRR149229.337253_P1 | 1909 | 7009 | 584 | LYM761 | 92.6 | globlastp |
| flaveria|11v1|SRR149232.130279_P1 | 1910 | 7009 | 584 | LYM761 | 92.6 | globlastp |
| phyla|11v2|SRR099037X101192_P1 | 1911 | 7010 | 584 | LYM761 | 92.6 | globlastp |
| pigeonpea|11v1|SRR054580X106933_P1 | 1912 | 7011 | 584 | LYM761 | 92.6 | globlastp |
| safflower|gb162|EL397955 | 1913 | 7005 | 584 | LYM761 | 92.6 | globlastp |
| sarracenia|11v1|SRR192669.107980 | 1914 | 7012 | 584 | LYM761 | 92.6 | globlastp |
| tabernaemontana|11v1|SRR098689X164626 | 1915 | 7013 | 584 | LYM761 | 92.6 | globlastp |
| tragopogon|10v1|SRR020205S0011085 | 1916 | 7014 | 584 | LYM761 | 92.6 | globlastp |
| watermelon|11v1|SRR071315.137690 | 1917 | 7015 | 584 | LYM761 | 92.6 | globlastp |
| pine|10v2|AW226125_T1 | 1918 | 7016 | 584 | LYM761 | 92.53 | glotblastn |
| b_rapa|11v1|BQ704397_P1 | 1919 | 7017 | 584 | LYM761 | 92.5 | globlastp |
| canola|11v1|EE552131_P1 | 1920 | 7018 | 584 | LYM761 | 92.5 | globlastp |
| sunflower|12v1|CD858341_P1 | 1921 | 7019 | 584 | LYM761 | 92.3 | globlastp |
| sunflower|12v1|DY916263_P1 | 1922 | 7020 | 584 | LYM761 | 92.3 | globlastp |
| arnica|11v1|SRR099034X127565_P1 | 1923 | 7021 | 584 | LYM761 | 92.3 | globlastp |
| humulus|11v1|EX520534_P1 | 1924 | 7022 | 584 | LYM761 | 92.3 | globlastp |
| monkeyflower|10v1|GR016649_P1 | 1925 | 7023 | 584 | LYM761 | 92.3 | globlastp |
| papaya|gb165|EX248313_P1 | 1926 | 7024 | 584 | LYM761 | 92.3 | globlastp |
| prunus|10v1|CN491532 | 1927 | 7025 | 584 | LYM761 | 92.3 | globlastp |
| sunflower|10v1|CD858341 | 1928 | 7019 | 584 | LYM761 | 92.3 | globlastp |
| sunflower|10v1|DY916263 | 1929 | 7020 | 584 | LYM761 | 92.3 | globlastp |
| vinca|11v1|SRR098690X108171 | 1930 | 7026 | 584 | LYM761 | 92.3 | globlastp |
| rye|gb164|BE586462 | 1931 | 7027 | 584 | LYM761 | 92.21 | glotblastn |
| cephalotaxus|11v1|SRR064395X116374_P1 | 1932 | 7028 | 584 | LYM761 | 92.2 | globlastp |
| tripterygium|11v1|SRR098677X119953 | 1933 | 7029 | 584 | LYM761 | 92.2 | globlastp |
| amsonia|11v1|SRR098688X10262_P1 | 1934 | 7030 | 584 | LYM761 | 92 | globlastp |
| arnica|11v1|SRR099034X106029_P1 | 1935 | 7031 | 584 | LYM761 | 92 | globlastp |
| coffea|10v1|DV666063_P1 | 1936 | 7032 | 584 | LYM761 | 92 | globlastp |
| flaveria|11v1|SRR149229.100835_P1 | 1937 | 7031 | 584 | LYM761 | 92 | globlastp |
| flaveria|11v1|SRR149229.21100_P1 | 1938 | 7031 | 584 | LYM761 | 92 | globlastp |
| guizotia|10v1|GE556160_P1 | 1939 | 7033 | 584 | LYM761 | 92 | globlastp |
| tabernaemontana|11v1|SRR098689X262880 | 1940 | 7034 | 584 | LYM761 | 92 | globlastp |
| tomato|11v1|AA840785 | 1941 | 7035 | 584 | LYM761 | 92 | globlastp |
| amorphophallus|11v2|SRR089351X346471_P1 | 1942 | 7036 | 584 | LYM761 | 91.9 | globlastp |
| nasturtium|11v1|GH164043_P1 | 1943 | 7037 | 584 | LYM761 | 91.9 | globlastp |
| curcuma|10v1|DY390662_T1 | 1944 | 7038 | 584 | LYM761 | 91.88 | glotblastn |
| fraxinus|11v1|SRR058827.10475_P1 | 1945 | 7039 | 584 | LYM761 | 91.7 | globlastp |
| lettuce|10v1|DW063841 | 1946 | 7040 | 584 | LYM761 | 91.7 | globlastp |
| phyla|11v2|SRR099035X104697_P1 | 1947 | 7041 | 584 | LYM761 | 91.7 | globlastp |
| vinca|11v1|SRR098690X119398 | 1948 | 7042 | 584 | LYM761 | 91.7 | globlastp |
| lettuce|12v1|DW063841_P1 | 1949 | 7040 | 584 | LYM761 | 91.7 | globlastp |
| primula|11v1|SRR098679X127035_P1 | 1950 | 7043 | 584 | LYM761 | 91.6 | globlastp |
| silene|11v1|SRR096785X10979 | 1951 | 7044 | 584 | LYM761 | 91.6 | globlastp |
| catharanthus|11v1|EG556453_P1 | 1952 | 7045 | 584 | LYM761 | 91.3 | globlastp |
| cichorium|gb1v1|EH675761_P1 | 1953 | 7046 | 584 | LYM761 | 91.3 | globlastp |
| physcomitrella|10v1|BJ188502_P1 | 1954 | 7047 | 584 | LYM761 | 91.3 | globlastp |
| utricularia|11v1|SRR094438.10563 | 1955 | 7048 | 584 | LYM761 | 91.3 | globlastp |
| ceratodon|10v1|AW098409_P1 | 1956 | 7049 | 584 | LYM761 | 90.9 | globlastp |
| ceratodon|10v1|SRR074890S0067556_P1 | 1957 | 7050 | 584 | LYM761 | 90.9 | globlastp |
| cotton|11v1|SRR032367.167348_T1 | 1958 | 7051 | 584 | LYM761 | 90.61 | glotblastn |
| physcomitrella|10v1|BQ826859_P1 | 1959 | 7052 | 584 | LYM761 | 90.6 | globlastp |
| poppy|11v1|SRR030263.9846_P1 | 1960 | 7053 | 584 | LYM761 | 90.6 | globlastp |
| marchantia|gb166|BJ841413_T1 | 1961 | 7054 | 584 | LYM761 | 90.38 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| artemisia\|10v1\|EY036621_T1 | 1962 | 7055 | 584 | LYM761 | 90.29 | glotblastn |
| triphysaria\|10v1\|BM357604 | 1963 | 7056 | 584 | LYM761 | 89.4 | globlastp |
| centaurea\|gb166\|EL931738_T1 | 1964 | 7057 | 584 | LYM761 | 89.32 | glotblastn |
| taxus\|10v1\|SRR032523S0026438 | 1965 | 7058 | 584 | LYM761 | 89.3 | globlastp |
| cleome_gynandra\|10v1\|SRR015532S0000592_P1 | 1966 | 7059 | 584 | LYM761 | 88.9 | globlastp |
| conyza\|10v1\|SRR035294S0024378_P1 | 1967 | 7060 | 584 | LYM761 | 88.6 | globlastp |
| distylium\|11v1\|SRR065077X102328_T1 | 1968 | 7061 | 584 | LYM761 | 88.27 | glotblastn |
| rye\|12v1\|DRR001012.143222_T1 | 1969 | 7062 | 584 | LYM761 | 88.2 | glotblastn |
| arnica\|11v1\|SRR099034X116188_P1 | 1970 | 7063 | 584 | LYM761 | 87.8 | globlastp |
| spikemoss\|gb165\|DN838164 | 1971 | 7064 | 584 | LYM761 | 87.8 | globlastp |
| lettuce\|10v1\|DW076279 | 1972 | 7065 | 584 | LYM761 | 87.5 | globlastp |
| pteridium\|11v1\|SRR043594X125636 | 1973 | 7066 | 584 | LYM761 | 86.4 | globlastp |
| ambrosia\|11v1\|SRR346935.337550_P1 | 1974 | 7067 | 584 | LYM761 | 85.1 | globlastp |
| ambrosia\|11v1\|SRR346943.148751_P1 | 1975 | 7068 | 584 | LYM761 | 84.6 | globlastp |
| salvia\|10v1\|AB492067 | 1976 | 7069 | 584 | LYM761 | 84.6 | globlastp |
| switchgrass\|gb167\|FE619507 | 1977 | 7070 | 584 | LYM761 | 84.04 | glotblastn |
| ambrosia\|11v1\|SRR346935.200575_T1 | 1978 | 7071 | 584 | LYM761 | 83.82 | glotblastn |
| ambrosia\|11v1\|SRR346935.450696_T1 | 1979 | 7071 | 584 | LYM761 | 83.5 | glotblastn |
| physcomitrella\|10v1\|BY960459_T1 | 1980 | 7072 | 584 | LYM761 | 83.23 | glotblastn |
| cenchrus\|gb166\|EB652429_P1 | 1981 | 7073 | 584 | LYM761 | 83.1 | globlastp |
| platanus\|11v1\|SRR096786X115097_T1 | 1982 | 7074 | 584 | LYM761 | 82.74 | glotblastn |
| thalictrum\|11v1\|SRR096787X106268_T1 | 1983 | 7075 | 584 | LYM761 | 82.08 | glotblastn |
| cleome_gynandra\|10v1\|SRR015532S0014075_P1 | 1984 | 7076 | 584 | LYM761 | 80.8 | globlastp |
| cucurbita\|11v1\|SRR091276X111443_P1 | 1985 | 7077 | 584 | LYM761 | 80.5 | globlastp |
| momordica\|10v1\|SRR071315S0000916_T1 | 1986 | 7078 | 584 | LYM761 | 80.46 | glotblastn |
| ginger\|gb164\|DY347768_P1 | 1987 | 7079 | 584 | LYM761 | 80.2 | globlastp |
| pseudoroegneria\|gb167\|FF350021 | 1988 | 7080 | 585 | LYM762 | 94.5 | globlastp |
| rye\|12v1\|DRR001012.24090_P1 | 1989 | 7081 | 585 | LYM762 | 93.4 | globlastp |
| rye\|12v1\|DRR001012.430988_P1 | 1990 | 7081 | 585 | LYM762 | 93.4 | globlastp |
| wheat\|12v3\|CA687565_P1 | 1991 | 7082 | 585 | LYM762 | 90.1 | globlastp |
| wheat\|10v2\|BF199804 | 1992 | 7082 | 585 | LYM762 | 90.1 | globlastp |
| oat\|11v1\|GR320143_P1 | 1993 | 7083 | 585 | LYM762 | 83.7 | globlastp |
| brachypodium\|12v1\|BRADHG21095_P1 | 1994 | 7084 | 585 | LYM762 | 80.2 | globlastp |
| brachypodium\|09v1\|GT767202 | 1995 | 7084 | 585 | LYM762 | 80.2 | globlastp |
| wheat\|12v3\|BE591664_T1 | 1996 | 7085 | 586 | LYM763 | 97.23 | glotblastn |
| wheat\|10v2\|BE591664 | 1997 | 7086 | 586 | LYM763 | 97.2 | globlastp |
| pseudoroegneria\|gb167\|FF348325 | 1998 | 7087 | 586 | LYM763 | 96.5 | globlastp |
| wheat\|10v2\|BE429517 | 1999 | 7088 | 586 | LYM763 | 95.8 | globlastp |
| wheat\|10v2\|BG909040 | 2000 | 7089 | 586 | LYM763 | 93.4 | globlastp |
| wheat\|12v3\|BG262636_P1 | 2001 | 7090 | 586 | LYM763 | 90.7 | globlastp |
| oat\|11v1\|GR318023XX1_P1 | 2002 | 7091 | 586 | LYM763 | 88.7 | globlastp |
| brachypodium\|12v1\|BRADI2G25910_P1 | 2003 | 7092 | 586 | LYM763 | 87.4 | globlastp |
| brachypodium\|09v1\|DV480288 | 2004 | 7092 | 586 | LYM763 | 87.4 | globlastp |
| cynodon\|10v1\|ES297690_P1 | 2005 | 7093 | 586 | LYM763 | 82.9 | globlastp |
| leymus\|gb166\|EG375288_P1 | 2006 | 7094 | 586 | LYM763 | 82 | globlastp |
| rice\|11v1\|AU174166 | 2007 | 7095 | 586 | LYM763 | 81.9 | globlastp |
| foxtail_millet\|11v3\|PHY7SI022866M_P1 | 2008 | 7096 | 586 | LYM763 | 81.6 | globlastp |
| maize\|10v1\|W49428_P1 | 2009 | 7097 | 586 | LYM763 | 80.8 | globlastp |
| sorghum\|11v1\|SB09G019720 | 2010 | 7098 | 586 | LYM763 | 80.6 | globlastp |
| sorghum\|12v1\|SB09G019720_P1 | 2011 | 7098 | 586 | LYM763 | 80.6 | globlastp |
| rye\|12v1\|DRR001012.179794_P1 | 2012 | 587 | 587 | LYM764 | 100 | globlastp |
| wheat\|10v2\|BE399470 | 2013 | 587 | 587 | LYM764 | 100 | globlastp |
| wheat\|12v3\|BE399470_T1 | 2014 | 7099 | 587 | LYM764 | 100 | glotblastn |
| wheat\|12v3\|BQ166333_P1 | 2015 | 7100 | 587 | LYM764 | 99.1 | globlastp |
| brachypodium\|12v1\|BRADI3G47250_P1 | 2016 | 7101 | 587 | LYM764 | 98.2 | globlastp |
| brachypodium\|09v1\|DV469929 | 2017 | 7101 | 587 | LYM764 | 98.2 | globlastp |
| fescue\|gb161\|DT686986_P1 | 2018 | 7102 | 587 | LYM764 | 98.2 | globlastp |
| oat\|11v1\|GO586016_P1 | 2019 | 7102 | 587 | LYM764 | 98.2 | globlastp |
| oat\|11v1\|GO587359_P1 | 2020 | 7102 | 587 | LYM764 | 98.2 | globlastp |
| switchgrass\|gb167\|FE619663 | 2021 | 7103 | 587 | LYM764 | 97.4 | globlastp |
| blueberry\|12v1\|SRR353282X13294D1_P1 | 2022 | 7104 | 587 | LYM764 | 96.5 | globlastp |
| blueberry\|12v1\|SRR353282X25661D1_P1 | 2023 | 7104 | 587 | LYM764 | 96.5 | globlastp |
| gossypium_raimondii\|12v1\|DW493749_P1 | 2024 | 7104 | 587 | LYM764 | 96.5 | globlastp |
| sunflower\|12v1\|CD849268_P1 | 2025 | 7105 | 587 | LYM764 | 96.5 | globlastp |
| sunflower\|12v1\|EL513076_P1 | 2026 | 7105 | 587 | LYM764 | 96.5 | globlastp |
| artemisia\|10v1\|EY045717_P1 | 2027 | 7105 | 587 | LYM764 | 96.5 | globlastp |
| artemisia\|10v1\|SRR019254S0025055_P1 | 2028 | 7105 | 587 | LYM764 | 96.5 | globlastp |
| cotton\|11v1\|DT048574_P1 | 2029 | 7104 | 587 | LYM764 | 96.5 | globlastp |
| cynodon\|10v1\|ES292192_P1 | 2030 | 7106 | 587 | LYM764 | 96.5 | globlastp |
| grape\|11v1\|GSVIVT01011117001_P1 | 2031 | 7107 | 587 | LYM764 | 96.5 | globlastp |
| kiwi\|gb166\|FG404409_P1 | 2032 | 7104 | 587 | LYM764 | 96.5 | globlastp |
| liquorice\|gb171\|FS253308_P1 | 2033 | 7108 | 587 | LYM764 | 96.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| maize\|10v1\|AI746243_P1 | 2034 | 7109 | 587 | LYM764 | 96.5 | globlastp |
| parthenium\|10v1\|GW777095_P1 | 2035 | 7105 | 587 | LYM764 | 96.5 | globlastp |
| peanut\|10v1\|ES722052_P1 | 2036 | 7108 | 587 | LYM764 | 96.5 | globlastp |
| sorghum\|11v1\|SB04G024330 | 2037 | 7109 | 587 | LYM764 | 96.5 | globlastp |
| sorghum\|12v1\|SB04G024330_P1 | 2038 | 7109 | 587 | LYM764 | 96.5 | globlastp |
| sugarcane\|10v1\|BQ533314 | 2039 | 7109 | 587 | LYM764 | 96.5 | globlastp |
| sunflower\|10v1\|CD849268 | 2040 | 7105 | 587 | LYM764 | 96.5 | globlastp |
| switchgrass\|gb167\|FE611111 | 2041 | 7109 | 587 | LYM764 | 96.5 | globlastp |
| ambrosia\|11v1\|SRR346935.607061_T1 | 2042 | 7110 | 587 | LYM764 | 95.61 | glotblastn |
| cirsium\|11v1\|SRR349641.1022743_T1 | 2043 | 7111 | 587 | LYM764 | 95.61 | glotblastn |
| banana\|12v1\|FF561510_P1 | 2044 | 7112 | 587 | LYM764 | 95.6 | globlastp |
| gossypium_raimondii\|12v1\|BE055331_P1 | 2045 | 7113 | 587 | LYM764 | 95.6 | globlastp |
| gossypium_raimondii\|12v1\|BQ401615_P1 | 2046 | 7114 | 587 | LYM764 | 95.6 | globlastp |
| medicago\|12v1\|AW692290_P1 | 2047 | 7115 | 587 | LYM764 | 95.6 | globlastp |
| acacia\|10v1\|FS588612_P1 | 2048 | 7116 | 587 | LYM764 | 95.6 | globlastp |
| amorphophallus\|11v2\|SRR089351X112366_P1 | 2049 | 7117 | 587 | LYM764 | 95.6 | globlastp |
| beech\|11v1\|SRR006293.13057_P1 | 2050 | 7118 | 587 | LYM764 | 95.6 | globlastp |
| castorbean\|11v1\|T15097_P1 | 2051 | 7119 | 587 | LYM764 | 95.6 | globlastp |
| chickpea\|11v1\|EL585393_P1 | 2052 | 7115 | 587 | LYM764 | 95.6 | globlastp |
| chickpea\|11v1\|SRR133517.118208_P1 | 2053 | 7115 | 587 | LYM764 | 95.6 | globlastp |
| cichorium\|gb171\|DT212586_P1 | 2054 | 7120 | 587 | LYM764 | 95.6 | globlastp |
| cotton\|11v1\|BE055331XX1_P1 | 2055 | 7113 | 587 | LYM764 | 95.6 | globlastp |
| cotton\|11v1\|ES810238XX1_P1 | 2056 | 7114 | 587 | LYM764 | 95.6 | globlastp |
| cynodon\|10v1\|ES299099_P1 | 2057 | 7121 | 587 | LYM764 | 95.6 | globlastp |
| euphorbia\|11v1\|BG317346_P1 | 2058 | 7122 | 587 | LYM764 | 95.6 | globlastp |
| euphorbia\|11v1\|BP962434_P1 | 2059 | 7119 | 587 | LYM764 | 95.6 | globlastp |
| euphorbia\|11v1\|SRR098678X397717_P1 | 2060 | 7123 | 587 | LYM764 | 95.6 | globlastp |
| hornbeam\|12v1\|SRR364455.107456_P1 | 2061 | 7124 | 587 | LYM764 | 95.6 | globlastp |
| jatropha\|09v1\|GO246693_P1 | 2062 | 7125 | 587 | LYM764 | 95.6 | globlastp |
| kiwi\|gb166\|FG480739_P1 | 2063 | 7126 | 587 | LYM764 | 95.6 | globlastp |
| liquorice\|gb171\|FS242306_P1 | 2064 | 7127 | 587 | LYM764 | 95.6 | globlastp |
| liriodendron\|gb166\|CK754735_P1 | 2065 | 7118 | 587 | LYM764 | 95.6 | globlastp |
| millet\|10v1\|EVO454PM007415_P1 | 2066 | 7128 | 587 | LYM764 | 95.6 | globlastp |
| nuphar\|gb166\|CO999379_P1 | 2067 | 7125 | 587 | LYM764 | 95.6 | globlastp |
| oil_palm\|11v1\|EL682739_P1 | 2068 | 7118 | 587 | LYM764 | 95.6 | globlastp |
| oil_palm\|11v1\|EL683315_P1 | 2069 | 7119 | 587 | LYM764 | 95.6 | globlastp |
| oil_palm\|11v1\|EY404435_P1 | 2070 | 7119 | 587 | LYM764 | 95.6 | globlastp |
| orobanche\|10v1\|SRR023189S0017589_P1 | 2071 | 7129 | 587 | LYM764 | 95.6 | globlastp |
| orobanche\|10v1\|SRR023189S0121969_P1 | 2072 | 7129 | 587 | LYM764 | 95.6 | globlastp |
| peanut\|10v1\|CD037555_P1 | 2073 | 7130 | 587 | LYM764 | 95.6 | globlastp |
| platanus\|11v1\|SRR096786X132370_P1 | 2074 | 7118 | 587 | LYM764 | 95.6 | globlastp |
| rice\|11v1\|AU069639 | 2075 | 7131 | 587 | LYM764 | 95.6 | globlastp |
| rice\|11v1\|BE039972 | 2076 | 7132 | 587 | LYM764 | 95.6 | globlastp |
| spurge\|gb161\|BG317346 | 2077 | 7122 | 587 | LYM764 | 95.6 | globlastp |
| trigonella\|11v1\|SRR066194X103956 | 2078 | 7115 | 587 | LYM764 | 95.6 | globlastp |
| amborella\|12v3\|FD435373_P1 | 2079 | 7118 | 587 | LYM764 | 95.6 | globlastp |
| medicago\|12v1\|AL371834_P1 | 2080 | 7133 | 587 | LYM764 | 94.8 | globlastp |
| foxtail_millet\|11v3\|PHY7SI011381M_P1 | 2081 | 7134 | 587 | LYM764 | 94.8 | globlastp |
| maize\|10v1\|BI361076_P1 | 2082 | 7134 | 587 | LYM764 | 94.8 | globlastp |
| papaya\|gb165\|EX281054_P1 | 2083 | 7135 | 587 | LYM764 | 94.8 | globlastp |
| sugarcane\|10v1\|AA842755 | 2084 | 7134 | 587 | LYM764 | 94.8 | globlastp |
| switchgrass\|gb167\|FE610595 | 2085 | 7134 | 587 | LYM764 | 94.8 | globlastp |
| switchgrass\|gb167\|FL834490 | 2086 | 7134 | 587 | LYM764 | 94.8 | globlastp |
| trigonella\|11v1\|SRR066194X165338 | 2087 | 7133 | 587 | LYM764 | 94.8 | globlastp |
| pteridium\|11v1\|SRR043594X631958 | 2088 | — | 587 | LYM764 | 94.74 | glotblastn |
| banana\|12v1\|ES432205_P1 | 2089 | 7136 | 587 | LYM764 | 94.7 | globlastp |
| bean\|12v1\|CA914226_P1 | 2090 | 7137 | 587 | LYM764 | 94.7 | globlastp |
| gossypium_raimondii\|12v1\|DR462801_P1 | 2091 | 7138 | 587 | LYM764 | 94.7 | globlastp |
| lettuce\|12v1\|DW074311_P1 | 2092 | 7139 | 587 | LYM764 | 94.7 | globlastp |
| rye\|12v1\|DRR001012.145427_P1 | 2093 | 7140 | 587 | LYM764 | 94.7 | globlastp |
| amsonia\|11v1\|SRR098688X102070_P1 | 2094 | 7141 | 587 | LYM764 | 94.7 | globlastp |
| aristolochia\|10v1\|SRR039082S0234026_P1 | 2095 | 7142 | 587 | LYM764 | 94.7 | globlastp |
| banana\|10v1\|ES432205 | 2096 | 7136 | 587 | LYM764 | 94.7 | globlastp |
| banana\|10v1\|FF561510 | 2097 | 7143 | 587 | LYM764 | 94.7 | globlastp |
| barley\|10v2\|AJ473720 | 2098 | 7140 | 587 | LYM764 | 94.7 | globlastp |
| barley\|12v1\|AJ473720_P1 | 2099 | 7140 | 587 | LYM764 | 94.7 | globlastp |
| bean\|gb167\|CA914226 | 2100 | 7137 | 587 | LYM764 | 94.7 | globlastp |
| cacao\|10v1\|CU470280_P1 | 2101 | 7138 | 587 | LYM764 | 94.7 | globlastp |
| citrus\|gb166\|BQ624385 | 2102 | 7144 | 587 | LYM764 | 94.7 | globlastp |
| clementine\|11v1\|BQ624385_P1 | 2103 | 7144 | 587 | LYM764 | 94.7 | globlastp |
| cotton\|11v1\|DW509872_P1 | 2104 | 7138 | 587 | LYM764 | 94.7 | globlastp |
| cowpea\|12v1\|FC461909_P1 | 2105 | 7145 | 587 | LYM764 | 94.7 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| cowpea\|gb166\|FC461909 | 2106 | 7145 | 587 | LYM764 | 94.7 | globlastp |
| cowpea\|12v1\|FF382105_P1 | 2107 | 7137 | 587 | LYM764 | 94.7 | globlastp |
| cowpea\|gb166\|FF382105 | 2108 | 7137 | 587 | LYM764 | 94.7 | globlastp |
| dandelion\|10v1\|GO666900_P1 | 2109 | 7139 | 587 | LYM764 | 94.7 | globlastp |
| eucalyptus\|11v2\|CD669513_P1 | 2110 | 7146 | 587 | LYM764 | 94.7 | globlastp |
| euonymus\|11v1\|SRR070038X100472_P1 | 2111 | 7147 | 587 | LYM764 | 94.7 | globlastp |
| flaveria\|11v1\|SRR149232.208531_P1 | 2112 | 7148 | 587 | LYM764 | 94.7 | globlastp |
| humulus\|11v1\|EX515668_P1 | 2113 | 7149 | 587 | LYM764 | 94.7 | globlastp |
| lettuce\|10v1\|DW053607 | 2114 | 7139 | 587 | LYM764 | 94.7 | globlastp |
| lettuce\|10v1\|DW074311 | 2115 | 7139 | 587 | LYM764 | 94.7 | globlastp |
| nasturtium\|11v1\|SRR032558.104924_P1 | 2116 | 7150 | 587 | LYM764 | 94.7 | globlastp |
| nicotiana_benthamiana\|gb162\|CN744828_P1 | 2117 | 7151 | 587 | LYM764 | 94.7 | globlastp |
| nuphar\|gb166\|FD387037_P1 | 2118 | 7152 | 587 | LYM764 | 94.7 | globlastp |
| oat\|11v1\|GR365645_P1 | 2119 | 7153 | 587 | LYM764 | 94.7 | globlastp |
| orange\|11v1\|BQ624385_P1 | 2120 | 7144 | 587 | LYM764 | 94.7 | globlastp |
| papaya\|gb165\|EX285322_P1 | 2121 | 7154 | 587 | LYM764 | 94.7 | globlastp |
| phyla\|11v2\|SRR099036X22322_P1 | 2122 | 7155 | 587 | LYM764 | 94.7 | globlastp |
| pine\|10v2\|CD028501_P1 | 2123 | 7156 | 587 | LYM764 | 94.7 | globlastp |
| plantago\|11v2\|SRR066373X101945XX2_P1 | 2124 | 7157 | 587 | LYM764 | 94.7 | globlastp |
| platanus\|11v1\|SRR096786X156053_P1 | 2125 | 7158 | 587 | LYM764 | 94.7 | globlastp |
| potato\|10v1\|BE923796_P1 | 2126 | 7159 | 587 | LYM764 | 94.7 | globlastp |
| prunus\|10v1\|CN489773 | 2127 | 7160 | 587 | LYM764 | 94.7 | globlastp |
| pseudotsuga\|10v1\|SRR065119S0042187 | 2128 | 7156 | 587 | LYM764 | 94.7 | globlastp |
| rhizophora\|10v1\|SRR005793S0012112 | 2129 | 7136 | 587 | LYM764 | 94.7 | globlastp |
| solanum_phureja\|09v1\|SPHBG123880 | 2130 | 7159 | 587 | LYM764 | 94.7 | globlastp |
| tobacco\|gb162\|DW002765 | 2131 | 7151 | 587 | LYM764 | 94.7 | globlastp |
| tomato\|11v1\|AI779704 | 2132 | 7159 | 587 | LYM764 | 94.7 | globlastp |
| tomato\|11v1\|BG123880 | 2133 | 7159 | 587 | LYM764 | 94.7 | globlastp |
| tripterygium\|11v1\|SRR098677X108554 | 2134 | 7147 | 587 | LYM764 | 94.7 | globlastp |
| wheat\|10v2\|BE471292 | 2135 | 7140 | 587 | LYM764 | 94.7 | globlastp |
| wheat\|12v3\|BE471292_P1 | 2136 | 7140 | 587 | LYM764 | 94.7 | globlastp |
| lotus\|09v1\|LLBW608753_P1 | 2137 | 7161 | 587 | LYM764 | 94 | globlastp |
| maize\|10v1\|T12708_P1 | 2138 | 7162 | 587 | LYM764 | 94 | globlastp |
| phalaenopsis\|11v1\|CK857119_T1 | 2139 | 7163 | 587 | LYM764 | 93.91 | glotblastn |
| brachypodium\|12v1\|BRADI5G13020_P1 | 2140 | 7164 | 587 | LYM764 | 93.9 | globlastp |
| cannabis\|12v1\|SOLX00027144_P1 | 2141 | 7165 | 587 | LYM764 | 93.9 | globlastp |
| onion\|12v1\|SRR073446X104277D1_P1 | 2142 | 7166 | 587 | LYM764 | 93.9 | globlastp |
| avocado\|10v1\|CO995363_P1 | 2143 | 7167 | 587 | LYM764 | 93.9 | globlastp |
| bean\|gb167\|CA914227 | 2144 | 7168 | 587 | LYM764 | 93.9 | globlastp |
| brachypodium\|09v1\|DV486390 | 2145 | 7164 | 587 | LYM764 | 93.9 | globlastp |
| cassava\|09v1\|DR087344_P1 | 2146 | 7169 | 587 | LYM764 | 93.9 | globlastp |
| chestnut\|gb170\|SRR006295S0000937_P1 | 2147 | 7170 | 587 | LYM764 | 93.9 | globlastp |
| cotton\|11v1\|DR462801_P1 | 2148 | 7171 | 587 | LYM764 | 93.9 | globlastp |
| cucumber\|09v1\|CK086091_P1 | 2149 | 7172 | 587 | LYM764 | 93.9 | globlastp |
| eggplant\|10v1\|FS004946_P1 | 2150 | 7173 | 587 | LYM764 | 93.9 | globlastp |
| eggplant\|10v1\|FS023091_P1 | 2151 | 7174 | 587 | LYM764 | 93.9 | globlastp |
| fraxinus\|11v1\|SRR058827.155858_P1 | 2152 | 7175 | 587 | LYM764 | 93.9 | globlastp |
| ginger\|gb164IDY357726_P1 | 2153 | 7176 | 587 | LYM764 | 93.9 | globlastp |
| grape\|11v1\|GSVIVT01014776001_P1 | 2154 | 7177 | 587 | LYM764 | 93.9 | globlastp |
| melon\|10v1\|AM717065_P1 | 2155 | 7172 | 587 | LYM764 | 93.9 | globlastp |
| nicotiana_benthamiana\|gb1621AY310779_P1 | 2156 | 7178 | 587 | LYM764 | 93.9 | globlastp |
| oak\|10v1\|FP044020_P1 | 2157 | 7170 | 587 | LYM764 | 93.9 | globlastp |
| petunia\|gb1v1\|FN004442_P1 | 2158 | 7179 | 587 | LYM764 | 93.9 | globlastp |
| petunia\|gb1v1\|FN006031_P1 | 2159 | 7180 | 587 | LYM764 | 93.9 | globlastp |
| phalaenopsis\|11v1\|SRR125771.1006291_P1 | 2160 | 7181 | 587 | LYM764 | 93.9 | globlastp |
| pigeonpea\|11v1\|SRR054580X234449_P1 | 2161 | 7182 | 587 | LYM764 | 93.9 | globlastp |
| pseudoroegneria\|gb167\|FF361298 | 2162 | 7183 | 587 | LYM764 | 93.9 | globlastp |
| rye\|gb164\|BE494768 | 2163 | 7184 | 587 | LYM764 | 93.9 | globlastp |
| sarracenia\|11v1\|SRR192669.111480 | 2164 | 7185 | 587 | LYM764 | 93.9 | globlastp |
| sorghum\|11v1\|SB06G019630 | 2165 | 7186 | 587 | LYM764 | 93.9 | globlastp |
| soybean\|11v1\|GLYMA03G30880 | 2166 | 7187 | 587 | LYM764 | 93.9 | globlastp |
| soybean\|11v1\|GLYMA19G33700 | 2167 | 7187 | 587 | LYM764 | 93.9 | globlastp |
| spruce\|11v1\|ES665200 | 2168 | 7188 | 587 | LYM764 | 93.9 | globlastp |
| spruce\|11v1\|SRR065813X158155 | 2169 | 7188 | 587 | LYM764 | 93.9 | globlastp |
| triphysaria\|10v1\|BM356865 | 2170 | 7189 | 587 | LYM764 | 93.9 | globlastp |
| triphysaria\|10v1\|SRR023500S0040912 | 2171 | 7190 | 587 | LYM764 | 93.9 | globlastp |
| tripterygium\|11v1\|SRR098677X103403 | 2172 | 7191 | 587 | LYM764 | 93.9 | globlastp |
| watermelon\|11v1\|AM717065 | 2173 | 7172 | 587 | LYM764 | 93.9 | globlastp |
| cucurbita\|11v1\|SRR091276X101470_T1 | 2174 | 7192 | 587 | LYM764 | 93.86 | glotblastn |
| euonymus\|11v1\|SRR070038X383323_T1 | 2175 | 7193 | 587 | LYM764 | 93.86 | glotblastn |
| flaveria\|11v1\|SRR149240.384760_T1 | 2176 | — | 587 | LYM764 | 93.86 | glotblastn |
| maritime_pine\|10v1\|SRR073317S0192376_T1 | 2177 | — | 587 | LYM764 | 93.86 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| pigeonpea\|11v1\|SRR054580X129511_P1 | 2178 | 7194 | 587 | LYM764 | 93.1 | globlastp |
| pigeonpea\|11v1\|SRR054580X785703_P1 | 2179 | 7194 | 587 | LYM764 | 93.1 | globlastp |
| gossypium_raimondii\|12v1\|CA992814_P1 | 2180 | 7195 | 587 | LYM764 | 93 | globlastp |
| amborella\|gb166\|FD435373 | 2181 | 7196 | 587 | LYM764 | 93 | globlastp |
| avocado\|10v1\|CK767481_P1 | 2182 | 7197 | 587 | LYM764 | 93 | globlastp |
| catharanthus\|11v1\|SRR098691X157358_P1 | 2183 | 7198 | 587 | LYM764 | 93 | globlastp |
| cotton\|11v1\|DW496131_P1 | 2184 | 7195 | 587 | LYM764 | 93 | globlastp |
| euonymus\|11v1\|SRR070038X105895_P1 | 2185 | 7199 | 587 | LYM764 | 93 | globlastp |
| hevea\|10v1\|EC601673_P1 | 2186 | 7200 | 587 | LYM764 | 93 | globlastp |
| ipomoea_nil\|10v1\|BJ553298_P1 | 2187 | 7201 | 587 | LYM764 | 93 | globlastp |
| pepper\|12v1\|CA515673_P1 | 2188 | 7202 | 587 | LYM764 | 93 | globlastp |
| pepper\|gb171\|CA515673 | 2189 | 7202 | 587 | LYM764 | 93 | globlastp |
| poplar\|10v1\|AI164109_P1 | 2190 | 7203 | 587 | LYM764 | 93 | globlastp |
| primula\|11v1\|SRR098679X187855_P1 | 2191 | 7204 | 587 | LYM764 | 93 | globlastp |
| primula\|11v1\|SRR098679X201948_P1 | 2192 | 7205 | 587 | LYM764 | 93 | globlastp |
| soybean\|11v1\|GLYMA18G52210 | 2193 | 7206 | 587 | LYM764 | 93 | globlastp |
| tamarix\|gb166\|EH054173 | 2194 | 7207 | 587 | LYM764 | 93 | globlastp |
| zamia\|gb166\|DY030853 | 2195 | 7208 | 587 | LYM764 | 93 | globlastp |
| zostera\|10v1\|SRR057351S0034145 | 2196 | 7209 | 587 | LYM764 | 93 | globlastp |
| flaveria\|11v1\|SRR149232.346567_T1 | 2197 | 7210 | 587 | LYM764 | 92.98 | glotblastn |
| sarracenia\|11v1\|SRR192669.102268 | 2198 | — | 587 | LYM764 | 92.98 | glotblastn |
| poppy\|11v1\|FE965136_P1 | 2199 | 7211 | 587 | LYM764 | 92.3 | globlastp |
| poppy\|11v1\|SRR030259.104300_P1 | 2200 | 7211 | 587 | LYM764 | 92.3 | globlastp |
| poppy\|11v1\|SRR096789.121912_P1 | 2201 | 7211 | 587 | LYM764 | 92.3 | globlastp |
| rose\|12v1\|BQ105234_P1 | 2202 | 7212 | 587 | LYM764 | 92.2 | globlastp |
| lotus\|09v1\|LLGO005623_P1 | 2203 | 7213 | 587 | LYM764 | 92.2 | globlastp |
| rose\|10v1\|BQ105234 | 2204 | 7212 | 587 | LYM764 | 92.2 | globlastp |
| soybean\|11v1\|GLYMA02G10640 | 2205 | 7214 | 587 | LYM764 | 92.2 | globlastp |
| flaveria\|11v1\|SRR149244.176623_T1 | 2206 | 7215 | 587 | LYM764 | 92.11 | glotblastn |
| cassava\|09v1\|JGICASSAVA24630VALIDM1_P1 | 2207 | 7216 | 587 | LYM764 | 92.1 | globlastp |
| cleome_spinosa\|10v1\|SRR015531S0030309_P1 | 2208 | 7217 | 587 | LYM764 | 92.1 | globlastp |
| cotton\|11v1\|CA992814_P1 | 2209 | 7218 | 587 | LYM764 | 92.1 | globlastp |
| cryptomeria\|gb166\|AU036742_P1 | 2210 | 7219 | 587 | LYM764 | 92.1 | globlastp |
| euonymus\|11v1\|SRR070038X150675_P1 | 2211 | 7220 | 587 | LYM764 | 92.1 | globlastp |
| euonymus\|11v1\|SRR070038X376659_P1 | 2212 | 7220 | 587 | LYM764 | 92.1 | globlastp |
| euphorbia\|11v1\|DV125901_P1 | 2213 | 7221 | 587 | LYM764 | 92.1 | globlastp |
| spurge\|gb161\|DV125901 | 2213 | 7221 | 587 | LYM764 | 92.1 | globlastp |
| flax\|11v1\|JG105390_P1 | 2214 | 7222 | 587 | LYM764 | 92.1 | globlastp |
| gnetum\|10v1\|SRR064399S0004634_P1 | 2215 | 7223 | 587 | LYM764 | 92.1 | globlastp |
| pepper\|12v1\|BM067625_P1 | 2216 | 7224 | 587 | LYM764 | 92.1 | globlastp |
| pepper\|gb171\|BM067625 | 2217 | 7224 | 587 | LYM764 | 92.1 | globlastp |
| phyla\|11v2\|SRR099035X109766_P1 | 2218 | 7225 | 587 | LYM764 | 92.1 | globlastp |
| sciadopitys\|10v1\|SRR065035S0086249 | 2219 | 7226 | 587 | LYM764 | 92.1 | globlastp |
| sequoia\|10v1\|SRR065044S0060828 | 2220 | 7227 | 587 | LYM764 | 92.1 | globlastp |
| tobacco\|gb162\|BP532071 | 2221 | 7228 | 587 | LYM764 | 92.1 | globlastp |
| utricularia\|11v1\|SRR094438.112587 | 2222 | 7229 | 587 | LYM764 | 92.1 | globlastp |
| valeriana\|11v1\|SRR099039X106303 | 2223 | 7230 | 587 | LYM764 | 92.1 | globlastp |
| fagopyrum\|11v1\|SRR063689X104089_P1 | 2224 | 7231 | 587 | LYM764 | 91.5 | globlastp |
| epimedium\|11v1\|SRR013502.27781_P1 | 2225 | 7232 | 587 | LYM764 | 91.4 | globlastp |
| pigeonpea\|11v1\|SRR054580X195117_P1 | 2226 | 7233 | 587 | LYM764 | 91.4 | globlastp |
| thellungiella_halophilum\|11v1\|EHJGI11018228 | 2227 | 7234 | 587 | LYM764 | 91.4 | globlastp |
| catharanthus\|11v1\|SRR098691X12648_P1 | 2228 | 7235 | 587 | LYM764 | 91.3 | globlastp |
| strawberry\|11v1\|DY667497 | 2229 | 7236 | 587 | LYM764 | 91.3 | globlastp |
| cephalotaxus\|11v1\|SRR064395X101727_P1 | 2230 | 7237 | 587 | LYM764 | 91.2 | globlastp |
| cephalotaxus\|11v1\|SRR064395X10746_P1 | 2231 | 7238 | 587 | LYM764 | 91.2 | globlastp |
| flax\|11v1\|GW866940_P1 | 2232 | 7239 | 587 | LYM764 | 91.2 | globlastp |
| flax\|11v1\|JG121754_P1 | 2233 | 7239 | 587 | LYM764 | 91.2 | globlastp |
| maritime_pine\|10v1\|SRR073357S0001862_P1 | 2234 | 7240 | 587 | LYM764 | 91.2 | globlastp |
| pine\|10v2\|BF778085_P1 | 2235 | 7240 | 587 | LYM764 | 91.2 | globlastp |
| poplar\|10v1\|CV249641_P1 | 2236 | 7241 | 587 | LYM764 | 91.2 | globlastp |
| silene\|11v1\|GH292331 | 2237 | 7242 | 587 | LYM764 | 91.2 | globlastp |
| silene\|11v1\|SRR096785X101660 | 2238 | 7243 | 587 | LYM764 | 91.2 | globlastp |
| valeriana\|11v1\|SRR099039X101371 | 2239 | 7244 | 587 | LYM764 | 91.2 | globlastp |
| arabidopsis_lyrata\|09v1\|JGIAL023553_P1 | 2240 | 7245 | 587 | LYM764 | 90.5 | globlastp |
| arabidopsis\|10v1\|AT4G02840_P1 | 2241 | 7246 | 587 | LYM764 | 90.5 | globlastp |
| sunflower\|12v1\|CD848877_P1 | 2242 | 7247 | 587 | LYM764 | 90.4 | globlastp |
| abies\|11v2\|SRR098676X12720_P1 | 2243 | 7248 | 587 | LYM764 | 90.4 | globlastp |
| arabidopsis\|10v1\|AT3G07590_P1 | 2244 | 7249 | 587 | LYM764 | 90.4 | globlastp |
| marchantia\|gb166\|C95889_P1 | 2245 | 7250 | 587 | LYM764 | 90.4 | globlastp |
| pseudotsuga\|10v1\|SRR065119S0065685 | 2246 | 7251 | 587 | LYM764 | 90.4 | globlastp |
| spruce\|11v1\|ES227917 | 2247 | 7252 | 587 | LYM764 | 90.4 | globlastp |
| sunflower\|10v1\|CD848877 | 2248 | 7253 | 587 | LYM764 | 90.4 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| watermelon\|11v1\|VMEL01802512650331 | 2249 | 7254 | 587 | LYM764 | 90.4 | globlastp |
| antirrhinum\|gb166\|AJ558281_P1 | 2250 | 7255 | 587 | LYM764 | 89.5 | globlastp |
| arabidopsis_lyrata\|09v1\|JGIAL009190_P1 | 2251 | 7256 | 587 | LYM764 | 89.5 | globlastp |
| cedrus\|11v1\|SRR065007X290865_P1 | 2252 | 7257 | 587 | LYM764 | 89.5 | globlastp |
| ceratodon\|10v1\|SRR074890S0018555_P1 | 2253 | 7258 | 587 | LYM764 | 89.5 | globlastp |
| cucurbita\|11v1\|SRR091276X111230_P1 | 2254 | 7259 | 587 | LYM764 | 89.5 | globlastp |
| heritiera\|10v1\|SRR005795S0013156_P1 | 2255 | 7260 | 587 | LYM764 | 89.5 | globlastp |
| monkeyflower\|10v1\|GO994237_P1 | 2256 | 7261 | 587 | LYM764 | 89.5 | globlastp |
| nasturtium\|11v1\|SRR032558.239677_P1 | 2257 | 7262 | 587 | LYM764 | 89.5 | globlastp |
| physcomitrella\|10v1\|BJ177271_P1 | 2258 | 7263 | 587 | LYM764 | 89.5 | globlastp |
| utricularia\|11v1\|SRR094438.106979 | 2259 | 7264 | 587 | LYM764 | 89.5 | globlastp |
| wheat\|10v2\|CA618605 | 2260 | 7265 | 587 | LYM764 | 89.47 | glotblastn |
| b_juncea\|10v2\|E6ANDIZ01DV9RT | 2261 | 7266 | 587 | LYM764 | 88.8 | globlastp |
| b_juncea\|12v1\|E6ANDIZ01DV9RT_P1 | 2262 | 7266 | 587 | LYM764 | 88.8 | globlastp |
| beet\|12v1\|BQ592223_P1 | 2263 | 7267 | 587 | LYM764 | 88.7 | globlastp |
| beet\|gb162\|BQ592223 | 2264 | 7267 | 587 | LYM764 | 88.7 | globlastp |
| thellungiella\|gb167\|BY811937 | 2265 | 7268 | 587 | LYM764 | 88.7 | globlastp |
| ceratodon\|10v1\|SRR074890S0038964_P1 | 2266 | 7269 | 587 | LYM764 | 88.6 | globlastp |
| cucurbita\|11v1\|SRR091276X138854_P1 | 2267 | 7270 | 587 | LYM764 | 88.6 | globlastp |
| monkeyflower\|10v1\|GO973386_P1 | 2268 | 7271 | 587 | LYM764 | 88.6 | globlastp |
| physcomitrella\|10v1\|BI488007_P1 | 2269 | 7272 | 587 | LYM764 | 88.6 | globlastp |
| primula\|11v1\|SRR098679X100009_P1 | 2270 | 7273 | 587 | LYM764 | 88.6 | globlastp |
| primula\|11v1\|SRR098679X123184XX2_P1 | 2271 | 7273 | 587 | LYM764 | 88.6 | globlastp |
| pteridium\|11v1\|SRR043594X135224 | 2272 | 7274 | 587 | LYM764 | 88.6 | globlastp |
| spikemoss\|gb165\|FE448441 | 2273 | 7275 | 587 | LYM764 | 88.6 | globlastp |
| aquilegia\|10v2\|JGIAC002018_P1 | 2274 | 7276 | 587 | LYM764 | 88.3 | globlastp |
| b_juncea\|12v1\|E6ANDIZ01BA33Q_P1 | 2275 | 7277 | 587 | LYM764 | 88.1 | globlastp |
| b_oleracea\|gb161\|DY027043_P1 | 2276 | 7277 | 587 | LYM764 | 88.1 | globlastp |
| canola\|11v1\|CN725843_P1 | 2277 | 7277 | 587 | LYM764 | 88.1 | globlastp |
| radish\|gb164\|EV537425 | 2278 | 7277 | 587 | LYM764 | 88.1 | globlastp |
| chelidonium\|11v1\|SRR084752X125534_P1 | 2279 | 7278 | 587 | LYM764 | 87.8 | globlastp |
| fern\|gb171\|DK951625_P1 | 2280 | 7279 | 587 | LYM764 | 87.7 | globlastp |
| ginseng\|10v1\|GR871722_P1 | 2281 | 7280 | 587 | LYM764 | 87.7 | globlastp |
| physcomitrella\|10v1\|BJ201959_P1 | 2282 | 7281 | 587 | LYM764 | 87.7 | globlastp |
| banana\|12v1\|MAGEN2012031490_P1 | 2283 | 7282 | 587 | LYM764 | 87.4 | globlastp |
| b_rapa\|11v1\|CD815800_P1 | 2284 | 7283 | 587 | LYM764 | 87.3 | globlastp |
| canola\|11v1\|CN726594_P1 | 2285 | 7284 | 587 | LYM764 | 87.3 | globlastp |
| canola\|11v1\|SRR023610.9846_P1 | 2286 | 7284 | 587 | LYM764 | 87.3 | globlastp |
| radish\|gb164\|EV567885 | 2287 | 7284 | 587 | LYM764 | 87.3 | globlastp |
| b_juncea\|12v1\|E6ANDIZ01ASW6Z_P1 | 2288 | 7284 | 587 | LYM764 | 87.3 | globlastp |
| b_rapa\|11v1\|DY017870_T1 | 2289 | 7285 | 587 | LYM764 | 87.29 | glotblastn |
| b_juncea\|10v2\|E6ANDIZ01ASW6Z | 2290 | 7286 | 587 | LYM764 | 87.2 | globlastp |
| antirrhinum\|gb166\|AJ788202_T1 | 2291 | 7287 | 587 | LYM764 | 86.84 | glotblastn |
| thellungiella_halophilum\|11v1\|EHJGI11004289 | 2292 | 7288 | 587 | LYM764 | 86.84 | glotblastn |
| sesame\|12v1\|SESI12V1373433_P1 | 2293 | 7289 | 587 | LYM764 | 86.8 | globlastp |
| pteridium\|11v1\|SRR043594X196011 | 2294 | 7290 | 587 | LYM764 | 86.8 | globlastp |
| b_rapa\|11v1\|CD824978_P1 | 2295 | 7291 | 587 | LYM764 | 86.4 | globlastp |
| vinca\|11v1\|SRR098690X11189 | 2296 | 7292 | 587 | LYM764 | 86.1 | globlastp |
| pigeonpea\|11v1\|SRR054580X561638_P1 | 2297 | 7293 | 587 | LYM764 | 86 | globlastp |
| canola\|11v1\|EE515471_P1 | 2298 | 7294 | 587 | LYM764 | 85.6 | globlastp |
| arabidopsis_lyrata\|09v1\|JGIAL000253_P1 | 2299 | 7295 | 587 | LYM764 | 85.5 | globlastp |
| b_rapa\|11v1\|DY027127_P1 | 2300 | 7296 | 587 | LYM764 | 85.1 | globlastp |
| dandelion\|10v1\|GO664956_T1 | 2301 | 7297 | 587 | LYM764 | 84.21 | glotblastn |
| fraxinus\|11v1\|SRR058827.117696_T1 | 2302 | 7298 | 587 | LYM764 | 84.21 | glotblastn |
| amsonia\|11v1\|SRR098688X126425_P1 | 2303 | 7299 | 587 | LYM764 | 84.2 | globlastp |
| cycas\|gb166\|CB090786_P1 | 2304 | 7300 | 587 | LYM764 | 84.2 | globlastp |
| monkeyflower\|10v1\|SRR037228S0020145_P1 | 2305 | 7301 | 587 | LYM764 | 84.2 | globlastp |
| b_oleracea\|gb161\|DY027127_P1 | 2306 | 7302 | 587 | LYM764 | 83.9 | globlastp |
| thellungiella_parvulum\|11v1\|EPCRP009433 | 2307 | 7303 | 587 | LYM764 | 83.6 | globlastp |
| sunflower\|12v1\|EL486663_T1 | 2308 | 7304 | 587 | LYM764 | 83.33 | glotblastn |
| podocarpus\|10v1\|SRR065014S0055713_T1 | 2309 | 7305 | 587 | LYM764 | 83.33 | glotblastn |
| plantago\|11v2\|SRR066373X147202_P1 | 2310 | 7306 | 587 | LYM764 | 83.3 | globlastp |
| thalictrum\|11v1\|SRR096787X113304 | 2311 | 7307 | 587 | LYM764 | 82.5 | globlastp |
| thellungiella_halophilum\|11v1\|BY811937 | 2312 | 7308 | 587 | LYM764 | 82.5 | globlastp |
| thellungiella_parvulum\|11v1\|EPCRP022017 | 2313 | 7309 | 587 | LYM764 | 82 | globlastp |
| thellungiella_parvulum\|11v1\|BY811937 | 2314 | 7310 | 587 | LYM764 | 81.8 | globlastp |
| b_rapa\|11v1\|EE475292_P1 | 2315 | 7311 | 587 | LYM764 | 81.8 | globlastp |
| primula\|11v1\|SRR098679X117473_T1 | 2316 | — | 587 | LYM764 | 81.74 | glotblastn |
| physcomitrella\|10v1\|PHPCRP005522_T1 | 2317 | 7312 | 587 | LYM764 | 81.58 | glotblastn |
| radish\|gb164\|EW731698 | 2318 | 7313 | 587 | LYM764 | 80.8 | globlastp |
| lettuce\|10v1\|BU011361 | 2319 | 7314 | 587 | LYM764 | 80.7 | globlastp |
| cenchrus\|gb166\|BM084231_T1 | 2320 | 7315 | 587 | LYM764 | 80 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| oat\|11v1\|CN820344_P1 | 2321 | 7316 | 589 | LYM766 | 92.1 | globlastp |
| barley\|10v2\|BG300000 | 2322 | 7317 | 589 | LYM766 | 89.5 | globlastp |
| barley\|12v1\|BG300000_P1 | 2323 | 7317 | 589 | LYM766 | 89.5 | globlastp |
| leymus\|gb166\|EG375803_P1 | 2324 | 7318 | 589 | LYM766 | 89.5 | globlastp |
| rye\|gb164\|BE705165 | 2325 | 7319 | 589 | LYM766 | 89.47 | glotblastn |
| rye\|12v1\|BE705165_T1 | 2326 | — | 589 | LYM766 | 89.47 | glotblastn |
| wheat\|12v3\|BE490461_P1 | 2327 | 7320 | 589 | LYM766 | 88.9 | globlastp |
| wheat\|10v2\|BE490461 | 2328 | 7321 | 589 | LYM766 | 88.9 | globlastp |
| foxtail_millet\|11v3\|SOLX00012538_P1 | 2329 | 7322 | 589 | LYM766 | 83.2 | globlastp |
| sorghum\|11v1\|SB03G026210 | 2330 | 7323 | 589 | LYM766 | 83.2 | globlastp |
| sorghum\|12v1\|SB03G026210_P1 | 2331 | 7323 | 589 | LYM766 | 83.2 | globlastp |
| foxtail_millet\|11v3\|SIPRD093768_T1 | 2332 | 7324 | 589 | LYM766 | 82.72 | glotblastn |
| sorghum\|11v1\|BG052750 | 2333 | 7325 | 589 | LYM766 | 82.6 | globlastp |
| maize\|10v1\|AA979895_P1 | 2334 | 7326 | 589 | LYM766 | 81.5 | globlastp |
| sugarcane\|10v1\|CA123485 | 2335 | 7327 | 589 | LYM766 | 81.05 | glotblastn |
| brachypodium\|12v1\|BRADI4G12180_P1 | 2336 | 7328 | 590 | LYM767 | 99.7 | globlastp |
| wheat\|12v3\|BG908029_T1 | 2337 | 7329 | 591 | LYM768 | 80.02 | glotblastn |
| lolium\|10v1\|AU248409_P1 | 2338 | 7330 | 592 | LYM769 | 89.5 | globlastp |
| brachypodium\|12v1\|BRADI2G37160_T1 | 2339 | 7331 | 592 | LYM769 | 87.72 | glotblastn |
| sorghum\|11v1\|SB09G001450 | 2340 | 7332 | 592 | LYM769 | 87.72 | glotblastn |
| brachypodium\|09v1\|GT766977 | 2341 | 7333 | 592 | LYM769 | 87.7 | globlastp |
| fescue\|gb161\|DT702669_P1 | 2342 | 7334 | 592 | LYM769 | 87.7 | globlastp |
| maize\|10v1\|AI901760_P1 | 2343 | 7335 | 592 | LYM769 | 87.7 | globlastp |
| maize\|10v1\|AI947359_P1 | 2344 | 7335 | 592 | LYM769 | 87.7 | globlastp |
| sorghum\|11v1\|SB02G040270 | 2345 | 7336 | 592 | LYM769 | 87.7 | globlastp |
| sorghum\|12v1\|SB02G040270_P1 | 2346 | 7336 | 592 | LYM769 | 87.7 | globlastp |
| sorghum\|11v1\|SB09G001440 | 2347 | 7336 | 592 | LYM769 | 87.7 | globlastp |
| sorghum\|12v1\|SB09G001440_P1 | 2348 | 7336 | 592 | LYM769 | 87.7 | globlastp |
| sugarcane\|10v1\|AA577633 | 2349 | 7336 | 592 | LYM769 | 87.7 | globlastp |
| sugarcane\|10v1\|CA084872 | 2350 | 7336 | 592 | LYM769 | 87.7 | globlastp |
| switchgrass\|gb167IDN150821 | 2351 | 7337 | 592 | LYM769 | 87.7 | globlastp |
| switchgrass\|gb167IDN151033 | 2352 | 7337 | 592 | LYM769 | 87.7 | globlastp |
| maize\|10v1\|AI948103_P1 | 2353 | 7338 | 592 | LYM769 | 86 | globlastp |
| millet\|10v1\|EVO454PM006593_P1 | 2354 | 7339 | 592 | LYM769 | 86 | globlastp |
| millet\|10v1\|EVO454PM516971_P1 | 2355 | 7339 | 592 | LYM769 | 86 | globlastp |
| fescue\|gb161\|DT685011_T1 | 2356 | 7340 | 592 | LYM769 | 85.96 | glotblastn |
| foxtail_millet\|11v3\|PHY7SI024061M_T1 | 2357 | 7341 | 592 | LYM769 | 85.96 | glotblastn |
| oat\|11v1\|CN818215_T1 | 2358 | 7342 | 592 | LYM769 | 85.96 | glotblastn |
| oat\|11v1\|SRR020741.189953_T1 | 2359 | 7343 | 592 | LYM769 | 85.96 | glotblastn |
| oat\|11v1\|SRR346072.10776_T1 | 2360 | 7344 | 592 | LYM769 | 85.96 | glotblastn |
| sugarcane\|10v1\|CA110158 | 2361 | 7345 | 592 | LYM769 | 85.96 | glotblastn |
| wheat\|10v2\|CA617073 | 2362 | 7346 | 592 | LYM769 | 85.96 | glotblastn |
| maize\|10v1\|SRR014550S0232417_P1 | 2363 | 7347 | 592 | LYM769 | 82.5 | globlastp |
| oil_palm\|11v1\|SRR190702.116725_T1 | 2364 | 7348 | 592 | LYM769 | 82.46 | glotblastn |
| pseudoroegneria\|gb167\|FF342712 | 2365 | 7349 | 592 | LYM769 | 82.46 | glotblastn |
| wheat\|10v2\|BE398522 | 2366 | 7350 | 592 | LYM769 | 82.46 | glotblastn |
| wheat\|10v2\|BE399758 | 2367 | 7351 | 592 | LYM769 | 82.46 | glotblastn |
| wheat\|10v2\|BE402177 | 2368 | 7352 | 592 | LYM769 | 82.46 | glotblastn |
| wheat\|10v2\|BF291871 | 2369 | 7353 | 592 | LYM769 | 82.46 | glotblastn |
| wheat\|12v3\|BE402177_T1 | 2370 | 7354 | 592 | LYM769 | 82.46 | glotblastn |
| wheat\|12v3\|TA12V11225671_T1 | 2371 | 7355 | 592 | LYM769 | 80.7 | glotblastn |
| cynodon\|10v1\|ES294220_T1 | 2372 | 7356 | 592 | LYM769 | 80.7 | glotblastn |
| maize\|10v1\|DW903049_T1 | 2373 | 7357 | 592 | LYM769 | 80.7 | glotblastn |
| maize\|10v1\|EB815908_P1 | 2374 | 7358 | 592 | LYM769 | 80.7 | globlastp |
| maize\|10v1\|FL025907_T1 | 2375 | 7359 | 592 | LYM769 | 80.7 | glotblastn |
| rice\|11v1\|BE039928 | 2376 | 7360 | 592 | LYM769 | 80.7 | glotblastn |
| scabiosa\|11v1\|SRR063723X102017 | 2377 | 7361 | 592 | LYM769 | 80.7 | glotblastn |
| platanus\|11v1\|SRR096786X100011XX1_T1 | 2378 | — | 592 | LYM769 | 80.7 | glotblastn |
| wheat\|10v2\|BE217030 | 2379 | 7362 | 593 | LYM770 | 85.5 | globlastp |
| wheat\|10v2\|BE425909 | 2380 | 7363 | 593 | LYM770 | 85.5 | globlastp |
| wheat\|10v2\|CA730005 | 2381 | 7364 | 593 | LYM770 | 84.8 | globlastp |
| rye\|12v1\|BE496065_P1 | 2382 | 7365 | 593 | LYM770 | 84.4 | globlastp |
| wheat\|12v3\|BE217030_P1 | 2383 | 7366 | 593 | LYM770 | 84 | globlastp |
| brachypodium\|12v1\|BRADI3G19630_P1 | 2384 | 7367 | 594 | LYM771 | 98.9 | globlastp |
| oat\|11v1\|CN818687_P1 | 2385 | 7368 | 594 | LYM771 | 87.9 | globlastp |
| foxtail_millet\|11v3\|PHY7SI013672M_T1 | 2386 | 7369 | 594 | LYM771 | 80.75 | glotblastn |
| barley\|12v1\|BG344680_P1 | 2387 | 7370 | 595 | LYM772 | 96.1 | globlastp |
| rye\|12v1\|DRR001012.102532_P1 | 2388 | 7371 | 595 | LYM772 | 96 | globlastp |
| rice\|11v1\|GFXOSU82966X1 | 2389 | 7372 | 595 | LYM772 | 94.7 | globlastp |
| sorghum\|11v1\|SB01G038990 | 2390 | 7373 | 595 | LYM772 | 94.1 | globlastp |
| sorghum\|12v1\|SB01G038990_P1 | 2391 | 7373 | 595 | LYM772 | 94.1 | globlastp |
| foxtail_millet\|11v3\|PHY7SI033969M_P1 | 2392 | 7374 | 595 | LYM772 | 93 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| maize\|10v1\|AW360722_P1 | 2393 | 7375 | 595 | LYM772 | 92.7 | globlastp |
| millet\|10v1\|EVO454PM001261_P1 | 2394 | 7376 | 595 | LYM772 | 89.3 | globlastp |
| wheat\|12v3\|CA499564_P1 | 2395 | 7377 | 595 | LYM772 | 84.6 | globlastp |
| wheat\|12v3\|BQ801193_P1 | 2396 | 7378 | 595 | LYM772 | 84.4 | globlastp |
| banana\|12v1\|ES434785_P1 | 2397 | 7379 | 595 | LYM772 | 81.3 | globlastp |
| oil_palm\|11v1\|EL563793_P1 | 2398 | 7380 | 595 | LYM772 | 81.2 | globlastp |
| banana\|12v1\|MAGEN2012033933_P1 | 2399 | 7381 | 595 | LYM772 | 80.8 | globlastp |
| banana\|12v1\|DN238741_P1 | 2400 | 7382 | 595 | LYM772 | 80.6 | globlastp |
| phalaenopsis\|11v1\|CK856961_T1 | 2401 | 7383 | 595 | LYM772 | 80.24 | glotblastn |
| barley\|12v1\|BJ462566_P1 | 2402 | 7384 | 596 | LYM773 | 84.2 | globlastp |
| rye\|12v1\|DRR001012.357593_P1 | 2403 | 7385 | 596 | LYM773 | 83.4 | globlastp |
| wheat\|12v3\|CA706773_P1 | 2404 | 7386 | 596 | LYM773 | 82.3 | globlastp |
| rice\|11v1\|AA752985 | 2405 | 7387 | 596 | LYM773 | 82 | globlastp |
| wheat\|10v2\|BG604574 | 2406 | 7388 | 596 | LYM773 | 81.13 | glotblastn |
| wheat\|12v3\|BG604574_P1 | 2407 | 7389 | 596 | LYM773 | 80.8 | globlastp |
| foxtail_millet\|11v3\|PHY7SI021727M_T1 | 2408 | 7390 | 597 | LYM774 | 95.96 | glotblastn |
| sorghum\|11v1\|SB09G023230 | 2409 | 7391 | 597 | LYM774 | 89.5 | globlastp |
| sorghum\|12v1\|SB09G023230_P1 | 2410 | 7391 | 597 | LYM774 | 89.5 | globlastp |
| maize\|10v1\|AI920753_P1 | 2411 | 7392 | 597 | LYM774 | 86.6 | globlastp |
| maize\|10v1\|CA404527_T1 | 2412 | 7393 | 597 | LYM774 | 83.96 | glotblastn |
| oil_palm\|11v1\|SRR190698.438770_P1 | 2413 | 598 | 598 | LYM775 | 100 | globlastp |
| sugarcane\|10v1\|BQ535377 | 2414 | 7394 | 598 | LYM775 | 98.9 | globlastp |
| maize\|10v1\|AI600845_P1 | 2415 | 7395 | 598 | LYM775 | 97.7 | globlastp |
| maize\|10v1\|T15300_P1 | 2416 | 7396 | 598 | LYM775 | 97.7 | globlastp |
| millet\|10v1\|CD724612_P1 | 2417 | 7397 | 598 | LYM775 | 97.7 | globlastp |
| switchgrass\|gb167\|DN144859 | 2418 | 7398 | 598 | LYM775 | 97.7 | globlastp |
| switchgrass\|gb167\|DN141020 | 2419 | 7399 | 598 | LYM775 | 96.6 | globlastp |
| switchgrass\|gb167\|FL789460 | 2420 | 7400 | 598 | LYM775 | 96.6 | globlastp |
| wheat\|10v2\|CA484334 | 2421 | 7401 | 598 | LYM775 | 96.6 | globlastp |
| cynodon\|10v1\|DT003652_P1 | 2422 | 7402 | 598 | LYM775 | 95.4 | globlastp |
| sorghum\|11v1\|SB10G008810 | 2423 | 7403 | 598 | LYM775 | 95.4 | globlastp |
| sorghum\|12v1\|SB10G008810_P1 | 2424 | 7403 | 598 | LYM775 | 95.4 | globlastp |
| millet\|10v1\|EVO454PM120644_T1 | 2425 | 7404 | 598 | LYM775 | 94.25 | glotblastn |
| rice\|11v1\|AF012897 | 2426 | 7405 | 598 | LYM775 | 89.9 | globlastp |
| momordica\|10v1\|EC612534_P1 | 2427 | 7406 | 598 | LYM775 | 87.4 | globlastp |
| brachypodium\|12v1\|BRADI1G44510_P1 | 2428 | 7407 | 598 | LYM775 | 86.4 | globlastp |
| brachypodium\|09v1\|DV471698 | 2429 | 7407 | 598 | LYM775 | 86.4 | globlastp |
| rye\|12v1\|DRR001012.100378_P1 | 2430 | 7408 | 598 | LYM775 | 86.2 | globlastp |
| rye\|12v1\|DRR001012.101417_P1 | 2431 | 7408 | 598 | LYM775 | 86.2 | globlastp |
| rye\|12v1\|DRR001012.104839_P1 | 2432 | 7408 | 598 | LYM775 | 86.2 | globlastp |
| rye\|12v1\|DRR001012.138176_P1 | 2433 | 7408 | 598 | LYM775 | 86.2 | globlastp |
| rye\|12v1\|DRR001012.160205_P1 | 2434 | 7408 | 598 | LYM775 | 86.2 | globlastp |
| rye\|12v1\|DRR001012.210967_P1 | 2435 | 7408 | 598 | LYM775 | 86.2 | globlastp |
| rye\|12v1\|DRR001012.38495_P1 | 2436 | 7408 | 598 | LYM775 | 86.2 | globlastp |
| rye\|12v1\|DRR001012.468725_P1 | 2437 | 7408 | 598 | LYM775 | 86.2 | globlastp |
| rye\|12v1\|DRR001013.137163_P1 | 2438 | 7408 | 598 | LYM775 | 86.2 | globlastp |
| rye\|12v1\|DRR001017.1053935_P1 | 2439 | 7408 | 598 | LYM775 | 86.2 | globlastp |
| rye\|12v1\|DRR001018.104407_P1 | 2440 | 7408 | 598 | LYM775 | 86.2 | globlastp |
| wheat\|12v3\|HX062544_P1 | 2441 | 7408 | 598 | LYM775 | 86.2 | globlastp |
| pseudoroegneria\|gb167\|FF344433 | 2442 | 7408 | 598 | LYM775 | 86.2 | globlastp |
| wheat\|10v2\|BE414600 | 2443 | 7408 | 598 | LYM775 | 86.2 | globlastp |
| wheat\|10v2\|BI750883 | 2444 | 7408 | 598 | LYM775 | 86.2 | globlastp |
| wheat\|10v2\|CA612414 | 2445 | 7408 | 598 | LYM775 | 86.2 | globlastp |
| wheat\|12v3\|BE398837_P1 | 2446 | 7408 | 598 | LYM775 | 86.2 | globlastp |
| wheat\|12v3\|BE423855_P1 | 2447 | 7408 | 598 | LYM775 | 86.2 | globlastp |
| lolium\|10v1\|AU245716_P1 | 2448 | 7409 | 598 | LYM775 | 85.2 | globlastp |
| oat\|11v1\|CN818082_P1 | 2449 | 7410 | 598 | LYM775 | 85.2 | globlastp |
| oat\|11v1\|CN820211_P1 | 2450 | 7411 | 598 | LYM775 | 85.2 | globlastp |
| barley\|12v1\|BE420608_P1 | 2451 | 7412 | 598 | LYM775 | 85.1 | globlastp |
| barley\|10v2\|X76604 | 2452 | 7412 | 598 | LYM775 | 85.1 | globlastp |
| leymus\|gb166\|EG377365_P1 | 2453 | 7413 | 598 | LYM775 | 85.1 | globlastp |
| rye\|12v1\|DRR001013.151600_T1 | 2454 | 7414 | 598 | LYM775 | 85.06 | glotblastn |
| fescue\|gb161\|DT690757_P1 | 2455 | 7415 | 598 | LYM775 | 84.1 | globlastp |
| wheat\|10v2\|CA609663 | 2456 | 7416 | 598 | LYM775 | 83.91 | glotblastn |
| rye\|12v1\|DRR001013.131244_P1 | 2457 | 7417 | 598 | LYM775 | 83.9 | globlastp |
| sugarcane\|10v1\|CA282515 | 2458 | 7418 | 598 | LYM775 | 82.8 | globlastp |
| wheat\|12v3\|HX196109_T1 | 2459 | 7419 | 598 | LYM775 | 82.76 | glotblastn |
| switchgrass\|gb167\|DN150986 | 2460 | 7420 | 599 | LYM776 | 96.2 | globlastp |
| sorghum\|11v1\|SB01G002480 | 2461 | 7421 | 599 | LYM776 | 94 | globlastp |
| sorghum\|12v1\|SB01G002480_P1 | 2462 | 7421 | 599 | LYM776 | 94 | globlastp |
| maize\|10v1\|H35885_T1 | 2463 | 7422 | 599 | LYM776 | 91.05 | glotblastn |
| oat\|11v1\|CN817409_T1 | 2464 | 7423 | 599 | LYM776 | 89.33 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| rice\|11v1\|BI807601 | 2465 | 7424 | 599 | LYM776 | 88.7 | globlastp |
| pseudoroegneria\|gb167\|FF349559 | 2466 | 7425 | 599 | LYM776 | 88.1 | globlastp |
| wheat\|10v2\|BE497924 | 2467 | 7426 | 599 | LYM776 | 88.1 | globlastp |
| wheat\|12v3\|BM135027_P1 | 2468 | 7426 | 599 | LYM776 | 88.1 | globlastp |
| wheat\|12v3\|CA696310_P1 | 2469 | 7427 | 599 | LYM776 | 87.7 | globlastp |
| rye\|12v1\|DRR001012.151204_T1 | 2470 | 7428 | 599 | LYM776 | 87.28 | glotblastn |
| brachypodium\|12v1\|BRADI1G02810_P1 | 2471 | 7429 | 599 | LYM776 | 87.1 | globlastp |
| brachypodium\|09v1\|GT796976 | 2472 | 7429 | 599 | LYM776 | 87.1 | globlastp |
| wheat\|10v2\|BE470626 | 2473 | 7430 | 599 | LYM776 | 86.8 | globlastp |
| wheat\|12v3\|BE470626_P1 | 2474 | 7430 | 599 | LYM776 | 86.8 | globlastp |
| rye\|12v1\|DRR001012.162892_P1 | 2475 | 7431 | 599 | LYM776 | 86.2 | globlastp |
| rye\|12v1\|DRR001012.129393_P1 | 2476 | 7432 | 599 | LYM776 | 86 | globlastp |
| rye\|12v1\|DRR001012.169474_P1 | 2477 | 7433 | 599 | LYM776 | 86 | globlastp |
| barley\|10v2\|BF619578 | 2478 | 7434 | 599 | LYM776 | 85.3 | globlastp |
| rye\|12v1\|DRR001012.409520_T1 | 2479 | 7435 | 599 | LYM776 | 84.92 | glotblastn |
| barley\|12v1\|BF619578_P1 | 2480 | 7436 | 599 | LYM776 | 84.5 | globlastp |
| rye\|12v1\|BE494834_P1 | 2481 | 7437 | 599 | LYM776 | 81.4 | globlastp |
| wheat\|12v3\|BE403256_P1 | 2482 | 7438 | 599 | LYM776 | 80.7 | globlastp |
| millet\|10v1\|EVO454PM006833_P1 | 2483 | 7439 | 600 | LYM777 | 99 | globlastp |
| sugarcane\|10v1\|AI105606 | 2484 | 7440 | 600 | LYM777 | 99 | globlastp |
| switchgrass\|gb167\|DN140631 | 2485 | 7440 | 600 | LYM777 | 99 | globlastp |
| switchgrass\|gb167\|DN141421 | 2486 | 7440 | 600 | LYM777 | 99 | globlastp |
| switchgrass\|gb167\|DN143459 | 2487 | 7440 | 600 | LYM777 | 99 | globlastp |
| sorghum\|11v1\|SB08G015270 | 2488 | 7441 | 600 | LYM777 | 98.5 | globlastp |
| sorghum\|12v1\|SB08G015270_P1 | 2489 | 7441 | 600 | LYM777 | 98.5 | globlastp |
| millet\|10v1\|EVO454PM004375_T1 | 2490 | 7442 | 600 | LYM777 | 98.46 | glotblastn |
| wheat\|10v2\|CA484196 | 2491 | 7443 | 600 | LYM777 | 97.9 | globlastp |
| wheat\|12v3\|CA484196_P1 | 2492 | 7443 | 600 | LYM777 | 97.9 | globlastp |
| lovegrass\|gb167\|DN482000_P1 | 2493 | 7444 | 600 | LYM777 | 96.9 | globlastp |
| maize\|10v1\|T70659_P1 | 2494 | 7445 | 600 | LYM777 | 96.9 | globlastp |
| brachypodium\|12v1\|BRADI4G07120_P1 | 2495 | 7446 | 600 | LYM777 | 95.9 | globlastp |
| brachypodium\|09v1\|DV470785 | 2496 | 7446 | 600 | LYM777 | 95.9 | globlastp |
| millet\|10v1\|EVO454PM000928_T1 | 2497 | 7447 | 600 | LYM777 | 94.92 | glotblastn |
| lolium\|10v1\|AU245786_P1 | 2498 | 7448 | 600 | LYM777 | 94.9 | globlastp |
| rice\|11v1\|AA751711 | 2499 | 7449 | 600 | LYM777 | 94.9 | globlastp |
| rice\|11v1\|BE039983 | 2500 | 7449 | 600 | LYM777 | 94.9 | globlastp |
| rice\|11v1\|BI795457 | 2501 | 7449 | 600 | LYM777 | 94.9 | globlastp |
| rye\|12v1\|DRR001012.113354_P1 | 2502 | 7450 | 600 | LYM777 | 94.4 | globlastp |
| wheat\|12v3\|BE399694_P1 | 2503 | 7450 | 600 | LYM777 | 94.4 | globlastp |
| wheat\|12v3\|BE400211_P1 | 2504 | 7450 | 600 | LYM777 | 94.4 | globlastp |
| barley\|10v2\|BE427774 | 2505 | 7450 | 600 | LYM777 | 94.4 | globlastp |
| barley\|12v1\|BE427774_P1 | 2506 | 7450 | 600 | LYM777 | 94.4 | globlastp |
| leymus\|gb166\|CN466442_P1 | 2507 | 7451 | 600 | LYM777 | 94.4 | globlastp |
| oat\|11v1\|CN816452_P1 | 2508 | 7452 | 600 | LYM777 | 94.4 | globlastp |
| pseudoroegneria\|gb167\|FF348873 | 2509 | 7450 | 600 | LYM777 | 94.4 | globlastp |
| wheat\|10v2\|BE399341 | 2510 | 7450 | 600 | LYM777 | 94.4 | globlastp |
| wheat\|12v3\|BF201468_P1 | 2511 | 7450 | 600 | LYM777 | 94.4 | globlastp |
| rye\|12v1\|DRR001012.100584_T1 | 2512 | 7453 | 600 | LYM777 | 93.33 | glotblastn |
| rye\|12v1\|DRR001012.115997_T1 | 2513 | 7453 | 600 | LYM777 | 92.31 | glotblastn |
| brachypodium\|12v1\|BRADI4G14160_P1 | 2514 | 7454 | 600 | LYM777 | 92.3 | globlastp |
| brachypodium\|09v1\|DV471421 | 2515 | 7454 | 600 | LYM777 | 92.3 | globlastp |
| foxtail_millet\|11v3\|PHY7S1031183M_P1 | 2516 | 7455 | 600 | LYM777 | 92.3 | globlastp |
| millet\|10v1\|CD725611_P1 | 2517 | 7456 | 600 | LYM777 | 92.3 | globlastp |
| foxtail_millet\|11v3\|PHY7SI037617M_P1 | 2518 | 7457 | 600 | LYM777 | 91.8 | globlastp |
| switchgrass\|gb167\|DN152369 | 2519 | 7458 | 600 | LYM777 | 91.8 | globlastp |
| switchgrass\|gb167\|FE628024 | 2520 | 7458 | 600 | LYM777 | 91.8 | globlastp |
| millet\|10v1\|EVO454PM042519_P1 | 2521 | 7459 | 600 | LYM777 | 91.3 | globlastp |
| sorghum\|11v1\|SB02G040120 | 2522 | 7460 | 600 | LYM777 | 90.8 | globlastp |
| sorghum\|12v1\|SB02G040120_P1 | 2523 | 7460 | 600 | LYM777 | 90.8 | globlastp |
| sugarcane\|10v1\|CA079990 | 2524 | 7461 | 600 | LYM777 | 90.8 | globlastp |
| switchgrass\|gb167\|DN140852 | 2525 | 7462 | 600 | LYM777 | 90.8 | globlastp |
| maize\|10v1\|AW165580_P1 | 2526 | 7463 | 600 | LYM777 | 90.3 | globlastp |
| maize\|10v1\|T27576_P1 | 2527 | 7464 | 600 | LYM777 | 90.3 | globlastp |
| sorghum\|11v1\|SB02G040080 | 2528 | 7465 | 600 | LYM777 | 90.3 | globlastp |
| sorghum\|12v1\|SB02G040080_P1 | 2529 | 7465 | 600 | LYM777 | 90.3 | globlastp |
| sugarcane\|10v1\|BQ536911 | 2530 | 7466 | 600 | LYM777 | 90.3 | globlastp |
| switchgrass\|gb167\|FE638764 | 2531 | 7467 | 600 | LYM777 | 90.3 | globlastp |
| lovegrass\|gb167\|EH187414_T1 | 2532 | 7468 | 600 | LYM777 | 89.74 | glotblastn |
| curcuma\|10v1\|DY391462_P1 | 2533 | 7469 | 600 | LYM777 | 89.3 | globlastp |
| eggplant\|10v1\|FS007451_P1 | 2534 | 7470 | 600 | LYM777 | 89.3 | globlastp |
| eggplant\|10v1\|FS014825_P1 | 2535 | 7470 | 600 | LYM777 | 89.3 | globlastp |
| fraxinus\|11v1\|SRR058827.130550_P1 | 2536 | 7471 | 600 | LYM777 | 89.3 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| brachypodium\|12v1\|BRADI1G20580_P1 | 2537 | 7472 | 600 | LYM777 | 89.2 | globlastp |
| brachypodium\|12v1\|BRADI1G61090_P1 | 2538 | 7473 | 600 | LYM777 | 89.2 | globlastp |
| brachypodium\|09v1\|GT776586 | 2539 | 7472 | 600 | LYM777 | 89.2 | globlastp |
| brachypodium\|09v1\|GT789857 | 2540 | 7473 | 600 | LYM777 | 89.2 | globlastp |
| banana\|10v1\|ES434451 | 2541 | 7474 | 600 | LYM777 | 88.83 | glotblastn |
| banana\|12v1\|ES436828_P1 | 2542 | 7475 | 600 | LYM777 | 88.8 | globlastp |
| banana\|12v1\|FL659414_P1 | 2543 | 7476 | 600 | LYM777 | 88.8 | globlastp |
| banana\|12v1\|MAGEN2012021093_P1 | 2544 | 7476 | 600 | LYM777 | 88.8 | globlastp |
| pepper\|12v1\|BM065041_P1 | 2545 | 7477 | 600 | LYM777 | 88.8 | globlastp |
| banana\|10v1\|ES436828 | 2546 | 7475 | 600 | LYM777 | 88.8 | globlastp |
| banana\|10v1\|FL659414 | 2547 | 7476 | 600 | LYM777 | 88.8 | globlastp |
| cassava\|09v1\|FG807211_P1 | 2548 | 7478 | 600 | LYM777 | 88.8 | globlastp |
| curcuma\|10v1\|DY389166_P1 | 2549 | 7479 | 600 | LYM777 | 88.8 | globlastp |
| eggplant\|10v1\|FS000601_P1 | 2550 | 7480 | 600 | LYM777 | 88.8 | globlastp |
| hevea\|10v1\|CB376802_P1 | 2551 | 7481 | 600 | LYM777 | 88.8 | globlastp |
| hevea\|10v1\|EC603142_P1 | 2552 | 7478 | 600 | LYM777 | 88.8 | globlastp |
| kiwi\|gb166\|FG487444_P1 | 2553 | 7482 | 600 | LYM777 | 88.8 | globlastp |
| pepper\|gb171\|BM065041 | 2554 | 7477 | 600 | LYM777 | 88.8 | globlastp |
| petunia\|gb171\|CV298144_P1 | 2555 | 7483 | 600 | LYM777 | 88.8 | globlastp |
| poplar\|10v1\|BI071759_P1 | 2556 | 7484 | 600 | LYM777 | 88.8 | globlastp |
| poplar\|10v1\|BI120948_P1 | 2557 | 7484 | 600 | LYM777 | 88.8 | globlastp |
| lovegrass\|gb167\|EH184479_P1 | 2558 | 7485 | 600 | LYM777 | 88.7 | globlastp |
| cotton\|11v1\|DV849183_T1 | 2559 | — | 600 | LYM777 | 88.32 | glotblastn |
| banana\|12v1\|ES432720_P1 | 2560 | 7486 | 600 | LYM777 | 88.3 | globlastp |
| banana\|12v1\|ES434451_P1 | 2561 | 7487 | 600 | LYM777 | 88.3 | globlastp |
| beet\|12v1\|BQ488675_P1 | 2562 | 7488 | 600 | LYM777 | 88.3 | globlastp |
| gossypium_raimondii\|12v1\|AI726645_P1 | 2563 | 7489 | 600 | LYM777 | 88.3 | globlastp |
| amaranthus\|10v1\|SRR039411S0002479_P1 | 2564 | 7490 | 600 | LYM777 | 88.3 | globlastp |
| beet\|gb162\|BQ488675 | 2565 | 7488 | 600 | LYM777 | 88.3 | globlastp |
| cassava\|09v1\|DV441809_P1 | 2566 | 7491 | 600 | LYM777 | 88.3 | globlastp |
| cassava\|09v1\|DV446722_P1 | 2567 | 7492 | 600 | LYM777 | 88.3 | globlastp |
| castorbean\|11v1\|GE635762_P1 | 2568 | 7493 | 600 | LYM777 | 88.3 | globlastp |
| cotton\|11v1\|AI726645_P1 | 2569 | 7489 | 600 | LYM777 | 88.3 | globlastp |
| fraxinus\|11v1\|SRR058827.13595_P1 | 2570 | 7494 | 600 | LYM777 | 88.3 | globlastp |
| fraxinus\|11v1\|SRR058827.153887_P1 | 2571 | 7495 | 600 | LYM777 | 88.3 | globlastp |
| ginger\|gb164\|DY351814_P1 | 2572 | 7496 | 600 | LYM777 | 88.3 | globlastp |
| ipomoea_batatas\|10v1\|CB330209_P1 | 2573 | 7497 | 600 | LYM777 | 88.3 | globlastp |
| lettuce\|10v1\|DW085754 | 2574 | 7498 | 600 | LYM777 | 88.3 | globlastp |
| olea\|11v1\|SRR014463.49400_P1 | 2575 | 7499 | 600 | LYM777 | 88.3 | globlastp |
| pepper\|12v1\|BM062542_P1 | 2576 | 7500 | 600 | LYM777 | 88.3 | globlastp |
| pepper\|gb171\|BM062542 | 2577 | 7500 | 600 | LYM777 | 88.3 | globlastp |
| pineapple\|10v1\|DT339114_P1 | 2578 | 7501 | 600 | LYM777 | 88.3 | globlastp |
| poplar\|10v1\|AI161607_P1 | 2579 | 7502 | 600 | LYM777 | 88.3 | globlastp |
| poplar\|10v1\|BU836785_P1 | 2580 | 7503 | 600 | LYM777 | 88.3 | globlastp |
| tomato\|11v1\|BG124626 | 2581 | 7504 | 600 | LYM777 | 88.3 | globlastp |
| tomato\|11v1\|BG125608 | 2582 | 7504 | 600 | LYM777 | 88.3 | globlastp |
| utricularia\|11v1\|SRR094438.102022 | 2583 | 7505 | 600 | LYM777 | 88.3 | globlastp |
| utricularia\|11v1\|SRR094438.109440 | 2584 | 7505 | 600 | LYM777 | 88.3 | globlastp |
| gerbera\|09v1\|AJ755444_T1 | 2585 | 7506 | 600 | LYM777 | 88.21 | glotblastn |
| fescue\|gb161\|DT674667_P1 | 2586 | 7507 | 600 | LYM777 | 88.2 | globlastp |
| lolium\|10v1\|AU248946_P1 | 2587 | 7507 | 600 | LYM777 | 88.2 | globlastp |
| oat\|11v1\|GO581400_P1 | 2588 | 7507 | 600 | LYM777 | 88.2 | globlastp |
| cirsium\|11v1\|SRR346952.104917_P1 | 2589 | 7508 | 600 | LYM777 | 87.9 | globlastp |
| flaveria\|11v1\|SRR149232.11491XX2_P1 | 2590 | 7509 | 600 | LYM777 | 87.9 | globlastp |
| tabernaemontana\|11v1\|SRR098689X105275 | 2591 | 7510 | 600 | LYM777 | 87.9 | globlastp |
| triphysaria\|10v1\|BM356510 | 2592 | 7511 | 600 | LYM777 | 87.9 | globlastp |
| beet\|12v1\|BQ583875_P1 | 2593 | 7512 | 600 | LYM777 | 87.8 | globlastp |
| blueberry\|12v1\|SRR353282X101853D1_P1 | 2594 | 7513 | 600 | LYM777 | 87.8 | globlastp |
| blueberry\|12v1\|SRR353282X17132D1_P1 | 2595 | 7513 | 600 | LYM777 | 87.8 | globlastp |
| gossypium_raimondii\|12v1\|AI729660_P1 | 2596 | 7514 | 600 | LYM777 | 87.8 | globlastp |
| gossypium_raimondii\|12v1\|BE052446_P1 | 2597 | 7515 | 600 | LYM777 | 87.8 | globlastp |
| acacia\|10v1\|FS585457_P1 | 2598 | 7516 | 600 | LYM777 | 87.8 | globlastp |
| amsonia\|11v1\|SRR098688X106817_P1 | 2599 | 7517 | 600 | LYM777 | 87.8 | globlastp |
| aristolochia\|10v1\|SRR039082S0083195_P1 | 2600 | 7518 | 600 | LYM777 | 87.8 | globlastp |
| beech\|11v1\|SRR006293.11207_P1 | 2601 | 7519 | 600 | LYM777 | 87.8 | globlastp |
| cacao\|10v1\|CU477209_P1 | 2602 | 7520 | 600 | LYM777 | 87.8 | globlastp |
| castorbean\|11v1\|EG662485_P1 | 2603 | 7521 | 600 | LYM777 | 87.8 | globlastp |
| castorbean\|11v1\|T14924_P1 | 2604 | 7522 | 600 | LYM777 | 87.8 | globlastp |
| cleome_gynandra\|10v1\|SRR015532S0014651_P1 | 2605 | 7523 | 600 | LYM777 | 87.8 | globlastp |
| cotton\|11v1\|AI728260_P1 | 2606 | 7514 | 600 | LYM777 | 87.8 | globlastp |
| cotton\|11v1\|AI729660XX1_P1 | 2607 | 7514 | 600 | LYM777 | 87.8 | globlastp |
| cotton\|11v1\|BE052446_P1 | 2608 | 7515 | 600 | LYM777 | 87.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| cotton\|11v1\|CO092376XX1_P1 | 2609 | 7515 | 600 | LYM777 | 87.8 | globlastp |
| flaveria\|11v1\|SRR149229.150154XX2_P1 | 2610 | 7524 | 600 | LYM777 | 87.8 | globlastp |
| fraxinus\|11v1\|SRR058827.120852_P1 | 2611 | 7525 | 600 | LYM777 | 87.8 | globlastp |
| hornbeam\|12v1\|SRR364455.112024_P1 | 2612 | 7526 | 600 | LYM777 | 87.8 | globlastp |
| hornbeam\|12v1\|SRR364455.124848_P1 | 2613 | 7527 | 600 | LYM777 | 87.8 | globlastp |
| ipomoea_nil\|10v1\|BJ561515_P1 | 2614 | 7528 | 600 | LYM777 | 87.8 | globlastp |
| ipomoea_nil\|10v1\|BJ565018_P1 | 2615 | 7529 | 600 | LYM777 | 87.8 | globlastp |
| kiwi\|gb166\|FG512659_P1 | 2616 | 7530 | 600 | LYM777 | 87.8 | globlastp |
| momordica\|10v1\|SRR071315S0000537_P1 | 2617 | 7531 | 600 | LYM777 | 87.8 | globlastp |
| momordica\|10v1\|SRR071315S0007757_P1 | 2618 | 7531 | 600 | LYM777 | 87.8 | globlastp |
| olea\|11v1\|SRR014463.28033_P1 | 2619 | 7532 | 600 | LYM777 | 87.8 | globlastp |
| pepper\|12v1\|CA523701_P1 | 2620 | 7533 | 600 | LYM777 | 87.8 | globlastp |
| pepper\|gb171\|CA523701 | 2621 | 7533 | 600 | LYM777 | 87.8 | globlastp |
| poplar\|10v1\|AI161996_P1 | 2622 | 7534 | 600 | LYM777 | 87.8 | globlastp |
| potato\|10v1\|BG596491_P1 | 2623 | 7535 | 600 | LYM777 | 87.8 | globlastp |
| potato\|10v1\|BI406305_P1 | 2624 | 7536 | 600 | LYM777 | 87.8 | globlastp |
| solanum_phureja\|09v1\|SPHBG124626 | 2625 | 7535 | 600 | LYM777 | 87.8 | globlastp |
| solanum_phureja\|09v1\|SPHBG125608 | 2626 | 7536 | 600 | LYM777 | 87.8 | globlastp |
| solanum_phureja\|09v1\|SPHBG127349 | 2627 | 7536 | 600 | LYM777 | 87.8 | globlastp |
| tabernaemontana\|11v1\|SRR098689X117089 | 2628 | 7537 | 600 | LYM777 | 87.8 | globlastp |
| tomato\|11v1\|BG123613 | 2629 | 7538 | 600 | LYM777 | 87.8 | globlastp |
| tragopogon\|10v1\|SRR020205S0002802 | 2630 | 7524 | 600 | LYM777 | 87.8 | globlastp |
| watermelon\|11v1\|CK700820 | 2631 | 7531 | 600 | LYM777 | 87.8 | globlastp |
| oat\|11v1\|GO588060_P1 | 2632 | 7539 | 600 | LYM777 | 87.7 | globlastp |
| oat\|11v1\|GO589158_P1 | 2633 | 7540 | 600 | LYM777 | 87.7 | globlastp |
| phyla\|11v2\|SRR099035X100154_P1 | 2634 | 7541 | 600 | LYM777 | 87.4 | globlastp |
| safflower\|gb162\|EL388581 | 2635 | 7542 | 600 | LYM777 | 87.4 | globlastp |
| sarracenia\|11v1\|SRR192669.100553 | 2636 | 7543 | 600 | LYM777 | 87.4 | globlastp |
| triphysaria\|10v1\|EY005188 | 2637 | 7544 | 600 | LYM777 | 87.4 | globlastp |
| sarracenia\|11v1\|SRR192669.152688 | 2638 | 7545 | 600 | LYM777 | 87.31 | glotblastn |
| cannabis\|12v1\|EW701442_P1 | 2639 | 7546 | 600 | LYM777 | 87.3 | globlastp |
| cannabis\|12v1\|GR221505_P1 | 2640 | 7546 | 600 | LYM777 | 87.3 | globlastp |
| gossypium_raimondii\|12v1\|AI725625_P1 | 2641 | 7547 | 600 | LYM777 | 87.3 | globlastp |
| sunflower\|12v1\|CD846519_P1 | 2642 | 7548 | 600 | LYM777 | 87.3 | globlastp |
| sunflower\|12v1\|CD850342_P1 | 2643 | 7548 | 600 | LYM777 | 87.3 | globlastp |
| sunflower\|12v1\|CD850630_P1 | 2644 | 7549 | 600 | LYM777 | 87.3 | globlastp |
| sunflower\|12v1\|CD850973_P1 | 2645 | 7548 | 600 | LYM777 | 87.3 | globlastp |
| sunflower\|12v1\|CF077456_P1 | 2646 | 7548 | 600 | LYM777 | 87.3 | globlastp |
| sunflower\|12v1\|CF077837_P1 | 2647 | 7548 | 600 | LYM777 | 87.3 | globlastp |
| sunflower\|12v1\|CF077863_P1 | 2648 | 7548 | 600 | LYM777 | 87.3 | globlastp |
| sunflower\|12v1\|CF097359_P1 | 2649 | 7548 | 600 | LYM777 | 87.3 | globlastp |
| sunflower\|12v1\|CX947862_P1 | 2650 | 7548 | 600 | LYM777 | 87.3 | globlastp |
| sunflower\|12v1\|DY917436_P1 | 2651 | 7548 | 600 | LYM777 | 87.3 | globlastp |
| sunflower\|12v1\|DY917758_P1 | 2652 | 7548 | 600 | LYM777 | 87.3 | globlastp |
| sunflower\|12v1\|DY939531_P1 | 2653 | 7548 | 600 | LYM777 | 87.3 | globlastp |
| sunflower\|12v1\|DY952059_P1 | 2654 | 7548 | 600 | LYM777 | 87.3 | globlastp |
| sunflower\|12v1\|EE613882_P1 | 2655 | 7548 | 600 | LYM777 | 87.3 | globlastp |
| sunflower\|12v1\|EE645705_P1 | 2656 | 7548 | 600 | LYM777 | 87.3 | globlastp |
| sunflower\|12v1\|EE650633_P1 | 2657 | 7548 | 600 | LYM777 | 87.3 | globlastp |
| sunflower\|12v1\|EL458989_P1 | 2658 | 7548 | 600 | LYM777 | 87.3 | globlastp |
| sunflower\|12v1\|EL466979_P1 | 2659 | 7548 | 600 | LYM777 | 87.3 | globlastp |
| sunflower\|12v1\|SRR346950X108020_P1 | 2660 | 7548 | 600 | LYM777 | 87.3 | globlastp |
| amsonia\|11v1\|SRR098688X108281_P1 | 2661 | 7550 | 600 | LYM777 | 87.3 | globlastp |
| artemisia\|10v1\|EY033526_P1 | 2662 | 7548 | 600 | LYM777 | 87.3 | globlastp |
| artemisia\|10v1\|EY035511_P1 | 2663 | 7548 | 600 | LYM777 | 87.3 | globlastp |
| catharanthus\|11v1\|AJ749993_P1 | 2664 | 7551 | 600 | LYM777 | 87.3 | globlastp |
| centaurea\|gb166\|EH746490_P1 | 2665 | 7552 | 600 | LYM777 | 87.3 | globlastp |
| chestnut\|gb170\|SRR006295S0000421_P1 | 2666 | 7553 | 600 | LYM777 | 87.3 | globlastp |
| cichorium\|gb171\|DT213209_P1 | 2667 | 7548 | 600 | LYM777 | 87.3 | globlastp |
| cichorium\|gb171\|DT213955_P1 | 2668 | 7554 | 600 | LYM777 | 87.3 | globlastp |
| cirsium\|11v1\|SRR346952.1014355_P1 | 2669 | 7552 | 600 | LYM777 | 87.3 | globlastp |
| cirsium\|11v1\|SRR346952.1129831_P1 | 2670 | 7552 | 600 | LYM777 | 87.3 | globlastp |
| coffea\|10v1\|DV667806_P1 | 2671 | 7555 | 600 | LYM777 | 87.3 | globlastp |
| cotton\|11v1\|AI725625_P1 | 2672 | 7556 | 600 | LYM777 | 87.3 | globlastp |
| cucumber\|09v1\|CK700820_P1 | 2673 | 7557 | 600 | LYM777 | 87.3 | globlastp |
| cucumber\|09v1\|DN910386_P1 | 2674 | 7557 | 600 | LYM777 | 87.3 | globlastp |
| cucurbita\|11v1\|SRR091276X136713_P1 | 2675 | 7557 | 600 | LYM777 | 87.3 | globlastp |
| cynara\|gb167\|GE586798_P1 | 2676 | 7558 | 600 | LYM777 | 87.3 | globlastp |
| dandelion\|10v1\|DR398843_P1 | 2677 | 7554 | 600 | LYM777 | 87.3 | globlastp |
| dandelion\|10v1\|DR399133_P1 | 2678 | 7554 | 600 | LYM777 | 87.3 | globlastp |
| dandelion\|10v1\|DR399898_P1 | 2679 | 7548 | 600 | LYM777 | 87.3 | globlastp |
| eschscholzia\|11v1\|SRR014116.108655_P1 | 2680 | 7559 | 600 | LYM777 | 87.3 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| euphorbia\|11v1\|BG467363_P1 | 2681 | 7560 | 600 | LYM777 | 87.3 | globlastp |
| fagopyrum\|11v1\|SRR063689X104185_P1 | 2682 | 7561 | 600 | LYM777 | 87.3 | globlastp |
| fagopyrum\|11v1\|SRR063703X103214_P1 | 2683 | 7561 | 600 | LYM777 | 87.3 | globlastp |
| flaveria\|11v1\|SRR149229.101325_P1 | 2684 | 7548 | 600 | LYM777 | 87.3 | globlastp |
| flaveria\|11v1\|SRR149229.119568_P1 | 2685 | 7548 | 600 | LYM777 | 87.3 | globlastp |
| flaveria\|11v1\|SRR149229.201221_P1 | 2686 | 7548 | 600 | LYM777 | 87.3 | globlastp |
| flaveria\|11v1\|SRR149229.458814_P1 | 2687 | 7548 | 600 | LYM777 | 87.3 | globlastp |
| flaveria\|11v1\|SRR149229.88862_P1 | 2688 | 7548 | 600 | LYM777 | 87.3 | globlastp |
| flaveria\|11v1\|SRR149232.101513_P1 | 2689 | 7548 | 600 | LYM777 | 87.3 | globlastp |
| flaveria\|11v1\|SRR149232.11287_P1 | 2690 | 7562 | 600 | LYM777 | 87.3 | globlastp |
| flaveria\|11v1\|SRR149232.113496_P1 | 2691 | 7562 | 600 | LYM777 | 87.3 | globlastp |
| flaveria\|11v1\|SRR149232.146161_P1 | 2692 | 7554 | 600 | LYM777 | 87.3 | globlastp |
| flaveria\|11v1\|SRR149232.14713_P1 | 2693 | 7548 | 600 | LYM777 | 87.3 | globlastp |
| flaveria\|11v1\|SRR149238.57812_P1 | 2694 | 7548 | 600 | LYM777 | 87.3 | globlastp |
| flaveria\|11v1\|SRR149241.105025_P1 | 2695 | 7548 | 600 | LYM777 | 87.3 | globlastp |
| ginger\|gb164\|DY352838_P1 | 2696 | 7563 | 600 | LYM777 | 87.3 | globlastp |
| humulus\|11v1\|ES652616_P1 | 2697 | 7564 | 600 | LYM777 | 87.3 | globlastp |
| humulus\|11v1\|ES653515XX1_P1 | 2698 | 7564 | 600 | LYM777 | 87.3 | globlastp |
| humulus\|11v1\|EX515957_P1 | 2699 | 7564 | 600 | LYM777 | 87.3 | globlastp |
| ipomoea_nil\|10v1\|BJ553391_P1 | 2700 | 7565 | 600 | LYM777 | 87.3 | globlastp |
| ipomoea_nil\|10v1\|BJ555152_P1 | 2701 | 7566 | 600 | LYM777 | 87.3 | globlastp |
| kiwi\|gb166\|FG396973_P1 | 2702 | 7567 | 600 | LYM777 | 87.3 | globlastp |
| lettuce\|10v1\|DW044447 | 2703 | 7554 | 600 | LYM777 | 87.3 | globlastp |
| lettuce\|10v1\|DW046680 | 2704 | 7554 | 600 | LYM777 | 87.3 | globlastp |
| lettuce\|10v1\|DW083743 | 2705 | 7554 | 600 | LYM777 | 87.3 | globlastp |
| lettuce\|10v1\|GFXAY193424X1 | 2706 | 7554 | 600 | LYM777 | 87.3 | globlastp |
| lettuce\|12v1\|GFXAY193424X1_P1 | 2707 | 7554 | 600 | LYM777 | 87.3 | globlastp |
| liriodendron\|gb166\|CK758803_P1 | 2708 | 7568 | 600 | LYM777 | 87.3 | globlastp |
| melon\|10v1\|DV632953_P1 | 2709 | 7557 | 600 | LYM777 | 87.3 | globlastp |
| melon\|10v1\|EB714875_P1 | 2710 | 7557 | 600 | LYM777 | 87.3 | globlastp |
| oak\|10v1\|DN950715_P1 | 2711 | 7553 | 600 | LYM777 | 87.3 | globlastp |
| oil_palm\|11v1\|EL608951_P1 | 2712 | 7569 | 600 | LYM777 | 87.3 | globlastp |
| phalaenopsis\|11v1\|CB035141_P1 | 2713 | 7570 | 600 | LYM777 | 87.3 | globlastp |
| phalaenopsis\|11v1\|CK856547_P1 | 2714 | 7571 | 600 | LYM777 | 87.3 | globlastp |
| phyla\|11v2\|SRR099035X127229_P1 | 2715 | 7572 | 600 | LYM777 | 87.3 | globlastp |
| platanus\|11v1\|SRR096786X103879_P1 | 2716 | 7573 | 600 | LYM777 | 87.3 | globlastp |
| sarracenia\|11v1\|SRR192669.128065 | 2717 | 7574 | 600 | LYM777 | 87.3 | globlastp |
| silene\|11v1\|SRR096785X103159 | 2718 | 7575 | 600 | LYM777 | 87.3 | globlastp |
| solanum_phureja\|09v1\|SPHBG123613 | 2719 | 7576 | 600 | LYM777 | 87.3 | globlastp |
| spurge\|gb161\|BG467363 | 2720 | 7577 | 600 | LYM777 | 87.3 | globlastp |
| sunflower\|10v1\|CD846519 | 2721 | 7548 | 600 | LYM777 | 87.3 | globlastp |
| sunflower\|10v1\|CD850342 | 2722 | 7548 | 600 | LYM777 | 87.3 | globlastp |
| sunflower\|10v1\|CD850973 | 2723 | 7548 | 600 | LYM777 | 87.3 | globlastp |
| sunflower\|10v1\|CX947862 | 2724 | 7548 | 600 | LYM777 | 87.3 | globlastp |
| tobacco\|gb162\|AF154636 | 2725 | 7578 | 600 | LYM777 | 87.3 | globlastp |
| tobacco\|gb162\|BQ842809 | 2726 | 7579 | 600 | LYM777 | 87.3 | globlastp |
| tobacco\|gb162\|Z14085 | 2727 | 7578 | 600 | LYM777 | 87.3 | globlastp |
| tragopogon\|10v1\|SRR020205S0000465 | 2728 | 7548 | 600 | LYM777 | 87.3 | globlastp |
| tragopogon\|10v1\|SRR020205S0025425 | 2729 | 7548 | 600 | LYM777 | 87.3 | globlastp |
| triphysaria\|10v1\|EY009061 | 2730 | 7580 | 600 | LYM777 | 87.3 | globlastp |
| watermelon\|11v1\|DV632953 | 2731 | 7557 | 600 | LYM777 | 87.3 | globlastp |
| lettuce\|12v1\|DW046680_P1 | 2732 | 7554 | 600 | LYM777 | 87.3 | globlastp |
| cleome_gynandra\|10v1\|SRR015532S0001632_P1 | 2733 | 7581 | 600 | LYM777 | 87.2 | globlastp |
| parthenium\|10v1\|GW782820_P1 | 2734 | 7582 | 600 | LYM777 | 87.2 | globlastp |
| maize\|10v1\|CA398995_T1 | 2735 | 7583 | 600 | LYM777 | 87.18 | glotblastn |
| centaurea\|gb166\|EH738371_P1 | 2736 | 7584 | 600 | LYM777 | 86.9 | globlastp |
| centaurea\|gb166\|EH753255_P1 | 2737 | 7584 | 600 | LYM777 | 86.9 | globlastp |
| centaurea\|gb166\|EL932197_P1 | 2738 | 7585 | 600 | LYM777 | 86.9 | globlastp |
| cirsium\|11v1\|SRR346952.1000066_P1 | 2739 | 7584 | 600 | LYM777 | 86.9 | globlastp |
| prunus\|10v1\|BU042184 | 2740 | 7586 | 600 | LYM777 | 86.9 | globlastp |
| safflower\|gb162\|EL374529 | 2741 | 7584 | 600 | LYM777 | 86.9 | globlastp |
| triphysaria\|10v1\|BM357656 | 2742 | 7587 | 600 | LYM777 | 86.9 | globlastp |
| triphysaria\|10v1\|EX991721 | 2743 | 7587 | 600 | LYM777 | 86.9 | globlastp |
| triphysaria\|10v1\|EX990270 | 2744 | 7588 | 600 | LYM777 | 86.87 | glotblastn |
| bean\|12v1\|CA897432_P1 | 2745 | 7589 | 600 | LYM777 | 86.8 | globlastp |
| gossypium_raimondii\|12v1\|ES804763_P1 | 2746 | 7590 | 600 | LYM777 | 86.8 | globlastp |
| rye\|12v1\|DRR001012.131699_T1 | 2747 | 7591 | 600 | LYM777 | 86.8 | glotblastn |
| sunflower\|12v1\|EL424140_P1 | 2748 | 7592 | 600 | LYM777 | 86.8 | globlastp |
| sunflower\|12v1\|EL484878_P1 | 2749 | 7593 | 600 | LYM777 | 86.8 | globlastp |
| amborella\|12v3\|CK759037_P1 | 2750 | 7594 | 600 | LYM777 | 86.8 | globlastp |
| amborella\|gb166\|CK759037 | 2751 | 7594 | 600 | LYM777 | 86.8 | globlastp |
| ambrosia\|11v1\|SRR346935.115376_P1 | 2752 | 7595 | 600 | LYM777 | 86.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| ambrosia\|11v1\|SRR346935.138867_P1 | 2753 | 7595 | 600 | LYM777 | 86.8 | globlastp |
| ambrosia\|11v1\|SRR346943.101813_P1 | 2754 | 7595 | 600 | LYM777 | 86.8 | globlastp |
| ambrosia\|11v1\|SRR346943.111655_P1 | 2755 | 7595 | 600 | LYM777 | 86.8 | globlastp |
| antirrhinum\|gb166\|AJ559730_P1 | 2756 | 7596 | 600 | LYM777 | 86.8 | globlastp |
| arnica\|11v1\|SRR099034X101053_P1 | 2757 | 7597 | 600 | LYM777 | 86.8 | globlastp |
| arnica\|11v1\|SRR099034X106824_P1 | 2758 | 7598 | 600 | LYM777 | 86.8 | globlastp |
| avocado\|10v1\|CK752485_P1 | 2759 | 7599 | 600 | LYM777 | 86.8 | globlastp |
| basilicum\|10v1\|DY324010_T1 | 2760 | 7600 | 600 | LYM777 | 86.8 | glotblastn |
| basilicum\|10v1\|DY328999_P1 | 2761 | 7601 | 600 | LYM777 | 86.8 | globlastp |
| bean\|gb167\|CA897432 | 2762 | 7589 | 600 | LYM777 | 86.8 | globlastp |
| beech\|11v1\|SRR006293.18398_P1 | 2763 | 7602 | 600 | LYM777 | 86.8 | globlastp |
| cacao\|10v1\|CU469980_P1 | 2764 | 7603 | 600 | LYM777 | 86.8 | globlastp |
| catharanthus\|11v1\|SRR098691X108789_T1 | 2765 | 7604 | 600 | LYM777 | 86.8 | glotblastn |
| cedrus\|11v1\|SRR065007X103514_P1 | 2766 | 7605 | 600 | LYM777 | 86.8 | globlastp |
| cirsium\|11v1\|SRR346952.112730_P1 | 2767 | 7595 | 600 | LYM777 | 86.8 | globlastp |
| cotton\|11v1\|BG444691_P1 | 2768 | 7606 | 600 | LYM777 | 86.8 | globlastp |
| cotton\|11v1\|CO089174_P1 | 2769 | 7590 | 600 | LYM777 | 86.8 | globlastp |
| cowpea\|12v1\|FF384281_P1 | 2770 | 7589 | 600 | LYM777 | 86.8 | globlastp |
| cowpea\|gb166\|FF384281 | 2771 | 7589 | 600 | LYM777 | 86.8 | globlastp |
| cucurbita\|11v1\|SRR091276X108637_P1 | 2772 | 7607 | 600 | LYM777 | 86.8 | globlastp |
| cucurbita\|11v1\|SRR091276X122774_P1 | 2773 | 7607 | 600 | LYM777 | 86.8 | globlastp |
| cucurbita\|11v1\|SRR091276X147433_T1 | 2774 | 7608 | 600 | LYM777 | 86.8 | glotblastn |
| cynara\|gb167\|GE585919_P1 | 2775 | 7595 | 600 | LYM777 | 86.8 | globlastp |
| cynara\|gb167\|GE587878_P1 | 2776 | 7598 | 600 | LYM777 | 86.8 | globlastp |
| eucalyptus\|11v2\|ES590214_P1 | 2777 | 7609 | 600 | LYM777 | 86.8 | globlastp |
| flaveria\|11v1\|SRR149229.103661_P1 | 2778 | 7610 | 600 | LYM777 | 86.8 | globlastp |
| flaveria\|11v1\|SRR149229.119683_P1 | 2779 | 7611 | 600 | LYM777 | 86.8 | globlastp |
| flaveria\|11v1\|SRR149232.274451_P1 | 2780 | 7612 | 600 | LYM777 | 86.8 | globlastp |
| flaveria\|11v1\|SRR149241.36887_T1 | 2781 | 7613 | 600 | LYM777 | 86.8 | glotblastn |
| guizotia\|10v1\|GE551295_P1 | 2782 | 7598 | 600 | LYM777 | 86.8 | globlastp |
| heritiera\|10v1\|SRR005794S0002407_P1 | 2783 | 7614 | 600 | LYM777 | 86.8 | globlastp |
| hornbeam\|12v1\|SRR364455.102282_P1 | 2784 | 7615 | 600 | LYM777 | 86.8 | globlastp |
| iceplant\|gb164\|AA762039_P1 | 2785 | 7616 | 600 | LYM777 | 86.8 | globlastp |
| iceplant\|gb164\|BG269487_P1 | 2786 | 7617 | 600 | LYM777 | 86.8 | globlastp |
| liquorice\|gb171\|FS239757_P1 | 2787 | 7618 | 600 | LYM777 | 86.8 | globlastp |
| liriodendron\|gb166\|CK743237_P1 | 2788 | 7619 | 600 | LYM777 | 86.8 | globlastp |
| lotus\|09v1\|LLAW163894_P1 | 2789 | 7620 | 600 | LYM777 | 86.8 | globlastp |
| nasturtium\|11v1\|GH162609_P1 | 2790 | 7621 | 600 | LYM777 | 86.8 | globlastp |
| oil_palm\|11v1\|EL930476_P1 | 2791 | 7622 | 600 | LYM777 | 86.8 | globlastp |
| parthenium\|10v1\|GW779583_P1 | 2792 | 7595 | 600 | LYM777 | 86.8 | globlastp |
| parthenium\|10v1\|GW784379_P1 | 2793 | 7595 | 600 | LYM777 | 86.8 | globlastp |
| pigeonpea\|11v1\|EE604740_P1 | 2794 | 7618 | 600 | LYM777 | 86.8 | globlastp |
| platanus\|11v1\|SRR096786X102911_P1 | 2795 | 7623 | 600 | LYM777 | 86.8 | globlastp |
| platanus\|11v1\|SRR096786X115128_P1 | 2796 | 7624 | 600 | LYM777 | 86.8 | globlastp |
| safflower\|gb162\|EL398688 | 2797 | 7625 | 600 | LYM777 | 86.8 | globlastp |
| scabiosa\|11v1\|SRR063723X113584 | 2798 | 7626 | 600 | LYM777 | 86.8 | globlastp |
| silene\|11v1\|SRR096785X101675 | 2799 | 7627 | 600 | LYM777 | 86.8 | globlastp |
| soybean\|11v1\|GLYMA05G01180 | 2800 | 7618 | 600 | LYM777 | 86.8 | globlastp |
| soybean\|11v1\|GLYMA17G10710 | 2801 | 7618 | 600 | LYM777 | 86.8 | globlastp |
| taxus\|10v1\|SRR065067S0014102 | 2802 | 7628 | 600 | LYM777 | 86.8 | globlastp |
| tobacco\|gb162\|BQ842834 | 2803 | 7629 | 600 | LYM777 | 86.8 | globlastp |
| triphysaria\|10v1\|BM357307 | 2804 | 7630 | 600 | LYM777 | 86.8 | globlastp |
| tripterygium\|11v1\|SRR098677X101689 | 2805 | 7631 | 600 | LYM777 | 86.8 | globlastp |
| utricularia\|11v1\|SRR094438.101827 | 2806 | 7632 | 600 | LYM777 | 86.8 | globlastp |
| walnuts\|gb166\|CB303673 | 2807 | 7633 | 600 | LYM777 | 86.8 | globlastp |
| euphorbia\|11v1\|BP960852_P1 | 2808 | 7634 | 600 | LYM777 | 86.7 | globlastp |
| euphorbia\|11v1\|BP960859_P1 | 2809 | 7634 | 600 | LYM777 | 86.7 | globlastp |
| euphorbia\|11v1\|SRR098678X102807_P1 | 2810 | 7635 | 600 | LYM777 | 86.7 | globlastp |
| euphorbia\|11v1\|SRR098678X103571_P1 | 2811 | 7635 | 600 | LYM777 | 86.7 | globlastp |
| euphorbia\|11v1\|SRR098678X103670_P1 | 2812 | 7635 | 600 | LYM777 | 86.7 | globlastp |
| euphorbia\|11v1\|SRR098678X108101_P1 | 2813 | 7635 | 600 | LYM777 | 86.7 | globlastp |
| pseudoroegneria\|gb167\|FF357450 | 2814 | 7636 | 600 | LYM777 | 86.7 | globlastp |
| ambrosia\|11v1\|SRR346946.211883_T1 | 2815 | 7637 | 600 | LYM777 | 86.67 | glotblastn |
| guizotia\|10v1\|GE554477_P1 | 2816 | 7638 | 600 | LYM777 | 86.4 | globlastp |
| monkeyflower\|10v1\|CV518253_P1 | 2817 | 7639 | 600 | LYM777 | 86.4 | globlastp |
| oak\|10v1\|FP029705_P1 | 2818 | 7640 | 600 | LYM777 | 86.4 | globlastp |
| valeriana\|11v1\|SRR099039X104259 | 2819 | 7641 | 600 | LYM777 | 86.4 | globlastp |
| valeriana\|11v1\|SRR099039X12659 | 2820 | 7641 | 600 | LYM777 | 86.4 | globlastp |
| bean\|12v1\|CA897428_P1 | 2821 | 7642 | 600 | LYM777 | 86.3 | globlastp |
| bean\|12v1\|CA897429_P1 | 2822 | 7643 | 600 | LYM777 | 86.3 | globlastp |
| blueberry\|12v1\|SRR353282X10805D1_P1 | 2823 | 7644 | 600 | LYM777 | 86.3 | globlastp |
| abies\|11v2\|SRR098676X102702_P1 | 2824 | 7645 | 600 | LYM777 | 86.3 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| ambrosia\|11v1\|SRR346943.100645_P1 | 2825 | 7646 | 600 | LYM777 | 86.3 | globlastp |
| ambrosia\|11v1\|SRR346943.101896_P1 | 2826 | 7647 | 600 | LYM777 | 86.3 | globlastp |
| arnica\|11v1\|SRR099034X103428_P1 | 2827 | 7648 | 600 | LYM777 | 86.3 | globlastp |
| bean\|gb167\|CA897428 | 2828 | 7642 | 600 | LYM777 | 86.3 | globlastp |
| bean\|gb167\|CA897429 | 2829 | 7643 | 600 | LYM777 | 86.3 | globlastp |
| bean\|gb167\|CV533532 | 2830 | 7642 | 600 | LYM777 | 86.3 | globlastp |
| cephalotaxus\|11v1\|SRR064395X100950_P1 | 2831 | 7649 | 600 | LYM777 | 86.3 | globlastp |
| cleome_spinosa\|10v1\|GR933407_P1 | 2832 | 7650 | 600 | LYM777 | 86.3 | globlastp |
| cotton\|11v1\|SRR032878.121814_P1 | 2833 | 7651 | 600 | LYM777 | 86.3 | globlastp |
| cowpea\|12v1\|FC457400_P1 | 2834 | 7642 | 600 | LYM777 | 86.3 | globlastp |
| cowpea\|gb166\|FC457400 | 2835 | 7642 | 600 | LYM777 | 86.3 | globlastp |
| cowpea\|12v1\|FF382796_P1 | 2836 | 7642 | 600 | LYM777 | 86.3 | globlastp |
| cowpea\|gb166\|FF382796 | 2837 | 7642 | 600 | LYM777 | 86.3 | globlastp |
| cryptomeria\|gb166\|BP176575_P1 | 2838 | 7652 | 600 | LYM777 | 86.3 | globlastp |
| eschscholzia\|11v1\|CD477434_P1 | 2839 | 7653 | 600 | LYM777 | 86.3 | globlastp |
| eschscholzia\|11v1\|CD479390_P1 | 2840 | 7654 | 600 | LYM777 | 86.3 | globlastp |
| eschscholzia\|11v1\|CK750539_P1 | 2841 | 7654 | 600 | LYM777 | 86.3 | globlastp |
| eschscholzia\|11v1\|CK762799_P1 | 2842 | 7655 | 600 | LYM777 | 86.3 | globlastp |
| eucalyptus\|11v2\|CB967769_P1 | 2843 | 7656 | 600 | LYM777 | 86.3 | globlastp |
| eucalyptus\|11v2\|CT983080_P1 | 2844 | 7657 | 600 | LYM777 | 86.3 | globlastp |
| fagopyrum\|11v1\|SRR063689X111567_P1 | 2845 | 7658 | 600 | LYM777 | 86.3 | globlastp |
| fagopyrum\|11v1\|SRR063689X117747_P1 | 2846 | 7658 | 600 | LYM777 | 86.3 | globlastp |
| fagopyrum\|11v1\|SRR063703X111826_P1 | 2847 | 7658 | 600 | LYM777 | 86.3 | globlastp |
| ginseng\|10v1\|CN847189_P1 | 2848 | 7659 | 600 | LYM777 | 86.3 | globlastp |
| guizotia\|10v1\|GE554040_P1 | 2849 | 7660 | 600 | LYM777 | 86.3 | globlastp |
| ipomoea_batatas\|10v1\|BU690276_P1 | 2850 | 7661 | 600 | LYM777 | 86.3 | globlastp |
| ipomoea_nil\|10v1\|BJ558303_P1 | 2851 | 7662 | 600 | LYM777 | 86.3 | globlastp |
| kiwi\|gb166\|FG413563_P1 | 2852 | 7663 | 600 | LYM777 | 86.3 | globlastp |
| liquorice\|gb171\|ES346844_P1 | 2853 | 7664 | 600 | LYM777 | 86.3 | globlastp |
| nasturtium\|11v1\|GH167171_P1 | 2854 | 7665 | 600 | LYM777 | 86.3 | globlastp |
| nicotiana_benthamiana\|gb162\|CN744357_P1 | 2855 | 7666 | 600 | LYM777 | 86.3 | globlastp |
| oil_palm\|11v1\|ES370890_P1 | 2856 | 7667 | 600 | LYM777 | 86.3 | globlastp |
| papaya\|gb165\|EX293747_P1 | 2857 | 7668 | 600 | LYM777 | 86.3 | globlastp |
| peanut\|10v1\|CD037512_P1 | 2858 | 7669 | 600 | LYM777 | 86.3 | globlastp |
| peanut\|10v1\|EE124857_P1 | 2859 | 7669 | 600 | LYM777 | 86.3 | globlastp |
| pea\|11v1\|EX568887_P1 | 2860 | 7670 | 600 | LYM777 | 86.3 | globlastp |
| phyla\|11v2\|SRR099037X101043_P1 | 2861 | 7671 | 600 | LYM777 | 86.3 | globlastp |
| podocarpus\|10v1\|SRR065014S0003464_P1 | 2862 | 7672 | 600 | LYM777 | 86.3 | globlastp |
| poppy\|11v1\|SRR030259.103383_P1 | 2863 | 7673 | 600 | LYM777 | 86.3 | globlastp |
| salvia\|10v1\|FE537089 | 2864 | 7674 | 600 | LYM777 | 86.3 | globlastp |
| salvia\|10v1\|SRR014553S0003324 | 2865 | 7674 | 600 | LYM777 | 86.3 | globlastp |
| scabiosa\|11v1\|SRR063723X100215 | 2866 | 7675 | 600 | LYM777 | 86.3 | globlastp |
| senecio\|gb170\|DY659590 | 2867 | 7676 | 600 | LYM777 | 86.3 | globlastp |
| senecio\|gb170\|DY661719 | 2868 | 7676 | 600 | LYM777 | 86.3 | globlastp |
| sequoia\|10v1\|SRR065044S0003584 | 2869 | 7677 | 600 | LYM777 | 86.3 | globlastp |
| soybean\|11v1\|GLYMA04G33900 | 2870 | 7642 | 600 | LYM777 | 86.3 | globlastp |
| soybean\|11v1\|GLYMA06G20540 | 2871 | 7642 | 600 | LYM777 | 86.3 | globlastp |
| tea\|10v1\|GE653030 | 2872 | 7678 | 600 | LYM777 | 86.3 | globlastp |
| tobacco\|gb162\|CV020582 | 2873 | 7679 | 600 | LYM777 | 86.3 | globlastp |
| tripterygium\|11v1\|SRR098677X100480 | 2874 | 7680 | 600 | LYM777 | 86.3 | globlastp |
| bupleurum\|11v1\|FG341964_T1 | 2875 | 7681 | 600 | LYM777 | 86.29 | glotblastn |
| epimedium\|11v1\|SRR013502.11733_T1 | 2876 | 7682 | 600 | LYM777 | 86.29 | glotblastn |
| guizotia\|10v1\|GE553151_T1 | 2877 | 7683 | 600 | LYM777 | 86.29 | glotblastn |
| phyla\|11v2\|SRR099037X110195_T1 | 2878 | 7684 | 600 | LYM777 | 86.29 | glotblastn |
| blueberry\|12v1\|CF810492_T1 | 2879 | 7685 | 600 | LYM777 | 86.29 | glotblastn |
| barley\|10v2\|BE421083 | 2880 | 7686 | 600 | LYM777 | 86.2 | globlastp |
| barley\|12v1\|BE421083_P1 | 2881 | 7686 | 600 | LYM777 | 86.2 | globlastp |
| cirsium\|11v1\|SRR349641.1010279_P1 | 2882 | 7687 | 600 | LYM777 | 86.2 | globlastp |
| leymus\|gb166\|EG398520_P1 | 2883 | 7688 | 600 | LYM777 | 86.2 | globlastp |
| clover\|gb162\|BB911949_P1 | 2884 | 7689 | 600 | LYM777 | 85.9 | globlastp |
| aquilegia\|10v2\|DR925733_P1 | 2885 | 7690 | 600 | LYM777 | 85.8 | globlastp |
| aquilegia\|10v2\|DT730818_P1 | 2886 | 7690 | 600 | LYM777 | 85.8 | globlastp |
| aquilegia\|10v2\|DT733559_P1 | 2887 | 7690 | 600 | LYM777 | 85.8 | globlastp |
| ambrosia\|11v1\|SRR346943.150670_P1 | 2888 | 7691 | 600 | LYM777 | 85.8 | globlastp |
| aquilegia\|10v1\|DR925733 | 2889 | 7690 | 600 | LYM777 | 85.8 | globlastp |
| aquilegia\|10v1\|DT730818 | 2890 | 7690 | 600 | LYM777 | 85.8 | globlastp |
| aquilegia\|10v1\|DT733559 | 2891 | 7690 | 600 | LYM777 | 85.8 | globlastp |
| cedrus\|11v1\|SRR065007X10886_P1 | 2892 | 7692 | 600 | LYM777 | 85.8 | globlastp |
| centaurea\|gb166\|EH726865_P1 | 2893 | 7693 | 600 | LYM777 | 85.8 | globlastp |
| chelidonium\|11v1\|SRR084752X124430_P1 | 2894 | 7694 | 600 | LYM777 | 85.8 | globlastp |
| chickpea\|11v1\|FE672029XX1_P1 | 2895 | 7695 | 600 | LYM777 | 85.8 | globlastp |
| chickpea\|11v1\|GR390925XX1_P1 | 2896 | 7695 | 600 | LYM777 | 85.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| cycas\|gb166\|CB090535_P1 | 2897 | 7696 | 600 | LYM777 | 85.8 | globlastp |
| ginseng\|10v1\|DV553793_P1 | 2898 | 7697 | 600 | LYM777 | 85.8 | globlastp |
| gnetum\|10v1\|DN954227_P1 | 2899 | 7698 | 600 | LYM777 | 85.8 | globlastp |
| grape\|11v1\|GSVIVT01008028001_P1 | 2900 | 7699 | 600 | LYM777 | 85.8 | globlastp |
| grape\|11v1\|GSVIVT01011384001_P1 | 2901 | 7699 | 600 | LYM777 | 85.8 | globlastp |
| lotus\|09v1\|AI967787_P1 | 2902 | 7700 | 600 | LYM777 | 85.8 | globlastp |
| maritime_pine\|10v1\|BX250654_P1 | 2903 | 7701 | 600 | LYM777 | 85.8 | globlastp |
| nasturtium\|11v1\|GH170441_P1 | 2904 | 7702 | 600 | LYM777 | 85.8 | globlastp |
| papaya\|gb165\|AM903892_P1 | 2905 | 7703 | 600 | LYM777 | 85.8 | globlastp |
| pea\|11v1\|FG529719_P1 | 2906 | 7704 | 600 | LYM777 | 85.8 | globlastp |
| pine\|10v2\|AA556248_P1 | 2907 | 7701 | 600 | LYM777 | 85.8 | globlastp |
| pseudotsuga\|10v1\|SRR065119S0001632 | 2908 | 7705 | 600 | LYM777 | 85.8 | globlastp |
| spruce\|11v1\|ES227320 | 2909 | 7706 | 600 | LYM777 | 85.8 | globlastp |
| spruce\|11v1\|EX408237 | 2910 | 7706 | 600 | LYM777 | 85.8 | globlastp |
| spruce\|11v1\|SRR064180X18860 | 2911 | 7706 | 600 | LYM777 | 85.8 | globlastp |
| strawberry\|11v1\|CO817087 | 2912 | 7707 | 600 | LYM777 | 85.8 | globlastp |
| taxus\|10v1\|SRR032523S0001280 | 2913 | 7708 | 600 | LYM777 | 85.8 | globlastp |
| thalictrum\|11v1\|SRR096787X109792 | 2914 | 7690 | 600 | LYM777 | 85.8 | globlastp |
| blueberry\|12v1\|SRR353282X84330D1_T1 | 2915 | 7709 | 600 | LYM777 | 85.79 | glotblastn |
| fagopyrum\|11v1\|SRR063689X106359_T1 | 2916 | 7710 | 600 | LYM777 | 85.79 | glotblastn |
| walnuts\|gb166\|EL894777 | 2917 | 7711 | 600 | LYM777 | 85.79 | glotblastn |
| rye\|12v1\|BE637304_P1 | 2918 | 7712 | 600 | LYM777 | 85.6 | globlastp |
| rye\|12v1\|DRR001012.198391_P1 | 2919 | 7712 | 600 | LYM777 | 85.6 | globlastp |
| ginger\|gb164\|DY346765_P1 | 2920 | 7713 | 600 | LYM777 | 85.6 | globlastp |
| wheat\|10v2\|BE398436 | 2921 | 7714 | 600 | LYM777 | 85.6 | globlastp |
| wheat\|10v2\|BE401914 | 2922 | 7714 | 600 | LYM777 | 85.6 | globlastp |
| wheat\|10v2\|BE402195 | 2923 | 7714 | 600 | LYM777 | 85.6 | globlastp |
| wheat\|10v2\|BE406067 | 2924 | 7714 | 600 | LYM777 | 85.6 | globlastp |
| wheat\|12v3\|BE401914_P1 | 2925 | 7714 | 600 | LYM777 | 85.6 | globlastp |
| vinca\|11v1\|SRR098690X106565 | 2926 | 7715 | 600 | LYM777 | 85.4 | globlastp |
| medicago\|12v1\|AA660571_P1 | 2927 | 7716 | 600 | LYM777 | 85.3 | globlastp |
| medicago\|12v1\|AA660911_P1 | 2928 | 7716 | 600 | LYM777 | 85.3 | globlastp |
| medicago\|12v1\|AI974652_P1 | 2929 | 7716 | 600 | LYM777 | 85.3 | globlastp |
| rose\|12v1\|BI978243_P1 | 2930 | 7717 | 600 | LYM777 | 85.3 | globlastp |
| antirrhinum\|gb166\|AJ560096_P1 | 2931 | 7718 | 600 | LYM777 | 85.3 | globlastp |
| antirrhinum\|gb166\|AJ790229_P1 | 2932 | 7719 | 600 | LYM777 | 85.3 | globlastp |
| apple\|11v1\|CN489564_P1 | 2933 | 7720 | 600 | LYM777 | 85.3 | globlastp |
| apple\|11v1\|CN578889_P1 | 2934 | 7721 | 600 | LYM777 | 85.3 | globlastp |
| chestnut\|gb170\|SRR006295S0004828_P1 | 2935 | 7722 | 600 | LYM777 | 85.3 | globlastp |
| cirsium\|11v1\|SRR346952.615589_P1 | 2936 | 7723 | 600 | LYM777 | 85.3 | globlastp |
| citrus\|gb166\|BQ624060 | 2937 | 7724 | 600 | LYM777 | 85.3 | globlastp |
| citrus\|gb166\|BQ624843 | 2938 | 7724 | 600 | LYM777 | 85.3 | globlastp |
| clementine\|11v1\|BQ624060_P1 | 2939 | 7724 | 600 | LYM777 | 85.3 | globlastp |
| cleome_spinosa\|10v1\|GR934035_P1 | 2940 | 7725 | 600 | LYM777 | 85.3 | globlastp |
| grape\|11v1\|GSVIVT01020020001_P1 | 2941 | 7726 | 600 | LYM777 | 85.3 | globlastp |
| maritime_pine\|10v1\|AL750714_P1 | 2942 | 7727 | 600 | LYM777 | 85.3 | globlastp |
| monkeyflower\|10v1\|CV520014_P1 | 2943 | 7728 | 600 | LYM777 | 85.3 | globlastp |
| oak\|10v1\|DN950212_P1 | 2944 | 7722 | 600 | LYM777 | 85.3 | globlastp |
| phyla\|11v2\|SRR099035X122446_P1 | 2945 | 7729 | 600 | LYM777 | 85.3 | globlastp |
| phyla\|11v2\|SRR099037X108971_P1 | 2946 | 7730 | 600 | LYM777 | 85.3 | globlastp |
| pine\|10v2\|AI920134_P1 | 2947 | 7727 | 600 | LYM777 | 85.3 | globlastp |
| poppy\|11v1\|FE964854_P1 | 2948 | 7731 | 600 | LYM777 | 85.3 | globlastp |
| poppy\|11v1\|FE968072_P1 | 2949 | 7732 | 600 | LYM777 | 85.3 | globlastp |
| poppy\|11v1\|FE968166_P1 | 2950 | 7731 | 600 | LYM777 | 85.3 | globlastp |
| poppy\|11v1\|SRR030262.27366_P1 | 2951 | 7733 | 600 | LYM777 | 85.3 | globlastp |
| poppy\|11v1\|SRR033669.79945_P1 | 2952 | 7734 | 600 | LYM777 | 85.3 | globlastp |
| sequoia\|10v1\|SRR065044S0000489 | 2953 | 7735 | 600 | LYM777 | 85.3 | globlastp |
| trigonella\|11v1\|SRR066194X103144 | 2954 | 7716 | 600 | LYM777 | 85.3 | globlastp |
| trigonella\|11v1\|SRR066194X117573 | 2955 | 7716 | 600 | LYM777 | 85.3 | globlastp |
| tripterygium\|11v1\|SRR098677X101131 | 2956 | 7736 | 600 | LYM777 | 85.3 | globlastp |
| vinca\|11v1\|SRR098690X101676 | 2957 | 7737 | 600 | LYM777 | 85.3 | globlastp |
| vinca\|11v1\|SRR098690X101998 | 2958 | 7738 | 600 | LYM777 | 85.3 | globlastp |
| vinca\|11v1\|SRR098690X105301 | 2959 | 7738 | 600 | LYM777 | 85.3 | globlastp |
| vinca\|11v1\|SRR098690X111690 | 2960 | 7739 | 600 | LYM777 | 85.3 | globlastp |
| zamia\|gb166\|DT577188 | 2961 | 7740 | 600 | LYM777 | 85.3 | globlastp |
| ambrosia\|11v1\|SRR346943.318984_T1 | 2962 | 7741 | 600 | LYM777 | 85.28 | glotblastn |
| pteridium\|11v1\|SRR043594X126608 | 2963 | 7742 | 600 | LYM777 | 85.2 | globlastp |
| gnetum\|10v1\|SRR064399S0249023_T1 | 2964 | 7743 | 600 | LYM777 | 85.13 | glotblastn |
| abies\|11v2\|SRR098676X101018_P1 | 2965 | 7744 | 600 | LYM777 | 84.8 | globlastp |
| arabidopsis_lyrata\|09v1\|JGIAL027729_P1 | 2966 | 7745 | 600 | LYM777 | 84.8 | globlastp |
| arabidopsis\|10v1\|AT5G39850_P1 | 2967 | 7746 | 600 | LYM777 | 84.8 | globlastp |
| distylium\|11v1\|SRR065077X108817_P1 | 2968 | 7747 | 600 | LYM777 | 84.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| ginger\|gb164\|DY355106_P1 | 2969 | 7748 | 600 | LYM777 | 84.8 | globlastp |
| monkeyflower\|10v1\|DV206003_P1 | 2970 | 7749 | 600 | LYM777 | 84.8 | globlastp |
| nuphar\|gb166\|CD475637_P1 | 2971 | 7750 | 600 | LYM777 | 84.8 | globlastp |
| radish\|gb164\|Ev529227 | 2972 | 7751 | 600 | LYM777 | 84.8 | globlastp |
| rose\|10v1\|BI978243 | 2973 | 7752 | 600 | LYM777 | 84.8 | globlastp |
| sciadopitys\|10v1\|SRR065035S0002090 | 2974 | 7753 | 600 | LYM777 | 84.8 | globlastp |
| spikemoss\|gb165\|FE433480 | 2975 | 7754 | 600 | LYM777 | 84.8 | globlastp |
| spikemoss\|gb165\|FE454962 | 2976 | 7755 | 600 | LYM777 | 84.8 | globlastp |
| spruce\|11v1\|ES252138 | 2977 | 7756 | 600 | LYM777 | 84.8 | globlastp |
| spruce\|11v1\|EX331798 | 2978 | 7756 | 600 | LYM777 | 84.8 | globlastp |
| strawberry\|11v1\|SRR034879S0003574 | 2979 | 7757 | 600 | LYM777 | 84.8 | globlastp |
| tamarix\|gb166\|CF199742 | 2980 | 7758 | 600 | LYM777 | 84.8 | globlastp |
| thellungiella_halophilum\|11v1\|DN773381 | 2981 | 7759 | 600 | LYM777 | 84.8 | globlastp |
| thellungiella\|gb167\|DN773381 | 2982 | 7760 | 600 | LYM777 | 84.8 | globlastp |
| vinca\|11v1\|SRR098690X132279 | 2983 | 7761 | 600 | LYM777 | 84.8 | globlastp |
| sunflower\|12v1\|DY903965XX1_T1 | 2984 | 7762 | 600 | LYM777 | 84.77 | glotblastn |
| euphorbia\|11v1\|BG485808XX1_T1 | 2985 | 7763 | 600 | LYM777 | 84.77 | glotblastn |
| sunflower\|10v1\|DY903965 | 2986 | 7762 | 600 | LYM777 | 84.77 | glotblastn |
| thalictrum\|11v1\|SRR096787X107095 | 2987 | 7764 | 600 | LYM777 | 84.77 | glotblastn |
| onion\|12v1\|SRR073446X102462D1_T1 | 2988 | 7765 | 600 | LYM777 | 84.62 | glotblastn |
| ambrosia\|11v1\|SRR346935.214793_P1 | 2989 | 7766 | 600 | LYM777 | 84.6 | globlastp |
| beech\|11v1\|SRR006293.15173_P1 | 2990 | 7767 | 600 | LYM777 | 84.6 | globlastp |
| petunia\|gb171\|DY395577_P1 | 2991 | 7768 | 600 | LYM777 | 84.6 | globlastp |
| clover\|gb162\|BB916018_P1 | 2992 | 7769 | 600 | LYM777 | 84.4 | globlastp |
| flax\|11v1\|JG022936_P1 | 2993 | 7770 | 600 | LYM777 | 84.4 | globlastp |
| flax\|11v1\|JG082483_P1 | 2994 | 7770 | 600 | LYM777 | 84.4 | globlastp |
| medicago\|12v1\|AL376358_P1 | 2995 | 7771 | 600 | LYM777 | 84.3 | globlastp |
| medicago\|12v1\|BG580170_P1 | 2996 | 7772 | 600 | LYM777 | 84.3 | globlastp |
| b_oleracea\|gb161\|DY027590_P1 | 2997 | 7773 | 600 | LYM777 | 84.3 | globlastp |
| b_rapa\|11v1\|CD818887_P1 | 2998 | 7773 | 600 | LYM777 | 84.3 | globlastp |
| canola\|11v1\|CN725727_P1 | 2999 | 7773 | 600 | LYM777 | 84.3 | globlastp |
| canola\|11v1\|CN730300_P1 | 3000 | 7773 | 600 | LYM777 | 84.3 | globlastp |
| canola\|11v1\|CN734718XX2_P1 | 3001 | 7774 | 600 | LYM777 | 84.3 | globlastp |
| canola\|11v1\|EE472849_P1 | 3002 | 7774 | 600 | LYM777 | 84.3 | globlastp |
| cephalotaxus\|11v1\|SRR064395X103070_P1 | 3003 | 7775 | 600 | LYM777 | 84.3 | globlastp |
| chelidonium\|11v1\|SRR084752X100339_P1 | 3004 | 7776 | 600 | LYM777 | 84.3 | globlastp |
| cleome_spinosa\|10v1\|GR931453_P1 | 3005 | 7777 | 600 | LYM777 | 84.3 | globlastp |
| cleome_spinosa\|10v1\|GR932229_P1 | 3006 | 7778 | 600 | LYM777 | 84.3 | globlastp |
| fern\|gb171\|DK945058_P1 | 3007 | 7779 | 600 | LYM777 | 84.3 | globlastp |
| poppy\|11v1\|SRR096789.126787_P1 | 3008 | 7776 | 600 | LYM777 | 84.3 | globlastp |
| prunus\|10v1\|BU039470 | 3009 | 7780 | 600 | LYM777 | 84.3 | globlastp |
| pteridium\|11v1\|SRR043594X105884 | 3010 | 7781 | 600 | LYM777 | 84.3 | globlastp |
| sciadopitys\|10v1\|SRR065035S0025348 | 3011 | 7782 | 600 | LYM777 | 84.3 | globlastp |
| cyamopsis\|10v1\|EG978163_T1 | 3012 | 7783 | 600 | LYM777 | 84.26 | glotblastn |
| canola\|11v1\|CN733164XX2_T1 | 3013 | 7784 | 600 | LYM777 | 84.18 | glotblastn |
| rye\|12v1\|DRR001012.100561_T1 | 3014 | 7785 | 600 | LYM777 | 84.1 | glotblastn |
| gerbera\|09v1\|AJ752954_P1 | 3015 | 7786 | 600 | LYM777 | 84.1 | globlastp |
| epimedium\|11v1\|SRR013502.1401_P1 | 3016 | 7787 | 600 | LYM777 | 83.9 | globlastp |
| arnica\|11v1\|SRR099034X10528_P1 | 3017 | 7788 | 600 | LYM777 | 83.9 | globlastp |
| pteridium\|11v1\|SRR043594X100991 | 3018 | 7789 | 600 | LYM777 | 83.9 | globlastp |
| cleome_spinosa\|10v1\|SRR015531S0014057_P1 | 3019 | 7790 | 600 | LYM777 | 83.8 | globlastp |
| pteridium\|11v1\|SRR043594X103155 | 3020 | 7791 | 600 | LYM777 | 83.8 | globlastp |
| zostera\|10v1\|AM767975 | 3021 | 7792 | 600 | LYM777 | 83.8 | globlastp |
| zostera\|10v1\|SRR057351S0020635 | 3022 | 7792 | 600 | LYM777 | 83.8 | globlastp |
| b_juncea\|12v1\|E6ANDIZ01C0BLU_P1 | 3023 | 7793 | 600 | LYM777 | 83.8 | globlastp |
| medicago\|12v1\|CO515506_T1 | 3024 | 7794 | 600 | LYM777 | 83.76 | glotblastn |
| euonymus\|11v1\|SRR070038X100454_P1 | 3025 | 7795 | 600 | LYM777 | 83.4 | globlastp |
| euonymus\|11v1\|SRR070038X103243_P1 | 3026 | 7796 | 600 | LYM777 | 83.4 | globlastp |
| b_juncea\|10v2\|E6ANDIZ01C0BLU | 3027 | 7797 | 600 | LYM777 | 83.3 | globlastp |
| cannabis\|12v1\|JK501848_T1 | 3028 | 7798 | 600 | LYM777 | 83.25 | glotblastn |
| amorphophallus\|11v2\|SRR089351X100607_P1 | 3029 | 7799 | 600 | LYM777 | 83.2 | globlastp |
| amorphophallus\|11v2\|SRR089351X104494_P1 | 3030 | 7800 | 600 | LYM777 | 83.2 | globlastp |
| amorphophallus\|11v2\|SRR089351X123595_P1 | 3031 | 7801 | 600 | LYM777 | 83.2 | globlastp |
| blueberry\|10v1\|CF810492 | 3032 | 7802 | 600 | LYM777 | 83.2 | globlastp |
| petunia\|gb171\|DC241003_T1 | 3033 | 7803 | 600 | LYM777 | 83.08 | glotblastn |
| utricularia\|11v1\|SRR094438.117219 | 3034 | 7804 | 600 | LYM777 | 83 | globlastp |
| ceratodon\|10v1\|AW098657_P1 | 3035 | 7805 | 600 | LYM777 | 82.9 | globlastp |
| ceratodon\|10v1\|SRR074890S0036498_P1 | 3036 | 7806 | 600 | LYM777 | 82.9 | globlastp |
| euonymus\|11v1\|SRR070038X100309_P1 | 3037 | 7807 | 600 | LYM777 | 82.9 | globlastp |
| euonymus\|11v1\|SRR070038X103772_P1 | 3038 | 7807 | 600 | LYM777 | 82.9 | globlastp |
| physcomitrella\|10v1\|AW497210_P1 | 3039 | 7808 | 600 | LYM777 | 82.8 | globlastp |
| cannabis\|12v1\|SOLX00009251_T1 | 3040 | 7809 | 600 | LYM777 | 82.74 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| physcomitrella\|10v1\|AW496847_P1 | 3041 | 7810 | 600 | LYM777 | 82.4 | globlastp |
| physcomitrella\|10v1\|AW598858_P1 | 3042 | 7810 | 600 | LYM777 | 82.4 | globlastp |
| ambrosia\|11v1\|SRR346935.153383_P1 | 3043 | 7811 | 600 | LYM777 | 82.2 | globlastp |
| cassava\|09v1\|BM259675_P1 | 3044 | 7812 | 600 | LYM777 | 82.2 | globlastp |
| orobanche\|10v1\|SRR023189S0022853_P1 | 3045 | 7813 | 600 | LYM777 | 82.2 | globlastp |
| papaya\|gb165\|EX260746_P1 | 3046 | 7814 | 600 | LYM777 | 82.2 | globlastp |
| physcomitrella\|10v1\|AW145623_P1 | 3047 | 7815 | 600 | LYM777 | 82.2 | globlastp |
| plantago\|11v2\|SRR066373X100005_P1 | 3048 | 7816 | 600 | LYM777 | 82.2 | globlastp |
| euphorbia\|11v1\|BP960862_P1 | 3049 | 7817 | 600 | LYM777 | 82.1 | globlastp |
| sorghum\|11v1\|SB01G033980 | 3050 | 7818 | 600 | LYM777 | 82.1 | globlastp |
| sorghum\|12v1\|SB01G033980_P1 | 3051 | 7818 | 600 | LYM777 | 82.1 | globlastp |
| rye\|12v1\|DRR001012.522771_T1 | 3052 | 7819 | 600 | LYM777 | 82.05 | glotblastn |
| distylium\|11v1\|SRR065077X103011_P1 | 3053 | 7820 | 600 | LYM777 | 82 | globlastp |
| primula\|11v1\|SRR098679X102129_P1 | 3054 | 7821 | 600 | LYM777 | 82 | globlastp |
| physcomitrella\|10v1\|BI437235_P1 | 3055 | 7822 | 600 | LYM777 | 81.9 | globlastp |
| marchantia\|gb166\|C95745_P1 | 3056 | 7823 | 600 | LYM777 | 81.8 | globlastp |
| pigeonpea\|11v1\|GR472687_T1 | 3057 | 7824 | 600 | LYM777 | 81.73 | glotblastn |
| flax\|11v1\|JG019785_P1 | 3058 | 7825 | 600 | LYM777 | 81.6 | globlastp |
| chestnut\|gb170\|SRR006295S0004248_P1 | 3059 | 7826 | 600 | LYM777 | 81.5 | globlastp |
| euphorbia\|11v1\|BE095299_P1 | 3060 | 7827 | 600 | LYM777 | 81.5 | globlastp |
| parthenium\|10v1\|GW780836_P1 | 3061 | 7828 | 600 | LYM777 | 81.5 | globlastp |
| physcomitrella\|10v1\|BQ826796_P1 | 3062 | 7829 | 600 | LYM777 | 81.3 | globlastp |
| thellungiella_halophilum\|11v1\|BY813513 | 3063 | 7830 | 600 | LYM777 | 81.3 | globlastp |
| thellungiella\|gb167\|BY813513 | 3064 | 7830 | 600 | LYM777 | 81.3 | globlastp |
| rice\|11v1\|AA752935 | 3065 | 7831 | 600 | LYM777 | 81.12 | glotblastn |
| wheat\|10v2\|CD491175 | 3066 | 7832 | 600 | LYM777 | 81 | globlastp |
| wheat\|12v3\|CD491175_P1 | 3067 | 7832 | 600 | LYM777 | 81 | globlastp |
| canola\|11v1\|SRR329661.11080_T1 | 3068 | 7833 | 600 | LYM777 | 80.9 | glotblastn |
| arabidopsis\|10v1\|AT5G15200_P1 | 3069 | 7834 | 600 | LYM777 | 80.8 | globlastp |
| marchantia\|gb166\|BJ840552_P1 | 3070 | 7835 | 600 | LYM777 | 80.8 | globlastp |
| thellungiella_parvulum\|11v1\|DN773381 | 3071 | 7836 | 600 | LYM777 | 80.71 | glotblastn |
| orobanche\|10v1\|SRR023189S0002179_P1 | 3072 | 7837 | 600 | LYM777 | 80.7 | globlastp |
| ambrosia\|11v1\|SRR346947.118166_P1 | 3073 | 7838 | 600 | LYM777 | 80.5 | globlastp |
| salvia\|10v1\|SRR014553S0002550 | 3074 | 7839 | 600 | LYM777 | 80.5 | globlastp |
| spurge\|gb161\|BE095299 | 3075 | 7840 | 600 | LYM777 | 80.5 | globlastp |
| arabidopsis_lyrata\|09v1\|JGIAL021216_P1 | 3076 | 7841 | 600 | LYM777 | 80.3 | globlastp |
| b_juncea\|12v1\|E6ANDIZ01A6IMQ_T1 | 3077 | 7842 | 600 | LYM777 | 80.2 | glotblastn |
| b_nigra\|09v1\|GT069264_T1 | 3078 | 7843 | 600 | LYM777 | 80 | glotblastn |
| canola\|11v1\|SRR341921.460279_P1 | 3079 | 7844 | 600 | LYM777 | 80 | globlastp |
| chlamydomonas\|gb162\|AI625918_P1 | 3080 | 7844 | 600 | LYM777 | 80 | globlastp |
| cirsium\|11v1\|SRR346952.1009768_P1 | 3081 | 7845 | 600 | LYM777 | 80 | globlastp |
| jatropha\|09v1\|FM891131_P1 | 3082 | 7846 | 600 | LYM777 | 80 | globlastp |
| primula\|11v1\|SRR098679X100782_P1 | 3083 | 7847 | 600 | LYM777 | 80 | globlastp |
| volvox\|gb162\|AI625918 | 3084 | 7848 | 600 | LYM777 | 80 | globlastp |
| sorghum\|11v1\|SB03G021860 | 3085 | 7849 | 601 | LYM778 | 94.6 | globlastp |
| sorghum\|12v1\|SB03G021860_P1 | 3086 | 7849 | 601 | LYM778 | 94.6 | globlastp |
| maize\|10v1\|AW360619_P1 | 3087 | 7850 | 601 | LYM778 | 93.4 | globlastp |
| rice\|11v1\|CA757090 | 3088 | 7851 | 601 | LYM778 | 91.7 | globlastp |
| brachypodium\|12v1\|BRADI2G13800_P1 | 3089 | 7852 | 601 | LYM778 | 88.3 | globlastp |
| wheat\|12v3\|CA704960_P1 | 3090 | 7853 | 601 | LYM778 | 84.4 | globlastp |
| millet\|10v1\|EVO454PM013036_P1 | 3091 | 7854 | 602 | LYM779 | 91.6 | globlastp |
| switchgrass\|gb167\|FL728306 | 3092 | 7855 | 602 | LYM779 | 81.1 | globlastp |
| switchgrass\|gb167\|FL871212 | 3093 | 7856 | 602 | LYM779 | 80.9 | globlastp |
| sorghum\|11v1\|SB03G010100 | 3094 | 7857 | 602 | LYM779 | 80.9 | globlastp |
| sorghum\|11v1\|SB03G010100 | 3094 | 7857 | 881 | LYM814 | 83 | globlastp |
| sorghum\|12v1\|SB03G010100_P1 | 3095 | 7857 | 602 | LYM779 | 80.9 | globlastp |
| sorghum\|12v1\|SB03G010100_P1 | 3095 | 7857 | 881 | LYM814 | 83 | globlastp |
| sugarcane\|10v1\|CA128909 | 3096 | 7858 | 602 | LYM779 | 80 | globlastp |
| sugarcane\|10v1\|CA128909 | 3096 | 7858 | 881 | LYM814 | 83.2 | globlastp |
| foxtail_millet\|11v3\|SICRP046665_P1 | 3097 | 7859 | 603 | LYM780 | 96.7 | globlastp |
| maize\|10v1\|CD982330_T1 | 3098 | 7860 | 603 | LYM780 | 89.57 | glotblastn |
| sorghum\|11v1\|SB10G009410 | 3099 | 7861 | 603 | LYM780 | 88.4 | globlastp |
| sorghum\|11v1\|SBCRP015042 | 3100 | 7861 | 603 | LYM780 | 88.4 | globlastp |
| sorghum\|12v1\|SB10G009410_P1 | 3101 | 7861 | 603 | LYM780 | 88.4 | globlastp |
| rice\|11v1\|CB638518 | 3102 | 7862 | 603 | LYM780 | 80.7 | globlastp |
| rice\|11v1\|CI436829 | 3103 | 7863 | 603 | LYM780 | 80.3 | globlastp |
| switchgrass\|gb167\|FL731517 | 3104 | 7864 | 604 | LYM781 | 88.95 | glotblastn |
| sugarcane\|10v1\|AA577630 | 3105 | 7865 | 604 | LYM781 | 88.6 | globlastp |
| sorghum\|11v1\|SB10G019640 | 3106 | 7866 | 604 | LYM781 | 88.5 | globlastp |
| sorghum\|12v1\|SB10G019640_P1 | 3107 | 7866 | 604 | LYM781 | 88.5 | globlastp |
| maize\|10v1\|CF624353_P1 | 3108 | 7867 | 604 | LYM781 | 85.1 | globlastp |
| foxtail_millet\|11v3\|EC612146_P1 | 3109 | 7868 | 604 | LYM781 | 84.1 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sugarcane\|10v1\|CA066089 | 3110 | 7869 | 604 | LYM781 | 83.2 | globlastp |
| sorghum\|11v1\|SB04G000290 | 3111 | 7870 | 604 | LYM781 | 83.1 | globlastp |
| sorghum\|12v1\|SB04G000290_P1 | 3112 | 7870 | 604 | LYM781 | 83.1 | globlastp |
| brachypodium\|12v1\|BRADI3G00280_P1 | 3113 | 7871 | 604 | LYM781 | 80.7 | globlastp |
| brachypodium\|12v1\|BRADI3G00280_P1 | 3113 | 7871 | 929 | LYM1005 | 87.5 | globlastp |
| brachypodium\|09v1\|DV484334 | 3114 | 7871 | 604 | LYM781 | 80.7 | globlastp |
| brachypodium\|09v1\|DV484334 | 3114 | 7871 | 929 | LYM1005 | 87.5 | globlastp |
| maize\|10v1\|AI979449_P1 | 3115 | 7872 | 606 | LYM783 | 86.1 | globlastp |
| barley\|10v2\|BE195278 | 3116 | 7873 | 606 | LYM783 | 85.5 | globlastp |
| barley\|12v1\|BE195278_P1 | 3117 | 7873 | 606 | LYM783 | 85.5 | globlastp |
| sorghum\|11v1\|SB04G031230 | 3118 | 7874 | 606 | LYM783 | 85.3 | globlastp |
| sorghum\|12v1\|SB04G031230_P1 | 3119 | 7874 | 606 | LYM783 | 85.3 | globlastp |
| wheat\|10v2\|BG274229 | 3120 | 7875 | 606 | LYM783 | 84.3 | globlastp |
| wheat\|12v3\|AL818157_T1 | 3121 | 7876 | 606 | LYM783 | 83.94 | glotblastn |
| millet\|10v1\|PMSLX0035025_T1 | 3122 | 7877 | 606 | LYM783 | 83.27 | glotblastn |
| rice\|11v1\|AU031193 | 3123 | 7878 | 606 | LYM783 | 83.27 | glotblastn |
| maize\|10v1\|CF003094_T1 | 3124 | 7879 | 606 | LYM783 | 83.07 | glotblastn |
| brachypodium\|12v1\|BRADI3G52170_T1 | 3125 | 7880 | 606 | LYM783 | 81.42 | glotblastn |
| brachypodium\|09v1\|SRR031795S0028260 | 3126 | 7880 | 606 | LYM783 | 81.42 | glotblastn |
| oat\|11v1\|GR330363_P1 | 3127 | 7881 | 606 | LYM783 | 80.8 | globlastp |
| millet\|10v1\|EVO454PM104438_T1 | 3128 | 7882 | 607 | LYM784 | 84.95 | glotblastn |
| cenchrus\|gb166\|EB659717_P1 | 3129 | 7883 | 607 | LYM784 | 84.7 | globlastp |
| foxtail_millet\|11v3\|SOLX00025495_P1 | 3130 | 7884 | 609 | LYM786 | 93.1 | globlastp |
| sorghum\|11v1\|SB09G019325 | 3131 | 7885 | 609 | LYM786 | 90.05 | glotblastn |
| sorghum\|12v1\|SB09G019325_T1 | 3132 | 7885 | 609 | LYM786 | 90.05 | glotblastn |
| sugarcane\|10v1\|CA069749 | 3133 | 7886 | 609 | LYM786 | 88.9 | globlastp |
| sorghum\|11v1\|CF480564 | 3134 | 7885 | 609 | LYM786 | 85.05 | glotblastn |
| maize\|10v1\|CD944789_P1 | 3135 | 7887 | 609 | LYM786 | 82.7 | globlastp |
| rice\|11v1\|AU032853 | 3136 | 7888 | 609 | LYM786 | 82.1 | globlastp |
| rice\|11v1\|AU064307 | 3137 | 7888 | 609 | LYM786 | 82.1 | globlastp |
| foxtail_millet\|11v3\|PHY7SI026222M_P1 | 3138 | 7889 | 612 | LYM789 | 97.7 | globlastp |
| sorghum\|11v1\|SB05G016730 | 3139 | 7890 | 612 | LYM789 | 96.7 | globlastp |
| sorghum\|12v1\|SB05G016730_P1 | 3140 | 7890 | 612 | LYM789 | 96.7 | globlastp |
| sugarcane\|10v1\|CA066535 | 3141 | 7891 | 612 | LYM789 | 96.7 | globlastp |
| millet\|10v1\|EVO454PM027066_T1 | 3142 | 7892 | 612 | LYM789 | 96.55 | glotblastn |
| maize\|10v1\|AI901650_P1 | 3143 | 7893 | 612 | LYM789 | 95 | globlastp |
| millet\|10v1\|EVO454PM005996_P1 | 3144 | 7894 | 612 | LYM789 | 92.1 | globlastp |
| rice\|11v1\|BM038723 | 3145 | 7895 | 612 | LYM789 | 91.4 | globlastp |
| maize\|10v1\|AW330658_P1 | 3146 | 7896 | 612 | LYM789 | 91.2 | globlastp |
| oat\|11v1\|GO593181_P1 | 3147 | 7897 | 612 | LYM789 | 89.1 | globlastp |
| switchgrass\|gb167\|DN143413 | 3148 | 7898 | 612 | LYM789 | 87.3 | globlastp |
| brachypodium\|12v1\|BRADI4G07810_P1 | 3149 | 7899 | 612 | LYM789 | 84.9 | globlastp |
| brachypodium\|09v1\|GT804793 | 3150 | 7899 | 612 | LYM789 | 84.9 | globlastp |
| rice\|11v1\|CB631895 | 3151 | 7900 | 612 | LYM789 | 84.6 | globlastp |
| wheat\|12v3\|BE445268_P1 | 3152 | 7901 | 612 | LYM789 | 83.5 | globlastp |
| wheat\|10v2\|BE416403 | 3153 | 7902 | 612 | LYM789 | 83.5 | globlastp |
| wheat\|12v3\|BE416403_T1 | 3154 | 7903 | 612 | LYM789 | 83.11 | glotblastn |
| millet\|10v1\|CD726254_P1 | 3155 | 7904 | 613 | LYM790 | 98.9 | globlastp |
| millet\|10v1\|CD726199_P1 | 3156 | 7904 | 613 | LYM790 | 98.9 | globlastp |
| millet\|10v1\|EVO454PM006718_P1 | 3157 | 7904 | 613 | LYM790 | 98.9 | globlastp |
| sorghum\|11v1\|SB02G009810 | 3158 | 7904 | 613 | LYM790 | 98.9 | globlastp |
| sorghum\|12v1\|SB02G009810_P1 | 3159 | 7904 | 613 | LYM790 | 98.9 | globlastp |
| sorghum\|11v1\|SB08G018650 | 3160 | 7904 | 613 | LYM790 | 98.9 | globlastp |
| sugarcane\|10v1\|CA117141 | 3161 | 7904 | 613 | LYM790 | 98.9 | globlastp |
| sorghum\|12v1\|SB08G018650_P1 | 3162 | 7904 | 613 | LYM790 | 98.9 | globlastp |
| sorghum\|12v1\|BG557371_T1 | 3163 | 7905 | 613 | LYM790 | 98.47 | glotblastn |
| sorghum\|11v1\|BG557371 | 3164 | 7906 | 613 | LYM790 | 98.47 | glotblastn |
| maize\|10v1\|AI615004_P1 | 3165 | 7907 | 613 | LYM790 | 98.1 | globlastp |
| maize\|10v1\|AI746071_P1 | 3166 | 7908 | 613 | LYM790 | 98.1 | globlastp |
| maize\|10v1\|AW129820_P1 | 3167 | 7907 | 613 | LYM790 | 98.1 | globlastp |
| rice\|11v1\|AA754060 | 3168 | 7909 | 613 | LYM790 | 97.3 | globlastp |
| brachypodium\|12v1\|BRADI4G04120T2_P1 | 3169 | 7910 | 613 | LYM790 | 96.6 | globlastp |
| brachypodium\|09v1\|DV469173 | 3170 | 7910 | 613 | LYM790 | 96.6 | globlastp |
| oat\|11v1\|CN814953_P1 | 3171 | 7911 | 613 | LYM790 | 96.6 | globlastp |
| rye\|12v1\|BE493970_P1 | 3172 | 7912 | 613 | LYM790 | 96.2 | globlastp |
| barley\|10v2\|BE421834XX2 | 3173 | 7912 | 613 | LYM790 | 96.2 | globlastp |
| barley\|12v1\|BE421834_P1 | 3174 | 7912 | 613 | LYM790 | 96.2 | globlastp |
| leymus\|gb166\|EG376336_P1 | 3175 | 7912 | 613 | LYM790 | 96.2 | globlastp |
| pseudoroegneria\|gb167\|FF343855 | 3176 | 7912 | 613 | LYM790 | 96.2 | globlastp |
| rye\|gb164\|BE493970 | 3177 | 7912 | 613 | LYM790 | 96.2 | globlastp |
| wheat\|10v2\|BE413912 | 3178 | 7912 | 613 | LYM790 | 96.2 | globlastp |
| wheat\|10v2\|BE423191 | 3179 | 7912 | 613 | LYM790 | 96.2 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
| --- | --- | --- | --- | --- | --- | --- |
| wheat\|12v3\|BE399395_P1 | 3180 | 7912 | 613 | LYM790 | 96.2 | globlastp |
| grape\|11v1\|BQ792471_P1 | 3181 | 7913 | 613 | LYM790 | 94.6 | globlastp |
| cowpea\|12v1\|FC460195_P1 | 3182 | 7914 | 613 | LYM790 | 94.3 | globlastp |
| cowpea\|12v1\|FC458027_P1 | 3183 | 7915 | 613 | LYM790 | 94.3 | globlastp |
| cowpea\|gb166\|FC458027 | 3184 | 7915 | 613 | LYM790 | 94.3 | globlastp |
| kiwi\|gb166\|FG413559_P1 | 3185 | 7916 | 613 | LYM790 | 93.9 | globlastp |
| pigeonpea\|11v1\|GW347592_P1 | 3186 | 7917 | 613 | LYM790 | 93.9 | globlastp |
| castorbean\|11v1\|T15018_P1 | 3187 | 7918 | 613 | LYM790 | 93.5 | globlastp |
| cotton\|11v1\|DT558029_P1 | 3188 | 7919 | 613 | LYM790 | 93.5 | globlastp |
| cowpea\|12v1\|FF383674_P1 | 3189 | 7920 | 613 | LYM790 | 93.5 | globlastp |
| cowpea\|gb166\|FF383674 | 3190 | 7920 | 613 | LYM790 | 93.5 | globlastp |
| cowpea\|12v1\|FF384724_P1 | 3191 | 7920 | 613 | LYM790 | 93.5 | globlastp |
| cowpea\|gb166\|FF384724 | 3192 | 7920 | 613 | LYM790 | 93.5 | globlastp |
| grape\|11v1\|EC933375_P1 | 3193 | 7921 | 613 | LYM790 | 93.5 | globlastp |
| grape\|11v1\|GSVIVT01014552001_P1 | 3194 | 7922 | 613 | LYM790 | 93.5 | globlastp |
| liquorice\|gb171\|FS240766_P1 | 3195 | 7923 | 613 | LYM790 | 93.5 | globlastp |
| peanut\|10v1\|ES702975_P1 | 3196 | 7924 | 613 | LYM790 | 93.5 | globlastp |
| petunia\|gb1v1\|CV296260_P1 | 3197 | 7925 | 613 | LYM790 | 93.5 | globlastp |
| utricularia\|11v1\|SRR094438.103234 | 3198 | 7926 | 613 | LYM790 | 93.5 | globlastp |
| pigeonpea\|11v1\|CCIIPG11036695_T1 | 3199 | 7927 | 613 | LYM790 | 93.49 | glotblastn |
| aquilegia\|10v2\|JGIAC000537_P1 | 3200 | 7928 | 613 | LYM790 | 93.1 | globlastp |
| banana\|12v1\|MAGEN2012016220_P1 | 3201 | 7929 | 613 | LYM790 | 93.1 | globlastp |
| bean\|12v1\|CA897709_P1 | 3202 | 7930 | 613 | LYM790 | 93.1 | globlastp |
| bean\|12v1\|CA897714_P1 | 3203 | 7930 | 613 | LYM790 | 93.1 | globlastp |
| medicago\|12v1\|AA661052_P1 | 3204 | 7931 | 613 | LYM790 | 93.1 | globlastp |
| aristolochia\|10v1\|SRR039084S0114267_P1 | 3205 | 7932 | 613 | LYM790 | 93.1 | globlastp |
| bean\|gb167\|CA897714 | 3206 | 7933 | 613 | LYM790 | 93.1 | globlastp |
| bean\|gb167\|CA904273 | 3207 | 7934 | 613 | LYM790 | 93.1 | globlastp |
| bean\|gb167\|CV531340 | 3208 | 7930 | 613 | LYM790 | 93.1 | globlastp |
| beech\|11v1\|SRR006293.10047_P1 | 3209 | 7935 | 613 | LYM790 | 93.1 | globlastp |
| cassava\|09v1\|CK646892_P1 | 3210 | 7936 | 613 | LYM790 | 93.1 | globlastp |
| castorbean\|11v1\|T15072_P1 | 3211 | 7937 | 613 | LYM790 | 93.1 | globlastp |
| cyamopsis\|10v1\|EG975130_P1 | 3212 | 7938 | 613 | LYM790 | 93.1 | globlastp |
| eschscholzia\|11v1\|CD477769_P1 | 3213 | 7939 | 613 | LYM790 | 93.1 | globlastp |
| eschscholzia\|11v1\|CK767112_P1 | 3214 | 7939 | 613 | LYM790 | 93.1 | globlastp |
| grape\|11v1\|VVPRD012633_T1 | 3215 | 7940 | 613 | LYM790 | 93.1 | glotblastn |
| petunia\|gb1v1\|CV296466_P1 | 3216 | 7941 | 613 | LYM790 | 93.1 | globlastp |
| pigeonpea\|11v1\|SRR054580X113345_P1 | 3217 | 7942 | 613 | LYM790 | 93.1 | globlastp |
| potato\|10v1\|BF153884_P1 | 3218 | 7943 | 613 | LYM790 | 93.1 | globlastp |
| solanum_phureja\|09v1\|SPHBG128024 | 3219 | 7943 | 613 | LYM790 | 93.1 | globlastp |
| soybean\|11v1\|GLYMA02G05540 | 3220 | 7944 | 613 | LYM790 | 93.1 | globlastp |
| soybean\|11v1\|GLYMA11G08050 | 3221 | 7945 | 613 | LYM790 | 93.1 | globlastp |
| soybean\|11v1\|GLYMA16G24120 | 3222 | 7944 | 613 | LYM790 | 93.1 | globlastp |
| tobacco\|gb162\|AF156372 | 3223 | 7946 | 613 | LYM790 | 93.1 | glotblastn |
| tobacco\|gb162\|EB446296 | 3224 | 7947 | 613 | LYM790 | 93.1 | globlastp |
| tomato\|11v1\|BG125029 | 3225 | 7947 | 613 | LYM790 | 93.1 | globlastp |
| tomato\|11v1\|BG128024 | 3226 | 7943 | 613 | LYM790 | 93.1 | globlastp |
| trigonella\|11v1\|SRR066194X171639 | 3227 | 7948 | 613 | LYM790 | 93.1 | globlastp |
| bean\|12v1\|SRR001334.11221_T1 | 3228 | 7949 | 613 | LYM790 | 92.72 | glotblastn |
| medicago\|12v1\|DY617816_T1 | 3229 | 7950 | 613 | LYM790 | 92.72 | glotblastn |
| phalaenopsis\|11v1\|CK859347_T1 | 3230 | 7951 | 613 | LYM790 | 92.72 | glotblastn |
| phalaenopsis\|11v1\|SRR125771.1011060_T1 | 3231 | 7952 | 613 | LYM790 | 92.72 | glotblastn |
| gossypium_raimondii\|12v1\|AI726633_P1 | 3232 | 7953 | 613 | LYM790 | 92.7 | globlastp |
| gossypium_raimondii\|12v1\|AI730867_P1 | 3233 | 7954 | 613 | LYM790 | 92.7 | globlastp |
| gossypium_raimondii\|12v1\|BF268316_P1 | 3234 | 7953 | 613 | LYM790 | 92.7 | globlastp |
| cassava\|09v1\|DV443629_P1 | 3235 | 7955 | 613 | LYM790 | 92.7 | globlastp |
| chelidonium\|11v1\|SRR084752X100589_P1 | 3236 | 7956 | 613 | LYM790 | 92.7 | globlastp |
| chickpea\|11v1\|GR394261_P1 | 3237 | 7957 | 613 | LYM790 | 92.7 | globlastp |
| clover\|gb162\|BB902852_P1 | 3238 | 7958 | 613 | LYM790 | 92.7 | globlastp |
| cotton\|11v1\|AI726454_P1 | 3239 | 7954 | 613 | LYM790 | 92.7 | globlastp |
| cotton\|11v1\|AI726633_P1 | 3240 | 7953 | 613 | LYM790 | 92.7 | globlastp |
| cotton\|11v1\|BE052314_P1 | 3241 | 7953 | 613 | LYM790 | 92.7 | globlastp |
| cotton\|11v1\|BE054943_P1 | 3242 | 7954 | 613 | LYM790 | 92.7 | globlastp |
| cotton\|11v1\|CO070941_P1 | 3243 | 7954 | 613 | LYM790 | 92.7 | globlastp |
| eschscholzia\|11v1\|CK744978_P1 | 3244 | 7959 | 613 | LYM790 | 92.7 | globlastp |
| pepper\|12v1\|BM059685_P1 | 3245 | 7960 | 613 | LYM790 | 92.7 | globlastp |
| pepper\|gb171\|BM059685 | 3246 | 7960 | 613 | LYM790 | 92.7 | globlastp |
| phyla\|11v2\|SRR099035X135964_P1 | 3247 | 7961 | 613 | LYM790 | 92.7 | globlastp |
| potato\|10v1\|BF153095_P1 | 3248 | 7960 | 613 | LYM790 | 92.7 | globlastp |
| potato\|10v1\|BF153410_P1 | 3249 | 7962 | 613 | LYM790 | 92.7 | globlastp |
| solanum_phureja\|09v1\|SPHBG130246 | 3250 | 7962 | 613 | LYM790 | 92.7 | globlastp |
| tea\|10v1\|CV013812 | 3251 | 7963 | 613 | LYM790 | 92.7 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| tobacco\|gb162\|EB678393 | 3252 | 7964 | 613 | LYM790 | 92.7 | globlastp |
| tobacco\|gb162\|X62500 | 3253 | 7965 | 613 | LYM790 | 92.7 | globlastp |
| tomato\|11v1\|AI637354 | 3254 | 7960 | 613 | LYM790 | 92.7 | globlastp |
| bean\|12v1\|CA897706_P1 | 3255 | 7966 | 613 | LYM790 | 92.3 | globlastp |
| bean\|12v1\|SRR001334.1028_P1 | 3256 | 7967 | 613 | LYM790 | 92.3 | globlastp |
| gossypium_raimondii\|12v1\|AI726240_P1 | 3257 | 7968 | 613 | LYM790 | 92.3 | globlastp |
| gossypium_raimondii\|12v1\|SRR032367.154259_P1 | 3258 | 7968 | 613 | LYM790 | 92.3 | globlastp |
| ambrosia\|11v1\|FG943090_P1 | 3259 | 7969 | 613 | LYM790 | 92.3 | globlastp |
| ambrosia\|11v1\|SRR346935.538007_P1 | 3260 | 7970 | 613 | LYM790 | 92.3 | globlastp |
| ambrosia\|11v1\|SRR346943.102234XX1_P1 | 3261 | 7970 | 613 | LYM790 | 92.3 | globlastp |
| chickpea\|11v1\|FE668762_P1 | 3262 | 7971 | 613 | LYM790 | 92.3 | globlastp |
| citrus\|gb166\|CB293635 | 3263 | 7972 | 613 | LYM790 | 92.3 | globlastp |
| clementine\|11v1\|CB293635_P1 | 3264 | 7972 | 613 | LYM790 | 92.3 | globlastp |
| cotton\|11v1\|BE053920_P1 | 3265 | 7973 | 613 | LYM790 | 92.3 | globlastp |
| cotton\|11v1\|BE055131_P1 | 3266 | 7974 | 613 | LYM790 | 92.3 | globlastp |
| cotton\|11v1\|CO091980_P1 | 3267 | 7968 | 613 | LYM790 | 92.3 | globlastp |
| eggplant\|10v1\|FS000343_P1 | 3268 | 7975 | 613 | LYM790 | 92.3 | globlastp |
| euphorbia\|11v1\|SRR098678X101867_P1 | 3269 | 7976 | 613 | LYM790 | 92.3 | globlastp |
| euphorbia\|11v1\|SRR098678X109211_P1 | 3270 | 7976 | 613 | LYM790 | 92.3 | globlastp |
| kiwi\|gb166\|FG400676_P1 | 3271 | 7977 | 613 | LYM790 | 92.3 | globlastp |
| oil_palm\|11v1\|ES414413_P1 | 3272 | 7978 | 613 | LYM790 | 92.3 | globlastp |
| orange\|11v1\|CB293635_P1 | 3273 | 7972 | 613 | LYM790 | 92.3 | globlastp |
| peanut\|10v1\|ES720565_P1 | 3274 | 7979 | 613 | LYM790 | 92.3 | globlastp |
| phalaenopsis\|11v1\|SRR125771.1005182_P1 | 3275 | 7980 | 613 | LYM790 | 92.3 | globlastp |
| platanus\|11v1\|SRR096786X106318_P1 | 3276 | 7981 | 613 | LYM790 | 92.3 | globlastp |
| platanus\|11v1\|SRR096786X106346_P1 | 3277 | 7982 | 613 | LYM790 | 92.3 | globlastp |
| prunus\|10v1\|BU039717 | 3278 | 7983 | 613 | LYM790 | 92.3 | globlastp |
| solanum_phureja\|09v1\|SPHAI637354 | 3279 | 7984 | 613 | LYM790 | 92.3 | globlastp |
| soybean\|11v1\|GLYMA01G37250 | 3280 | 7985 | 613 | LYM790 | 92.3 | globlastp |
| tobacco\|gb162\|BQ842849 | 3281 | 7986 | 613 | LYM790 | 92.3 | globlastp |
| tobacco\|gb162\|BQ843184 | 3282 | 7986 | 613 | LYM790 | 92.3 | globlastp |
| tragopogon\|10v1\|SRR020205S0043061 | 3283 | 7987 | 613 | LYM790 | 92.3 | globlastp |
| utricularia\|11v1\|SRR094438.104799 | 3284 | 7988 | 613 | LYM790 | 92.3 | globlastp |
| blueberry\|12v1\|SRR353282X10403D1_P1 | 3285 | 7989 | 613 | LYM790 | 92 | globlastp |
| sunflower\|12v1\|AJ828302_P1 | 3286 | 7990 | 613 | LYM790 | 92 | globlastp |
| sunflower\|12v1\|BU671926XX1_P1 | 3287 | 7990 | 613 | LYM790 | 92 | globlastp |
| sunflower\|12v1\|CD849831_P1 | 3288 | 7990 | 613 | LYM790 | 92 | globlastp |
| sunflower\|12v1\|CF094119_P1 | 3289 | 7990 | 613 | LYM790 | 92 | globlastp |
| sunflower\|12v1\|DY919920_P1 | 3290 | 7990 | 613 | LYM790 | 92 | globlastp |
| sunflower\|12v1\|DY921763_P1 | 3291 | 7990 | 613 | LYM790 | 92 | globlastp |
| sunflower\|12v1\|DY942685_P1 | 3292 | 7990 | 613 | LYM790 | 92 | globlastp |
| sunflower\|12v1\|DY947262_P1 | 3293 | 7990 | 613 | LYM790 | 92 | globlastp |
| sunflower\|12v1\|EE620392_P1 | 3294 | 7990 | 613 | LYM790 | 92 | globlastp |
| ambrosia\|11v1\|SRR346935.10297_P1 | 3295 | 7990 | 613 | LYM790 | 92 | globlastp |
| ambrosia\|11v1\|SRR346943.140716_P1 | 3296 | 7990 | 613 | LYM790 | 92 | globlastp |
| cichorium\|gb171\|DT212928_P1 | 3297 | 7990 | 613 | LYM790 | 92 | globlastp |
| dandelion\|10v1\|DR400077_P1 | 3298 | 7990 | 613 | LYM790 | 92 | globlastp |
| eggplant\|10v1\|FS007566_P1 | 3299 | 7991 | 613 | LYM790 | 92 | globlastp |
| eucalyptus\|11v2\|AJ697756_P1 | 3300 | 7992 | 613 | LYM790 | 92 | globlastp |
| euphorbia\|11v1\|BI946359_P1 | 3301 | 7993 | 613 | LYM790 | 92 | globlastp |
| spurge\|gb161\|BI946359 | 3301 | 7993 | 613 | LYM790 | 92 | globlastp |
| flaveria\|11v1\|SRR149229.119170_P1 | 3302 | 7990 | 613 | LYM790 | 92 | globlastp |
| flaveria\|11v1\|SRR149242.124845_P1 | 3303 | 7994 | 613 | LYM790 | 92 | globlastp |
| flax\|11v1\|EU829754XX1_P1 | 3304 | 7995 | 613 | LYM790 | 92 | globlastp |
| ipomoea_nil\|10v1\|BJ556576_P1 | 3305 | 7996 | 613 | LYM790 | 92 | globlastp |
| lettuce\|10v1\|DW048534 | 3306 | 7990 | 613 | LYM790 | 92 | globlastp |
| lettuce\|10v1\|DW050750 | 3307 | 7990 | 613 | LYM790 | 92 | globlastp |
| lettuce\|10v1\|DW074488 | 3308 | 7990 | 613 | LYM790 | 92 | globlastp |
| lettuce\|10v1\|DW081418 | 3309 | 7990 | 613 | LYM790 | 92 | globlastp |
| lotus\|09v1\|AW164154_P1 | 3310 | 7997 | 613 | LYM790 | 92 | globlastp |
| lotus\|09v1\|CRPLJ004563_P1 | 3311 | 7998 | 613 | LYM790 | 92 | globlastp |
| melon\|10v1\|DV631763_P1 | 3312 | 7999 | 613 | LYM790 | 92 | globlastp |
| orobanche\|10v1\|SRR023189S0016934_P1 | 3313 | 8000 | 613 | LYM790 | 92 | globlastp |
| orobanche\|10v1\|SRR023189S0017144_P1 | 3314 | 8000 | 613 | LYM790 | 92 | globlastp |
| parthenium\|10v1\|GW778504_P1 | 3315 | 7990 | 613 | LYM790 | 92 | globlastp |
| pepper\|gb171\|BM065261 | 3316 | 8001 | 613 | LYM790 | 92 | globlastp |
| pepper\|12v1\|BM066052_P1 | 3317 | 8002 | 613 | LYM790 | 92 | globlastp |
| pepper\|gb171\|BM066052 | 3318 | 8002 | 613 | LYM790 | 92 | globlastp |
| phyla\|11v2\|SRR099035X118626_P1 | 3319 | 8003 | 613 | LYM790 | 92 | globlastp |
| poppy\|11v1\|FE966571_P1 | 3320 | 8004 | 613 | LYM790 | 92 | globlastp |
| prunus\|10v1\|BU042469 | 3321 | 8005 | 613 | LYM790 | 92 | globlastp |
| safflower\|gb162\|EL377398 | 3322 | 8006 | 613 | LYM790 | 92 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| salvia\|10v1\|CV162967 | 3323 | 8007 | 613 | LYM790 | 92 | globlastp |
| sunflower\|10v1\|CD849437 | 3324 | 7990 | 613 | LYM790 | 92 | globlastp |
| sunflower\|10v1\|CD849478 | 3325 | 7990 | 613 | LYM790 | 92 | globlastp |
| sunflower\|10v1\|CD849831 | 3326 | 7990 | 613 | LYM790 | 92 | globlastp |
| sunflower\|10v1\|CX944526 | 3327 | 7990 | 613 | LYM790 | 92 | globlastp |
| triphysaria\|10v1\|BM357630 | 3328 | 8008 | 613 | LYM790 | 92 | globlastp |
| lettuce\|12v1\|DW048534_P1 | 3329 | 7990 | 613 | LYM790 | 92 | globlastp |
| lettuce\|12v1\|DW057710_P1 | 3330 | 7990 | 613 | LYM790 | 92 | globlastp |
| fraxinus\|11v1\|SRR058827.107952_T1 | 3331 | 8009 | 613 | LYM790 | 91.95 | glotblastn |
| banana\|12v1\|MAGEN2012010348_P1 | 3332 | 8010 | 613 | LYM790 | 91.6 | globlastp |
| pepper\|12v1\|BM065261_P1 | 3333 | 8011 | 613 | LYM790 | 91.6 | globlastp |
| amorphophallus\|11v2\|SRR089351X104085_P1 | 3334 | 8012 | 613 | LYM790 | 91.6 | globlastp |
| arnica\|11v1\|SRR099034X10233_P1 | 3335 | 8013 | 613 | LYM790 | 91.6 | globlastp |
| arnica\|11v1\|SRR099034X102649_P1 | 3336 | 8013 | 613 | LYM790 | 91.6 | globlastp |
| bean\|gb167\|CA897707 | 3337 | 8014 | 613 | LYM790 | 91.6 | globlastp |
| cacao\|10v1\|CU470692_P1 | 3338 | 8015 | 613 | LYM790 | 91.6 | globlastp |
| chestnut\|gb170\|SRR006295S0000013_P1 | 3339 | 8016 | 613 | LYM790 | 91.6 | globlastp |
| chestnut\|gb170\|SRR006295S0005365_P1 | 3340 | 8016 | 613 | LYM790 | 91.6 | globlastp |
| chestnut\|gb170\|SRR006295S0013876_P1 | 3341 | 8016 | 613 | LYM790 | 91.6 | globlastp |
| cirsium\|11v1\|DV175322_P1 | 3342 | 8017 | 613 | LYM790 | 91.6 | globlastp |
| cirsium\|11v1\|SRR346952.105643_P1 | 3343 | 8017 | 613 | LYM790 | 91.6 | globlastp |
| cucumber\|09v1\|DN909368_P1 | 3344 | 8018 | 613 | LYM790 | 91.6 | globlastp |
| cucurbita\|11v1\|SRR091276X108731_P1 | 3345 | 8019 | 613 | LYM790 | 91.6 | globlastp |
| cynara\|gb167\|GE577941_P1 | 3346 | 8020 | 613 | LYM790 | 91.6 | globlastp |
| flaveria\|11v1\|SRR149229.107613_P1 | 3347 | 8021 | 613 | LYM790 | 91.6 | globlastp |
| flaveria\|11v1\|SRR149229.429915_P1 | 3348 | 8022 | 613 | LYM790 | 91.6 | globlastp |
| flaveria\|11v1\|SRR149229.514036_P1 | 3349 | 8023 | 613 | LYM790 | 91.6 | globlastp |
| flaveria\|11v1\|SRR149232.109718_P1 | 3350 | 8023 | 613 | LYM790 | 91.6 | globlastp |
| flaveria\|11v1\|SRR149241.11276_P1 | 3351 | 8023 | 613 | LYM790 | 91.6 | globlastp |
| flaveria\|11v1\|SRR149241.155066_P1 | 3352 | 8021 | 613 | LYM790 | 91.6 | globlastp |
| ginger\|gb164\|DY361029_P1 | 3353 | 8024 | 613 | LYM790 | 91.6 | globlastp |
| monkeyflower\|10v1\|GO993547_P1 | 3354 | 8025 | 613 | LYM790 | 91.6 | globlastp |
| oak\|10v1\|DB996699_P1 | 3355 | 8016 | 613 | LYM790 | 91.6 | globlastp |
| oil_palm\|11v1\|CN600494_P1 | 3356 | 8026 | 613 | LYM790 | 91.6 | globlastp |
| poppy\|11v1\|SRR030259.103837_P1 | 3357 | 8027 | 613 | LYM790 | 91.6 | globlastp |
| thellungiella_halophilum\|11v1\|BY835047 | 3358 | 8028 | 613 | LYM790 | 91.6 | globlastp |
| tripterygium\|11v1\|SRR098677X10350 | 3359 | 8029 | 613 | LYM790 | 91.6 | globlastp |
| utricularia\|11v1\|SRR094438.100035 | 3360 | 8030 | 613 | LYM790 | 91.6 | globlastp |
| ambrosia\|11v1\|SRR346935.211863_T1 | 3361 | 8031 | 613 | LYM790 | 91.57 | glotblastn |
| eucalyptus\|11v2\|SRR001659X12071_T1 | 3362 | 8032 | 613 | LYM790 | 91.57 | glotblastn |
| banana\|12v1\|FL662540_P1 | 3363 | 8033 | 613 | LYM790 | 91.2 | globlastp |
| medicago\|12v1\|AL385299_P1 | 3364 | 8034 | 613 | LYM790 | 91.2 | globlastp |
| sunflower\|12v1\|CD849437_P1 | 3365 | 8035 | 613 | LYM790 | 91.2 | globlastp |
| amsonia\|11v1\|SRR098688X103589_P1 | 3366 | 8036 | 613 | LYM790 | 91.2 | globlastp |
| arnica\|11v1\|SRR099034X12376_P1 | 3367 | 8037 | 613 | LYM790 | 91.2 | globlastp |
| arnica\|11v1\|SRR099034X146168_P1 | 3368 | 8037 | 613 | LYM790 | 91.2 | globlastp |
| catharanthus\|11v1\|EG556490_P1 | 3369 | 8038 | 613 | LYM790 | 91.2 | globlastp |
| cleome_spinosa\|10v1\|GR933570_P1 | 3370 | 8039 | 613 | LYM790 | 91.2 | globlastp |
| cotton\|11v1\|AI726240_P1 | 3371 | 8040 | 613 | LYM790 | 91.2 | globlastp |
| cucumber\|09v1\|CK759390_P1 | 3372 | 8041 | 613 | LYM790 | 91.2 | globlastp |
| cynara\|gb167\|GE590226_P1 | 3373 | 8042 | 613 | LYM790 | 91.2 | globlastp |
| dandelion\|10v1\|DR400825_P1 | 3374 | 8043 | 613 | LYM790 | 91.2 | globlastp |
| eucalyptus\|11v2\|ES593077_P1 | 3375 | 8044 | 613 | LYM790 | 91.2 | globlastp |
| ipomoea_nil\|10v1\|BJ553194_P1 | 3376 | 8045 | 613 | LYM790 | 91.2 | globlastp |
| lotus\|09v1\|Av765152_P1 | 3377 | 8046 | 613 | LYM790 | 91.2 | globlastp |
| momordica\|10v1\|SRR071315S0020101_P1 | 3378 | 8047 | 613 | LYM790 | 91.2 | globlastp |
| monkeyflower\|10v1\|DV205886_P1 | 3379 | 8048 | 613 | LYM790 | 91.2 | globlastp |
| nasturtium\|11v1\|GH165730_P1 | 3380 | 8049 | 613 | LYM790 | 91.2 | globlastp |
| oak\|10v1\|DB997544_P1 | 3381 | 8050 | 613 | LYM790 | 91.2 | globlastp |
| oak\|10v1\|FP027874_P1 | 3382 | 8050 | 613 | LYM790 | 91.2 | globlastp |
| oil_palm\|11v1\|EL608784_P1 | 3383 | 8051 | 613 | LYM790 | 91.2 | globlastp |
| poplar\|10v1\|AI162269_P1 | 3384 | 8052 | 613 | LYM790 | 91.2 | globlastp |
| poplar\|10v1\|BU874175_P1 | 3385 | 8053 | 613 | LYM790 | 91.2 | globlastp |
| senecio\|gb170\|CO553738 | 3386 | 8054 | 613 | LYM790 | 91.2 | globlastp |
| sequoia\|10v1\|SRR065044S0006287 | 3387 | 8055 | 613 | LYM790 | 91.2 | globlastp |
| tabernaemontana\|11v1\|SRR098689X100259 | 3388 | 8056 | 613 | LYM790 | 91.2 | globlastp |
| triphysaria\|10v1\|DR171855 | 3389 | 8057 | 613 | LYM790 | 91.2 | globlastp |
| watermelon\|11v1\|CV003352 | 3390 | 8058 | 613 | LYM790 | 91.2 | globlastp |
| flaveria\|11v1\|SRR149240.109104_T1 | 3391 | 8059 | 613 | LYM790 | 91.19 | glotblastn |
| blueberry\|12v1\|CF810940_P1 | 3392 | 8060 | 613 | LYM790 | 90.8 | globlastp |
| medicago\|12v1\|MTPRD031517_T1 | 3393 | 8061 | 613 | LYM790 | 90.8 | glotblastn |
| amborella\|12v3\|CK759227_P1 | 3394 | 8062 | 613 | LYM790 | 90.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| amborella\|gb166\|CV011325 | 3395 | 8062 | 613 | LYM790 | 90.8 | globlastp |
| apple\|11v1\|CN444631_P1 | 3396 | 8063 | 613 | LYM790 | 90.8 | globlastp |
| apple\|11v1\|CN490551_P1 | 3397 | 8063 | 613 | LYM790 | 90.8 | globlastp |
| apple\|11v1\|CN494176_P1 | 3398 | 8063 | 613 | LYM790 | 90.8 | globlastp |
| arabidopsis_lyrata\|09v1\|JGIAL024354_P1 | 3399 | 8064 | 613 | LYM790 | 90.8 | globlastp |
| b_juncea\|10v2\|E6ANDIZ02IBF74 | 3400 | 8065 | 613 | LYM790 | 90.8 | globlastp |
| centaurea\|gb166\|EH725315_P1 | 3401 | 8066 | 613 | LYM790 | 90.8 | globlastp |
| cirsium\|11v1\|SRR349641.1114191_P1 | 3402 | 8067 | 613 | LYM790 | 90.8 | globlastp |
| cleome_spinosa\|10v1\|GR932617_P1 | 3403 | 8068 | 613 | LYM790 | 90.8 | globlastp |
| coffea\|10v1\|DV676186_P1 | 3404 | 8069 | 613 | LYM790 | 90.8 | globlastp |
| eschscholzia\|11v1\|SRR014116.101144_P1 | 3405 | 8070 | 613 | LYM790 | 90.8 | globlastp |
| eschscholzia\|11v1\|SRR014116.105025_P1 | 3406 | 8070 | 613 | LYM790 | 90.8 | globlastp |
| euonymus\|11v1\|SRR070038X115275_P1 | 3407 | 8071 | 613 | LYM790 | 90.8 | globlastp |
| euonymus\|11v1\|SRR070038X116138_P1 | 3408 | 8072 | 613 | LYM790 | 90.8 | globlastp |
| flaveria\|11v1\|SRR149229.76749_P1 | 3409 | 8073 | 613 | LYM790 | 90.8 | globlastp |
| melon\|10v1\|EB714943_P1 | 3410 | 8074 | 613 | LYM790 | 90.8 | globlastp |
| nasturtium\|11v1\|SRR032558.105690_P1 | 3411 | 8075 | 613 | LYM790 | 90.8 | globlastp |
| nicotiana_benthamiana\|gb162\|CN743079_T1 | 3412 | 8076 | 613 | LYM790 | 90.8 | glotblastn |
| papaya\|gb165\|EX276851_P1 | 3413 | 8077 | 613 | LYM790 | 90.8 | globlastp |
| poppy\|11v1\|SRR030259.114139_T1 | 3414 | 8078 | 613 | LYM790 | 90.8 | glotblastn |
| sequoia\|10v1\|SRR065044S0018509 | 3415 | 8079 | 613 | LYM790 | 90.8 | globlastp |
| strawberry\|11v1\|CO380517 | 3416 | 8080 | 613 | LYM790 | 90.8 | globlastp |
| strawberry\|11v1\|CO381760 | 3417 | 8080 | 613 | LYM790 | 90.8 | globlastp |
| triphysaria\|10v1\|DR173971 | 3418 | 8081 | 613 | LYM790 | 90.8 | globlastp |
| utricularia\|11v1\|SRR094438.111334 | 3419 | 8082 | 613 | LYM790 | 90.8 | globlastp |
| valeriana\|11v1\|SRR099039X101644 | 3420 | 8083 | 613 | LYM790 | 90.8 | globlastp |
| vinca\|11v1\|SRR098690X10369 | 3421 | 8084 | 613 | LYM790 | 90.8 | globlastp |
| vinca\|11v1\|SRR098690X104675 | 3422 | 8084 | 613 | LYM790 | 90.8 | globlastp |
| watermelon\|11v1\|CK759390 | 3423 | 8085 | 613 | LYM790 | 90.8 | globlastp |
| scabiosa\|11v1\|SRR063723X115625 | 3424 | 8086 | 613 | LYM790 | 90.6 | globlastp |
| thellungiella_halophilum\|11v1\|DN772730 | 3425 | 8087 | 613 | LYM790 | 90.53 | glotblastn |
| apple\|11v1\|CN860660_T1 | 3426 | 8088 | 613 | LYM790 | 90.46 | glotblastn |
| apple\|11v1\|CN916738_T1 | 3427 | 8088 | 613 | LYM790 | 90.46 | glotblastn |
| b_rapa\|11v1\|BQ791304_T1 | 3428 | 8089 | 613 | LYM790 | 90.42 | glotblastn |
| cucurbita\|11v1\|SRR091276X116640_T1 | 3429 | 8090 | 613 | LYM790 | 90.42 | glotblastn |
| watermelon\|11v1\|AM719570 | 3430 | 8091 | 613 | LYM790 | 90.42 | glotblastn |
| b_juncea\|12v1\|E6ANDIZ01A1N972_P1 | 3431 | 8092 | 613 | LYM790 | 90.4 | globlastp |
| beet\|12v1\|BE590421_P1 | 3432 | 8093 | 613 | LYM790 | 90.4 | globlastp |
| rose\|12v1\|EC586200_P1 | 3433 | 8094 | 613 | LYM790 | 90.4 | globlastp |
| rose\|12v1\|EC589512_P1 | 3434 | 8095 | 613 | LYM790 | 90.4 | globlastp |
| apple\|11v1\|CN444113_P1 | 3435 | 8096 | 613 | LYM790 | 90.4 | globlastp |
| arabidopsis_lyrata\|09v1\|JGIAL012279_P1 | 3436 | 8097 | 613 | LYM790 | 90.4 | globlastp |
| artemisia\|10v1\|EY045901_P1 | 3437 | 8098 | 613 | LYM790 | 90.4 | globlastp |
| b_rapa\|11v1\|CD812422_P1 | 3438 | 8099 | 613 | LYM790 | 90.4 | globlastp |
| canola\|11v1\|CN732206_P1 | 3439 | 8100 | 613 | LYM790 | 90.4 | globlastp |
| canola\|11v1\|CN737455_P1 | 3440 | 8100 | 613 | LYM790 | 90.4 | globlastp |
| cleome_gynandra\|10v1\|SRR015532S0013809_P1 | 3441 | 8101 | 613 | LYM790 | 90.4 | globlastp |
| cucurbita\|11v1\|SRR091276X100241_P1 | 3442 | 8102 | 613 | LYM790 | 90.4 | globlastp |
| euonymus\|11v1\|SRR070038X101033_P1 | 3443 | 8103 | 613 | LYM790 | 90.4 | globlastp |
| euonymus\|11v1\|SRR070038X432428_P1 | 3444 | 8104 | 613 | LYM790 | 90.4 | globlastp |
| ipomoea_batatas\|10v1\|CB330006_P1 | 3445 | 8105 | 613 | LYM790 | 90.4 | globlastp |
| momordica\|10v1\|SRR071315S0003035_P1 | 3446 | 8106 | 613 | LYM790 | 90.4 | globlastp |
| papaya\|gb165\|EX267697_P1 | 3447 | 8107 | 613 | LYM790 | 90.4 | globlastp |
| plantago\|11v2\|SRR066373X100273_P1 | 3448 | 8108 | 613 | LYM790 | 90.4 | globlastp |
| pseudotsuga\|10v1\|SRR065119S0013400 | 3449 | 8109 | 613 | LYM790 | 90.4 | globlastp |
| sequoia\|10v1\|SRR065044S0036380 | 3450 | 8110 | 613 | LYM790 | 90.4 | globlastp |
| taxus\|10v1\|SRR032523S0011975 | 3451 | 8111 | 613 | LYM790 | 90.4 | globlastp |
| tripterygium\|11v1\|SRR098677X100889 | 3452 | 8112 | 613 | LYM790 | 90.4 | globlastp |
| b_juncea\|12v1\|E6ANDIZ01A4V9S_T1 | 3453 | 8113 | 613 | LYM790 | 90.04 | glotblastn |
| apple\|11v1\|CN881003_T1 | 3454 | 8114 | 613 | LYM790 | 90.04 | glotblastn |
| b_juncea\|12v1\|AY184410_P1 | 3455 | 8115 | 613 | LYM790 | 90 | globlastp |
| b_juncea\|12v1\|E6ANDIZ01AMEZR_P1 | 3456 | 8116 | 613 | LYM790 | 90 | globlastp |
| b_juncea\|12v1\|E6ANDIZ01CI2XS_P1 | 3457 | 8116 | 613 | LYM790 | 90 | globlastp |
| abies\|11v2\|SRR098676X101262_P1 | 3458 | 8117 | 613 | LYM790 | 90 | globlastp |
| abies\|11v2\|SRR098676X11978_P1 | 3459 | 8118 | 613 | LYM790 | 90 | globlastp |
| antirrhinum\|gb166\|AJ787095_P1 | 3460 | 8119 | 613 | LYM790 | 90 | globlastp |
| arabidopsis\|10v1\|AT2G18020_P1 | 3461 | 8120 | 613 | LYM790 | 90 | globlastp |
| arabidopsis\|10v1\|AT4G36130_P1 | 3462 | 8121 | 613 | LYM790 | 90 | globlastp |
| b_juncea\|10v2\|E6ANDIZ01A1VQT | 3463 | 8116 | 613 | LYM790 | 90 | globlastp |
| b_juncea\|10v2\|E6ANDIZ01A5VF6 | 3464 | 8115 | 613 | LYM790 | 90 | globlastp |
| b_juncea\|12v1\|E6ANDIZ01A5VF6_P1 | 3465 | 8115 | 613 | LYM790 | 90 | globlastp |
| b_juncea\|10v2\|E6ANDIZ01AR1Q7 | 3466 | 8122 | 613 | LYM790 | 90 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| b_oleracea|gb161|AM062392_P1 | 3467 | 8123 | 613 | LYM790 | 90 | globlastp |
| b_oleracea|gb161|DY018836_P1 | 3468 | 8122 | 613 | LYM790 | 90 | globlastp |
| b_oleracea|gb161|DY028981_P1 | 3469 | 8116 | 613 | LYM790 | 90 | globlastp |
| b_rapa|11v1|BG543461_P1 | 3470 | 8122 | 613 | LYM790 | 90 | globlastp |
| b_rapa|11v1|BG544286_P1 | 3471 | 8116 | 613 | LYM790 | 90 | globlastp |
| canola|11v1|CN726717_P1 | 3472 | 8122 | 613 | LYM790 | 90 | globlastp |
| canola|11v1|CN730548_P1 | 3473 | 8116 | 613 | LYM790 | 90 | globlastp |
| canola|11v1|CN731144_P1 | 3474 | 8116 | 613 | LYM790 | 90 | globlastp |
| canola|11v1|CN731374_P1 | 3475 | 8115 | 613 | LYM790 | 90 | globlastp |
| canola|11v1|CN827355_P1 | 3476 | 8122 | 613 | LYM790 | 90 | globlastp |
| canola|11v1|EG020713_P1 | 3477 | 8115 | 613 | LYM790 | 90 | globlastp |
| cedrus|11v1|SRR065007X103421_P1 | 3478 | 8117 | 613 | LYM790 | 90 | globlastp |
| cleome_gynandra|10v1|SRR015532S0001671_P1 | 3479 | 8124 | 613 | LYM790 | 90 | globlastp |
| cleome_gynandra|10v1|SRR015532S0011392_P1 | 3480 | 8125 | 613 | LYM790 | 90 | globlastp |
| cryptomeria|gb166|BP173962_P1 | 3481 | 8126 | 613 | LYM790 | 90 | globlastp |
| euonymus|11v1|SRR070038X101772_P1 | 3482 | 8127 | 613 | LYM790 | 90 | globlastp |
| flax|11v1|EB712093_P1 | 3483 | 8128 | 613 | LYM790 | 90 | globlastp |
| onion|12v1|CF436112_P1 | 3484 | 8129 | 613 | LYM790 | 90 | globlastp |
| onion|gb162|CF436112 | 3485 | 8129 | 613 | LYM790 | 90 | globlastp |
| radish|gb164|EV525690 | 3486 | 8116 | 613 | LYM790 | 90 | globlastp |
| radish|gb164|EV535721 | 3487 | 8122 | 613 | LYM790 | 90 | globlastp |
| radish|gb164|EV567163 | 3488 | 8116 | 613 | LYM790 | 90 | globlastp |
| radish|gb164|EX756150 | 3489 | 8116 | 613 | LYM790 | 90 | globlastp |
| radish|gb164|EX756461 | 3490 | 8116 | 613 | LYM790 | 90 | globlastp |
| radish|gb164|EX756775 | 3491 | 8130 | 613 | LYM790 | 90 | globlastp |
| silene|11v1|SRR096785X101618 | 3492 | 8131 | 613 | LYM790 | 90 | globlastp |
| spruce|11v1|ES248846 | 3493 | 8132 | 613 | LYM790 | 90 | globlastp |
| thellungiella_halophilum|11v1|DN773500 | 3494 | 8133 | 613 | LYM790 | 90 | globlastp |
| thellungiella|gb167|DN773500 | 3495 | 8133 | 613 | LYM790 | 90 | globlastp |
| vinca|11v1|SRR098690X109763 | 3496 | 8134 | 613 | LYM790 | 90 | globlastp |
| b_juncea|12v1|E6ANDIZ01A8K37_P1 | 3497 | 8135 | 613 | LYM790 | 90 | globlastp |
| b_juncea|12v1|E6ANDIZ01A9KIA_P1 | 3498 | 8136 | 613 | LYM790 | 89.7 | globlastp |
| b_juncea|12v1|E6ANDIZ01A5Q1M_P1 | 3499 | 8137 | 613 | LYM790 | 89.7 | globlastp |
| b_oleracea|gb161|DY028371_P1 | 3500 | 8138 | 613 | LYM790 | 89.7 | globlastp |
| b_rapa|11v1|CD820189_P1 | 3501 | 8139 | 613 | LYM790 | 89.7 | globlastp |
| humulus|11v1|ES655191_P1 | 3502 | 8140 | 613 | LYM790 | 89.7 | globlastp |
| humulus|11v1|GD252291_P1 | 3503 | 8140 | 613 | LYM790 | 89.7 | globlastp |
| silene|11v1|SRR096785X100142 | 3504 | 8141 | 613 | LYM790 | 89.7 | globlastp |
| spruce|11v1|ES248508 | 3505 | 8142 | 613 | LYM790 | 89.7 | globlastp |
| spruce|11v1|EX306417 | 3506 | 8142 | 613 | LYM790 | 89.7 | globlastp |
| spruce|11v1|EX414754 | 3507 | 8142 | 613 | LYM790 | 89.7 | globlastp |
| spruce|11v1|EX431529 | 3508 | 8142 | 613 | LYM790 | 89.7 | globlastp |
| b_juncea|12v1|E6ANDIZ01BHGOM1_P1 | 3509 | 8143 | 613 | LYM790 | 89.7 | globlastp |
| apple|11v1|CN882575_T1 | 3510 | 8144 | 613 | LYM790 | 89.35 | glotblastn |
| b_juncea|12v1|E6ANDIZ01A7GN0_P1 | 3511 | 8145 | 613 | LYM790 | 89.3 | globlastp |
| basilicum|10v1|DY323385_P1 | 3512 | 8146 | 613 | LYM790 | 89.3 | globlastp |
| canola|11v1|CN737311_P1 | 3513 | 8147 | 613 | LYM790 | 89.3 | globlastp |
| citrus|gb166|BE208858 | 3514 | 8148 | 613 | LYM790 | 89.3 | globlastp |
| clementine|11v1|BE208858_P1 | 3515 | 8148 | 613 | LYM790 | 89.3 | globlastp |
| fagopyrum|11v1|SRR063703X111835_P1 | 3516 | 8149 | 613 | LYM790 | 89.3 | globlastp |
| humulus|11v1|GD243754_P1 | 3517 | 8150 | 613 | LYM790 | 89.3 | globlastp |
| pseudotsuga|10v1|SRR065119S0021674 | 3518 | 8151 | 613 | LYM790 | 89.3 | globlastp |
| zostera|10v1|AM766543 | 3519 | 8152 | 613 | LYM790 | 89.3 | globlastp |
| hornbeam|12v1|SRR364455.104140_T1 | 3520 | 8153 | 613 | LYM790 | 89.27 | glotblastn |
| artemisia|10v1|SRR019254S0027003_T1 | 3521 | 8154 | 613 | LYM790 | 89.27 | glotblastn |
| epimedium|11v1|SRR013502.13108_P1 | 3522 | 8155 | 613 | LYM790 | 88.9 | globlastp |
| beet|gb162|BE590421 | 3523 | 8156 | 613 | LYM790 | 88.9 | globlastp |
| centaurea|gb166|EH747157_P1 | 3524 | 8157 | 613 | LYM790 | 88.9 | globlastp |
| cephalotaxus|11v1|SRR064395X103527_P1 | 3525 | 8158 | 613 | LYM790 | 88.9 | globlastp |
| cryptomeria|gb166|AU036759_P1 | 3526 | 8159 | 613 | LYM790 | 88.9 | globlastp |
| distylium|11v1|SRR065077X1020_P1 | 3527 | 8160 | 613 | LYM790 | 88.9 | globlastp |
| maritime_pine|10v1|BX253399_P1 | 3528 | 8161 | 613 | LYM790 | 88.9 | globlastp |
| fagopyrum|11v1|SRR063703X113488_T1 | 3529 | 8162 | 613 | LYM790 | 88.89 | glotblastn |
| flaveria|11v1|SRR149244.117090_T1 | 3530 | 8163 | 613 | LYM790 | 88.89 | glotblastn |
| spruce|11v1|SRR066107X88366 | 3531 | 8164 | 613 | LYM790 | 88.89 | glotblastn |
| thellungiella_parvulum|11v1|DN772730 | 3532 | 8165 | 613 | LYM790 | 88.89 | glotblastn |
| scabiosa|11v1|SRR063723X101051 | 3533 | 8166 | 613 | LYM790 | 88.81 | glotblastn |
| cannabis|12v1|EW701015_P1 | 3534 | 8167 | 613 | LYM790 | 88.5 | globlastp |
| b_oleracea|gb161|AM389355_P1 | 3535 | 8168 | 613 | LYM790 | 88.5 | globlastp |
| beech|11v1|SRR006293.10985_P1 | 3536 | 8169 | 613 | LYM790 | 88.5 | globlastp |
| cycas|gb166|CB089838_P1 | 3537 | 8170 | 613 | LYM790 | 88.5 | globlastp |
| flaveria|11v1|SRR149229.171993_P1 | 3538 | 8171 | 613 | LYM790 | 88.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| podocarpus\|10v1\|SRR065014S0006210_P1 | 3539 | 8172 | 613 | LYM790 | 88.5 | globlastp |
| tea\|10v1\|GE651650 | 3540 | 8173 | 613 | LYM790 | 88.5 | globlastp |
| walnuts\|gb166\|CV197093 | 3541 | 8174 | 613 | LYM790 | 88.5 | globlastp |
| primula\|11v1\|SRR098679X100789_T1 | 3542 | 8175 | 613 | LYM790 | 88.12 | glotblastn |
| canola\|11v1\|SRR023610.28440_P1 | 3543 | 8176 | 613 | LYM790 | 88.1 | globlastp |
| marchantia\|gb166\|BJ840611_P1 | 3544 | 8177 | 613 | LYM790 | 88.1 | globlastp |
| maritime_pine\|10v1\|AL751187_P1 | 3545 | 8178 | 613 | LYM790 | 88.1 | globlastp |
| pine\|10v2\|AW010247_P1 | 3546 | 8179 | 613 | LYM790 | 88.1 | globlastp |
| b_juncea\|12v1\|E6ANDIZ01A7SOF_P1 | 3547 | 8180 | 613 | LYM790 | 87.7 | globlastp |
| onion\|12v1\|CF439148_P1 | 3548 | 8181 | 613 | LYM790 | 87.7 | globlastp |
| b_rapa\|11v1\|H74672_P1 | 3549 | 8182 | 613 | LYM790 | 87.7 | globlastp |
| b_juncea\|12v1\|E6ANDIZ01B295M_P1 | 3550 | 8183 | 613 | LYM790 | 87.4 | globlastp |
| marchantia\|gb166\|AU081768_P1 | 3551 | 8184 | 613 | LYM790 | 87.4 | globlastp |
| platanus\|11v1\|SRR096786X184889_P1 | 3552 | 8185 | 613 | LYM790 | 87.4 | globlastp |
| cannabis\|12v1\|MDCRP124434_T1 | 3553 | 8186 | 613 | LYM790 | 87.36 | glotblastn |
| spikemoss\|gb165\|DN839095 | 3554 | 8187 | 613 | LYM790 | 87 | globlastp |
| spikemoss\|gb165\|FE439180 | 3555 | 8187 | 613 | LYM790 | 87 | globlastp |
| poppy\|11v1\|SRR096789.102616_P1 | 3556 | 8188 | 613 | LYM790 | 86.6 | globlastp |
| zostera\|10v1\|SRR057351S0004839 | 3557 | 8189 | 613 | LYM790 | 86.59 | glotblastn |
| b_juncea\|12v1\|E6ANDIZ01AEMGX_T1 | 3558 | 8190 | 613 | LYM790 | 86.36 | glotblastn |
| b_rapa\|11v1\|DY012330_P1 | 3559 | 8191 | 613 | LYM790 | 86.3 | globlastp |
| platanus\|11v1\|SRR096786X139061XX2_T1 | 3560 | 8192 | 613 | LYM790 | 86.21 | glotblastn |
| cleome_spinosa\|10v1\|GR931660_P1 | 3561 | 8193 | 613 | LYM790 | 86.2 | globlastp |
| fagopyrum\|11v1\|GO898743_P1 | 3562 | 8194 | 613 | LYM790 | 86.2 | globlastp |
| radish\|gb164\|EV529055 | 3563 | 8195 | 613 | LYM790 | 85.98 | glotblastn |
| thellungiella_parvulum\|11v1\|BY824668 | 3564 | 8196 | 613 | LYM790 | 85.9 | globlastp |
| sciadopitys\|10v1\|SRR065035S0001107 | 3565 | 8197 | 613 | LYM790 | 85.8 | globlastp |
| bean\|12v1\|CA904261_P1 | 3566 | 8198 | 613 | LYM790 | 85.1 | globlastp |
| euphorbia\|11v1\|DV122889_P1 | 3567 | 8199 | 613 | LYM790 | 85.1 | globlastp |
| gerbera\|09v1\|AJ755830_P1 | 3568 | 8200 | 613 | LYM790 | 85.1 | globlastp |
| ceratodon\|10v1\|SRR074890S0009136_P1 | 3569 | 8201 | 613 | LYM790 | 84.7 | globlastp |
| ceratodon\|10v1\|SRR074890S0013362_P1 | 3570 | 8201 | 613 | LYM790 | 84.7 | globlastp |
| ceratodon\|10v1\|SRR074890S0014912_P1 | 3571 | 8201 | 613 | LYM790 | 84.7 | globlastp |
| ceratodon\|10v1\|SRR074890S0067707_P1 | 3572 | 8201 | 613 | LYM790 | 84.7 | globlastp |
| fern\|gb171\|BP920896_P1 | 3573 | 8202 | 613 | LYM790 | 84.7 | globlastp |
| physcomitrella\|10v1\|AW476914_P1 | 3574 | 8201 | 613 | LYM790 | 84.7 | globlastp |
| physcomitrella\|10v1\|BG361871_P1 | 3575 | 8201 | 613 | LYM790 | 84.7 | globlastp |
| physcomitrella\|10v1\|BJ157399_P1 | 3576 | 8201 | 613 | LYM790 | 84.7 | globlastp |
| physcomitrella\|10v1\|BJ165368_P1 | 3577 | 8201 | 613 | LYM790 | 84.7 | globlastp |
| physcomitrella\|10v1\|BJ180207_P1 | 3578 | 8201 | 613 | LYM790 | 84.7 | globlastp |
| physcomitrella\|10v1\|BQ041623_P1 | 3579 | 8201 | 613 | LYM790 | 84.7 | globlastp |
| thellungiella_halophilum\|11v1\|EHJGI11028028 | 3580 | 8203 | 613 | LYM790 | 84.7 | globlastp |
| b_juncea\|12v1\|E6ANDIZ01BQPKI_T1 | 3581 | 8204 | 613 | LYM790 | 84.67 | glotblastn |
| pteridium\|11v1\|GW574815 | 3582 | 8205 | 613 | LYM790 | 84.3 | globlastp |
| radish\|gb164\|EY903949 | 3583 | 8206 | 613 | LYM790 | 84.29 | glotblastn |
| cannabis\|12v1\|SOLX00011997_P1 | 3584 | 8207 | 613 | LYM790 | 84 | globlastp |
| pine\|10v2\|BQ701393_T1 | 3585 | 8208 | 613 | LYM790 | 83.91 | glotblastn |
| thalictrum\|11v1\|SRR096787X104447 | 3586 | 8209 | 613 | LYM790 | 83.91 | glotblastn |
| b_juncea\|10v2\|E6ANDIZ01A1N971 | 3587 | 8210 | 613 | LYM790 | 83.9 | globlastp |
| gnetum\|10v1\|CB081127_P1 | 3588 | 8211 | 613 | LYM790 | 83.9 | globlastp |
| utricularia\|11v1\|SRR094438.100421 | 3589 | 8212 | 613 | LYM790 | 83.9 | globlastp |
| sunflower\|12v1\|DY942987_P1 | 3590 | 8213 | 613 | LYM790 | 83.8 | globlastp |
| jatropha\|09v1\|GO247069_T1 | 3591 | 8214 | 613 | LYM790 | 83.77 | glotblastn |
| rye\|12v1\|BE496023_T1 | 3592 | 8215 | 613 | LYM790 | 83.52 | glotblastn |
| b_juncea\|12v1\|E6ANDIZ01A1EBW_P1 | 3593 | 8216 | 613 | LYM790 | 83.5 | globlastp |
| cirsium\|11v1\|SRR346952.657737_P1 | 3594 | 8217 | 613 | LYM790 | 83.5 | globlastp |
| cannabis\|12v1\|SOLX00092724_P1 | 3595 | 8218 | 613 | LYM790 | 82.8 | globlastp |
| oil_palm\|11v1\|EY397962_P1 | 3596 | 8219 | 613 | LYM790 | 82.8 | globlastp |
| foxtail_millet\|11v3\|PHY7SI024384M_P1 | 3597 | 8220 | 613 | LYM790 | 82.4 | globlastp |
| sorghum\|11v1\|SB09G026110 | 3598 | 8221 | 613 | LYM790 | 82.1 | globlastp |
| barley\|12v1\|HV12v1CRP134476_P1 | 3599 | 8222 | 613 | LYM790 | 82 | globlastp |
| parthenium\|10v1\|GW778069_P1 | 3600 | 8223 | 613 | LYM790 | 82 | globlastp |
| petunia\|gb171\|DY396132_T1 | 3601 | 8224 | 613 | LYM790 | 81.99 | glotblastn |
| sciadopitys\|10v1\|SRR065035S0002350 | 3602 | 8225 | 613 | LYM790 | 81.9 | globlastp |
| pigeonpea\|11v1\|SRR054580X455793_T1 | 3603 | 8226 | 613 | LYM790 | 81.61 | glotblastn |
| spruce\|11v1\|SRR064180X158172 | 3604 | 8227 | 613 | LYM790 | 81.61 | glotblastn |
| arabidopsis_lyrata\|09v1\|JGIAL018325_P1 | 3605 | 8228 | 613 | LYM790 | 81.6 | globlastp |
| b_juncea\|10v2\|E6ANDIZ01B295M | 3606 | 8229 | 613 | LYM790 | 81.6 | globlastp |
| basilicum\|10v1\|DY328889_P1 | 3607 | 8230 | 613 | LYM790 | 81.6 | globlastp |
| chelidonium\|11v1\|SRR084752X11912_P1 | 3608 | 8231 | 613 | LYM790 | 81.6 | globlastp |
| brachypodium\|12v1\|BRADI1G00867_P1 | 3609 | 8232 | 613 | LYM790 | 81.3 | globlastp |
| liriodendron\|gb166\|CK763214_P1 | 3610 | 8233 | 613 | LYM790 | 81.2 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| arabidopsis\|10v1\|AT3G51190_P1 | 3611 | 8234 | 613 | LYM790 | 80.9 | globlastp |
| senecio\|gb170\|DY664878 | 3612 | 8235 | 613 | LYM790 | 80.9 | globlastp |
| aquilegia\|10v2\|JGIAC024475_P1 | 3613 | 8236 | 613 | LYM790 | 80.7 | globlastp |
| cleome_spinosa\|10v1\|GR932078_P1 | 3614 | 8237 | 613 | LYM790 | 80.5 | globlastp |
| brachypodium\|09v1\|BRADI1G00870 | 3615 | 8238 | 613 | LYM790 | 80.15 | glotblastn |
| b_juncea\|12v1\|E6ANDIZ01AJWEP_P1 | 3616 | 8239 | 613 | LYM790 | 80.1 | globlastp |
| cenchrus\|gb166\|EB655552_P1 | 3617 | 8240 | 614 | LYM791 | 99.5 | globlastp |
| millet\|10v1\|EVO454PM363815_P1 | 3618 | 8241 | 614 | LYM791 | 99.5 | globlastp |
| sugarcane\|10v1\|BQ533632 | 3619 | 8242 | 614 | LYM791 | 99.5 | globlastp |
| sorghum\|11v1\|SB02G029260 | 3620 | 8243 | 614 | LYM791 | 99.1 | globlastp |
| sorghum\|12v1\|SB02G029260_P1 | 3621 | 8243 | 614 | LYM791 | 99.1 | globlastp |
| wheat\|12v3\|CA484812_P1 | 3622 | 8243 | 614 | LYM791 | 99.1 | globlastp |
| maize\|10v1\|T18278_P1 | 3623 | 8244 | 614 | LYM791 | 98.6 | globlastp |
| switchgrass\|gb167\|DN140975 | 3624 | 8245 | 614 | LYM791 | 98.6 | globlastp |
| switchgrass\|gb167\|FE607390 | 3625 | 8246 | 614 | LYM791 | 98.2 | globlastp |
| maize\|10v1\|AI615015_P1 | 3626 | 8247 | 614 | LYM791 | 97.7 | globlastp |
| cynodon\|10v1\|BQ826119_P1 | 3627 | 8248 | 614 | LYM791 | 96.8 | globlastp |
| rice\|11v1\|BI805797 | 3628 | 8249 | 614 | LYM791 | 96.8 | globlastp |
| brachypodium\|12v1\|BRADI4G34620_P1 | 3629 | 8250 | 614 | LYM791 | 95.5 | globlastp |
| brachypodium\|09v1\|DV473769 | 3630 | 8251 | 614 | LYM791 | 95.48 | glotblastn |
| rye\|12v1\|DRR001012.101116_P1 | 3631 | 8252 | 614 | LYM791 | 94.1 | globlastp |
| rye\|12v1\|DRR001012.10578_P1 | 3632 | 8252 | 614 | LYM791 | 94.1 | globlastp |
| rye\|12v1\|DRR001012.132414_P1 | 3633 | 8252 | 614 | LYM791 | 94.1 | globlastp |
| rye\|12v1\|DRR001012.90699_P1 | 3634 | 8252 | 614 | LYM791 | 94.1 | globlastp |
| barley\|10v2\|BF621689 | 3635 | 8252 | 614 | LYM791 | 94.1 | globlastp |
| barley\|12v1\|BF621689_P1 | 3636 | 8252 | 614 | LYM791 | 94.1 | globlastp |
| leymus\|gb166\|CN466249_P1 | 3637 | 8252 | 614 | LYM791 | 94.1 | globlastp |
| pseudoroegneria\|gb167\|FF362230 | 3638 | 8252 | 614 | LYM791 | 94.1 | globlastp |
| wheat\|10v2\|BE399354 | 3639 | 8252 | 614 | LYM791 | 94.1 | globlastp |
| wheat\|12v3\|BE399354_P1 | 3640 | 8252 | 614 | LYM791 | 94.1 | globlastp |
| oat\|11v1\|CN819721_P1 | 3641 | 8253 | 614 | LYM791 | 93.7 | globlastp |
| fescue\|gb161\|DT688025_P1 | 3642 | 8254 | 614 | LYM791 | 92.8 | globlastp |
| pineapple\|10v1\|DT336196_P1 | 3643 | 8255 | 614 | LYM791 | 92.8 | globlastp |
| wheat\|10v2\|CA484812 | 3644 | 8256 | 614 | LYM791 | 92.8 | globlastp |
| foxtail_millet\|11v3\|PHY7SI014432M_P1 | 3645 | 8257 | 614 | LYM791 | 88.2 | globlastp |
| oil_palm\|11v1\|DW248085_P1 | 3646 | 8258 | 614 | LYM791 | 88.2 | globlastp |
| millet\|10v1\|EVO454PM026012_P1 | 3647 | 8259 | 614 | LYM791 | 87.8 | globlastp |
| brachypodium\|12v1\|BRADI3G41090_P1 | 3648 | 8260 | 614 | LYM791 | 87.3 | globlastp |
| brachypodium\|09v1\|DV472028 | 3649 | 8260 | 614 | LYM791 | 87.3 | globlastp |
| rice\|11v1\|CA999332 | 3650 | 8261 | 614 | LYM791 | 87.3 | globlastp |
| switchgrass\|gb167\|FE621136 | 3651 | 8262 | 614 | LYM791 | 87.3 | globlastp |
| lovegrass\|gb167\|EH185158_P1 | 3652 | 8263 | 614 | LYM791 | 87 | globlastp |
| maize\|10v1\|CB924363_P1 | 3653 | 8264 | 614 | LYM791 | 86 | globlastp |
| sorghum\|11v1\|SB07G026360 | 3654 | 8265 | 614 | LYM791 | 86 | globlastp |
| sorghum\|12v1\|SB07G026360_P1 | 3655 | 8265 | 614 | LYM791 | 86 | globlastp |
| sugarcane\|10v1\|BQ535872 | 3656 | 8265 | 614 | LYM791 | 86 | globlastp |
| banana\|12v1\|BBS2372T3_P1 | 3657 | 8266 | 614 | LYM791 | 85.5 | globlastp |
| banana\|10v1\|BBS2372T3 | 3658 | 8266 | 614 | LYM791 | 85.5 | globlastp |
| phalaenopsis\|11v1\|CB032201_P1 | 3659 | 8267 | 614 | LYM791 | 85.1 | globlastp |
| onion\|12v1\|CF438483_P1 | 3660 | 8268 | 614 | LYM791 | 85.1 | globlastp |
| rye\|12v1\|DRR001013.125654_P1 | 3661 | 8269 | 614 | LYM791 | 84.8 | globlastp |
| amorphophallus\|11v2\|SRR089351X121767_T1 | 3662 | 8270 | 614 | LYM791 | 84.07 | glotblastn |
| oil_palm\|11v1\|EL685477_P1 | 3663 | 8271 | 614 | LYM791 | 83.7 | globlastp |
| zostera\|10v1\|AM769627 | 3664 | 8272 | 614 | LYM791 | 82.9 | globlastp |
| aquilegia\|10v2\|DR918194_P1 | 3665 | 8273 | 614 | LYM791 | 82.8 | globlastp |
| aquilegia\|10v1\|DR918194 | 3666 | 8274 | 614 | LYM791 | 82.8 | globlastp |
| cephalotaxus\|11v1\|SRR064395X162954_P1 | 3667 | 8275 | 614 | LYM791 | 82.1 | globlastp |
| cryptomeria\|gb166\|BP176620_T1 | 3668 | 8276 | 614 | LYM791 | 82.06 | glotblastn |
| cassava\|09v1\|DV449164_P1 | 3669 | 8277 | 614 | LYM791 | 81.6 | globlastp |
| citrus\|gb166\|CF418465 | 3670 | 8278 | 614 | LYM791 | 81.6 | globlastp |
| clementine\|11v1\|CF418465_P1 | 3671 | 8278 | 614 | LYM791 | 81.6 | globlastp |
| orange\|11v1\|CF418465_P1 | 3672 | 8278 | 614 | LYM791 | 81.6 | globlastp |
| prunus\|10v1\|BU044098 | 3673 | 8279 | 614 | LYM791 | 81.6 | globlastp |
| nuphar\|gb166\|CK752351_T1 | 3674 | 8280 | 614 | LYM791 | 81.53 | glotblastn |
| banana\|10v1\|FL658249 | 3675 | 8281 | 614 | LYM791 | 81.4 | globlastp |
| onion\|gb162\|CF438483 | 3676 | 8282 | 614 | LYM791 | 81.3 | globlastp |
| aristolochia\|10v1\|SRR039082S0107473_P1 | 3677 | 8283 | 614 | LYM791 | 81.2 | globlastp |
| cephalotaxus\|11v1\|SRR064395X11086_P1 | 3678 | 8284 | 614 | LYM791 | 81.2 | globlastp |
| momordica\|10v1\|SRR071315S0005813_P1 | 3679 | 8285 | 614 | LYM791 | 81.2 | globlastp |
| oak\|10v1\|DN949835_P1 | 3680 | 8286 | 614 | LYM791 | 81.2 | globlastp |
| tripterygium\|11v1\|SRR098677X125826 | 3681 | 8287 | 614 | LYM791 | 81.2 | globlastp |
| taxus\|10v1\|SRR032523S0004461 | 3682 | 8288 | 614 | LYM791 | 81.17 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| epimedium\|11v1\|SRR013502.18132_P1 | 3683 | 8289 | 614 | LYM791 | 80.8 | globlastp |
| cassava\|09v1\|FF536078_P1 | 3684 | 8290 | 614 | LYM791 | 80.7 | globlastp |
| chestnut\|gb170\|SRR006295S0017263_P1 | 3685 | 8291 | 614 | LYM791 | 80.7 | globlastp |
| citrus\|gb166\|BQ623381 | 3686 | 8292 | 614 | LYM791 | 80.7 | globlastp |
| clementine\|11v1\|BQ623381_P1 | 3687 | 8292 | 614 | LYM791 | 80.7 | globlastp |
| cucumber\|09v1\|AM718972_P1 | 3688 | 8293 | 614 | LYM791 | 80.7 | globlastp |
| eucalyptus\|11v2\|CT980295_P1 | 3689 | 8294 | 614 | LYM791 | 80.7 | globlastp |
| euonymus\|11v1\|SRR070038X151412_P1 | 3690 | 8295 | 614 | LYM791 | 80.7 | globlastp |
| orange\|11v1\|BQ623381_P1 | 3691 | 8292 | 614 | LYM791 | 80.7 | globlastp |
| aristolochia\|10v1\|SRR039082S0213963_T1 | 3692 | 8296 | 614 | LYM791 | 80.63 | glotblastn |
| eschscholzia\|11v1\|SRR014116.121286_T1 | 3693 | 8297 | 614 | LYM791 | 80.54 | glotblastn |
| euphorbia\|11v1\|DV122926_P1 | 3694 | 8298 | 614 | LYM791 | 80.3 | globlastp |
| melon\|10v1\|AM718972_P1 | 3695 | 8299 | 614 | LYM791 | 80.3 | globlastp |
| vinca\|11v1\|SRR098690X100565 | 3696 | 8300 | 614 | LYM791 | 80.3 | globlastp |
| gossypium_raimondii\|12v1\|AI055720_T1 | 3697 | 8301 | 614 | LYM791 | 80.18 | glotblastn |
| gossypium_raimondii\|12v1\|AI726589_T1 | 3698 | 8302 | 614 | LYM791 | 80.18 | glotblastn |
| beech\|11v1\|SRR006293.20892_T1 | 3699 | 8303 | 614 | LYM791 | 80.18 | glotblastn |
| cirsium\|11v1\|SRR346952.178763_T1 | 3700 | 8304 | 614 | LYM791 | 80.18 | glotblastn |
| coffea\|10v1\|DV666791_T1 | 3701 | 8305 | 614 | LYM791 | 80.18 | glotblastn |
| cotton\|11v1\|AI726171_T1 | 3702 | 8301 | 614 | LYM791 | 80.18 | glotblastn |
| cotton\|11v1\|AI726589_T1 | 3703 | 8302 | 614 | LYM791 | 80.18 | glotblastn |
| cucurbita\|11v1\|FG227623_T1 | 3704 | 8306 | 614 | LYM791 | 80.18 | glotblastn |
| fraxinus\|11v1\|SRR058827.102544_T1 | 3705 | 8307 | 614 | LYM791 | 80.18 | glotblastn |
| heritiera\|10v1\|SRR005794S0002323_T1 | 3706 | 8308 | 614 | LYM791 | 80.18 | glotblastn |
| phyla\|11v2\|SRR099035X100712_T1 | 3707 | 8309 | 614 | LYM791 | 80.18 | glotblastn |
| podocarpus\|10v1\|SRR065014S0006464_T1 | 3708 | 8310 | 614 | LYM791 | 80.18 | glotblastn |
| spruce\|11v1\|ES854277 | 3709 | 8311 | 614 | LYM791 | 80.18 | glotblastn |
| triphysaria\|10v1\|BM356580 | 3710 | 8312 | 614 | LYM791 | 80.18 | glotblastn |
| tripterygium\|11v1\|SRR098677X113442 | 3711 | 8313 | 614 | LYM791 | 80.18 | glotblastn |
| poppy\|11v1\|SRR030259.13818_T1 | 3712 | 8314 | 614 | LYM791 | 80.09 | glotblastn |
| primula\|11v1\|SRR098679X11393_T1 | 3713 | 8315 | 614 | LYM791 | 80.09 | glotblastn |
| sequoia\|10v1\|SRR065044S0030724 | 3714 | 8316 | 614 | LYM791 | 80 | globlastp |
| switchgrass\|gb167\|FE642097 | 3715 | 8317 | 615 | LYM792 | 97.7 | globlastp |
| sorghum\|11v1\|SB02G006440 | 3716 | 8318 | 615 | LYM792 | 90.9 | globlastp |
| sorghum\|12v1\|SB02G006440_P1 | 3717 | 8318 | 615 | LYM792 | 90.9 | globlastp |
| maize\|10v1\|BU037045_P1 | 3718 | 8319 | 615 | LYM792 | 89.4 | globlastp |
| millet\|10v1\|EVO454PM024422_P1 | 3719 | 8320 | 615 | LYM792 | 86.5 | globlastp |
| maize\|10v1\|GRMZM2G062186T01_P1 | 3720 | 8321 | 615 | LYM792 | 86 | globlastp |
| brachypodium\|12v1\|BRADI1G54020_P1 | 3721 | 8322 | 615 | LYM792 | 81.3 | globlastp |
| brachypodium\|12v1\|BRADI1G54020_P1 | 3721 | 8322 | 721 | LYM904 | 82.6 | globlastp |
| switchgrass\|gb167\|GD020754 | 3722 | 8323 | 615 | LYM792 | 81.3 | globlastp |
| brachypodium\|09v1\|GT806175 | 3723 | 8322 | 615 | LYM792 | 81.3 | globlastp |
| brachypodium\|09v1\|GT806175 | 3723 | 8322 | 721 | LYM904 | 82.6 | globlastp |
| switchgrass\|gb167\|FL740315 | 3724 | 8324 | 615 | LYM792 | 81.1 | globlastp |
| switchgrass\|gb167\|FL740315 | 3724 | 8324 | 721 | LYM904 | 94 | globlastp |
| brachypodium\|12v1\|BRADI1G04590_P1 | 3725 | 8325 | 615 | LYM792 | 80.2 | globlastp |
| brachypodium\|12v1\|BRADI1G04590_P1 | 3725 | 8325 | 721 | LYM904 | 90.7 | globlastp |
| brachypodium\|09v1\|GT765484 | 3726 | 8325 | 615 | LYM792 | 80.2 | globlastp |
| brachypodium\|09v1\|GT765484 | 3726 | 8325 | 721 | LYM904 | 90.7 | globlastp |
| rye\|12v1\|DRR001012.20034_P1 | 3727 | 8326 | 615 | LYM792 | 80 | globlastp |
| rye\|12v1\|DRR001012.20034_P1 | 3727 | 8326 | 721 | LYM904 | 88 | globlastp |
| maize\|10v1\|BM659995_P1 | 3728 | 616 | 616 | LYM793 | 100 | globlastp |
| wheat\|10v2\|CA623441 | 3729 | 8327 | 616 | LYM793 | 98.18 | glotblastn |
| maize\|10v1\|CO440619_P1 | 3730 | 8328 | 616 | LYM793 | 96.4 | globlastp |
| millet\|10v1\|EVO454PM001695_P1 | 3731 | 8329 | 616 | LYM793 | 96.4 | globlastp |
| switchgrass\|gb167\|GD007908 | 3732 | 8330 | 616 | LYM793 | 96.4 | globlastp |
| sorghum\|11v1\|SB02G007040 | 3733 | 8331 | 616 | LYM793 | 94.5 | globlastp |
| sorghum\|12v1\|SB02G007040_P1 | 3734 | 8331 | 616 | LYM793 | 94.5 | globlastp |
| switchgrass\|gb167\|GD012617 | 3735 | 8332 | 616 | LYM793 | 94.5 | globlastp |
| rice\|11v1\|AU063135 | 3736 | 8333 | 616 | LYM793 | 89.09 | glotblastn |
| rye\|12v1\|BF146023_T1 | 3737 | 8334 | 616 | LYM793 | 87.27 | glotblastn |
| rye\|12v1\|DRR001017.1112672_T1 | 3738 | — | 616 | LYM793 | 87.27 | glotblastn |
| wheat\|12v3\|CA640176_T1 | 3739 | 8335 | 616 | LYM793 | 85.45 | glotblastn |
| rye\|gb164\|BF146023 | 3740 | 8336 | 616 | LYM793 | 84.2 | globlastp |
| barley\|12v1\|BF253430_T1 | 3741 | 8337 | 616 | LYM793 | 83.64 | glotblastn |
| brachypodium\|12v1\|BRADI1G55840_T1 | 3742 | 8338 | 616 | LYM793 | 83.64 | glotblastn |
| barley\|10v2\|BF253430 | 3743 | 8339 | 616 | LYM793 | 83.64 | glotblastn |
| rice\|11v1\|AU093694 | 3744 | — | 616 | LYM793 | 83.64 | glotblastn |
| brachypodium\|09v1\|DV483701 | 3745 | 8340 | 616 | LYM793 | 83.6 | globlastp |
| rye\|12v1\|DRR001012.258436_T1 | 3746 | 8341 | 616 | LYM793 | 82.14 | glotblastn |
| rye\|12v1\|DRR001012.659025_T1 | 3747 | 8342 | 616 | LYM793 | 82.14 | glotblastn |
| wheat\|10v2\|CA640176 | 3748 | — | 616 | LYM793 | 81.82 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| wheat\|12v3\|BG313070_T1 | 3749 | 8343 | 616 | LYM793 | 80.36 | glotblastn |
| maize\|10v1\|AI861684_P1 | 3750 | 8344 | 618 | LYM795 | 93.5 | globlastp |
| sorghum\|11v1\|SB01G010450 | 3751 | 8345 | 618 | LYM795 | 93.5 | globlastp |
| sorghum\|12v1\|SB01G010450_P1 | 3752 | 8345 | 618 | LYM795 | 93.5 | globlastp |
| maize\|10v1\|BI180407_P1 | 3753 | 8346 | 618 | LYM795 | 91.9 | globlastp |
| switchgrass\|gb167\|DN147279 | 3754 | 8347 | 618 | LYM795 | 89.2 | globlastp |
| sugarcane\|10v1\|CA127353 | 3755 | 8348 | 618 | LYM795 | 84.21 | glotblastn |
| millet\|10v1\|EVO454PM107104_P1 | 3756 | 8349 | 618 | LYM795 | 80.5 | globlastp |
| pseudoroegneria\|gb167\|FF352743 | 3757 | 8350 | 618 | LYM795 | 80.4 | globlastp |
| brachypodium\|12v1\|BRADI1G11270_P1 | 3758 | 8351 | 618 | LYM795 | 80.3 | globlastp |
| brachypodium\|09v1\|GT790986 | 3759 | 8351 | 618 | LYM795 | 80.3 | globlastp |
| sorghum\|11v1\|SB01G009060 | 3760 | 8352 | 619 | LYM796 | 86.4 | globlastp |
| sorghum\|12v1\|SB01G009060_P1 | 3761 | 8352 | 619 | LYM796 | 86.4 | globlastp |
| switchgrass\|gb167\|FE631837 | 3762 | 8353 | 620 | LYM797 | 87.2 | globlastp |
| sorghum\|11v1\|SB08G002310 | 3763 | 8354 | 621 | LYM798 | 82 | globlastp |
| sorghum\|12v1\|SB08G002310_P1 | 3764 | 8354 | 621 | LYM798 | 82 | globlastp |
| switchgrass\|gb167\|FL949403 | 3765 | 8355 | 622 | LYM799 | 80.9 | globlastp |
| foxtail_millet\|11v3\|PHY7SI031474M_P1 | 3766 | 8356 | 622 | LYM799 | 80 | globlastp |
| sorghum\|12v1\|SB01G037510_P1 | 3767 | 8357 | 623 | LYM800 | 80.9 | globlastp |
| sorghum\|11v1\|SB01G037510 | 3768 | 8357 | 623 | LYM800 | 80.9 | globlastp |
| sugarcane\|10v1\|CA066327 | 3769 | 8358 | 624 | LYM801 | 95 | globlastp |
| sorghum\|11v1\|SB01G035280 | 3770 | 8359 | 624 | LYM801 | 93.9 | globlastp |
| sorghum\|12v1\|SB01G035280_P1 | 3771 | 8359 | 624 | LYM801 | 93.9 | globlastp |
| switchgrass\|gb167\|DN143840 | 3772 | 8360 | 624 | LYM801 | 91.5 | globlastp |
| foxtail_millet\|11v3\|PHY7SI035065M_P1 | 3773 | 8361 | 624 | LYM801 | 91.3 | globlastp |
| rice\|11v1\|AA750837 | 3774 | 8362 | 624 | LYM801 | 83.4 | globlastp |
| millet\|10v1\|EVO454PM004194_P1 | 3775 | 8363 | 624 | LYM801 | 81.8 | globlastp |
| rye\|12v1\|DRR001012.119491_P1 | 3776 | 8364 | 624 | LYM801 | 80.9 | globlastp |
| brachypodium\|12v1\|BRADI1G62330_P1 | 3777 | 8365 | 624 | LYM801 | 80.8 | globlastp |
| brachypodium\|09v1\|GT762296 | 3778 | 8365 | 624 | LYM801 | 80.8 | globlastp |
| wheat\|10v2\|BG314304 | 3779 | 8366 | 624 | LYM801 | 80.7 | globlastp |
| wheat\|12v3\|BG263259_P1 | 3780 | 8366 | 624 | LYM801 | 80.7 | globlastp |
| barley\|10v2\|BG299410 | 3781 | 8367 | 624 | LYM801 | 80.5 | glotblastn |
| switchgrass\|gb167\|DN141150 | 3782 | 8368 | 625 | LYM802 | 97.4 | globlastp |
| millet\|10v1\|EVO454PM006416_P1 | 3783 | 8369 | 625 | LYM802 | 97.2 | globlastp |
| foxtail_millet\|11v3\|EC612208_P1 | 3784 | 8370 | 625 | LYM802 | 97 | globlastp |
| maize\|10v1\|AI943839_P1 | 3785 | 8371 | 625 | LYM802 | 97 | globlastp |
| sorghum\|11v1\|SB02G041180 | 3786 | 8372 | 625 | LYM802 | 96.4 | globlastp |
| sugarcane\|10v1\|CA071332 | 3787 | 8372 | 625 | LYM802 | 96.4 | globlastp |
| sorghum\|12v1\|SB02G041180_P1 | 3788 | 8372 | 625 | LYM802 | 96.4 | globlastp |
| foxtail_millet\|11v3\|EC613100_P1 | 3789 | 8373 | 625 | LYM802 | 94 | globlastp |
| wheat\|12v3\|BE585763_P1 | 3790 | 8374 | 625 | LYM802 | 93.7 | globlastp |
| rice\|11v1\|BI796419 | 3791 | 8375 | 625 | LYM802 | 93.7 | globlastp |
| wheat\|10v2\|BE492404 | 3792 | 8374 | 625 | LYM802 | 93.7 | globlastp |
| wheat\|12v3\|BG607596_P1 | 3793 | 8376 | 625 | LYM802 | 93.7 | globlastp |
| wheat\|12v3\|BQ243590_P1 | 3794 | 8377 | 625 | LYM802 | 93.5 | globlastp |
| barley\|10v2\|BE412429 | 3795 | 8378 | 625 | LYM802 | 93.5 | globlastp |
| barley\|12v1\|BE412429_P1 | 3796 | 8378 | 625 | LYM802 | 93.5 | globlastp |
| sorghum\|11v1\|SBPRD032521 | 3797 | 8379 | 625 | LYM802 | 93.5 | globlastp |
| pseudoroegneria\|gb167\|FF348041 | 3798 | 8380 | 625 | LYM802 | 93.3 | globlastp |
| oat\|11v1\|BE439051_P1 | 3799 | 8381 | 625 | LYM802 | 93.1 | globlastp |
| rye\|12v1\|BE637093_P1 | 3800 | 8382 | 625 | LYM802 | 92.7 | globlastp |
| rye\|12v1\|DRR001012.107798_P1 | 3801 | 8382 | 625 | LYM802 | 92.7 | globlastp |
| amorphophallus\|11v2\|SRR089351X10911_T1 | 3802 | 8383 | 625 | LYM802 | 89.33 | glotblastn |
| banana\|12v1\|MAGEN2012001694_P1 | 3803 | 8384 | 625 | LYM802 | 88.8 | globlastp |
| apple\|11v1\|CN491847_P1 | 3804 | 8385 | 625 | LYM802 | 88.7 | globlastp |
| banana\|12v1\|FF561689_P1 | 3805 | 8386 | 625 | LYM802 | 88.5 | globlastp |
| cotton\|11v1\|BE053213XX2_T1 | 3806 | 8387 | 625 | LYM802 | 88.32 | glotblastn |
| apple\|11v1\|CN868707_T1 | 3807 | 8388 | 625 | LYM802 | 88.29 | glotblastn |
| artemisia\|10v1\|EY032215_T1 | 3808 | 8389 | 625 | LYM802 | 88.12 | glotblastn |
| gossypium_raimondii\|12v1\|AI725585_P1 | 3809 | 8390 | 625 | LYM802 | 88.1 | globlastp |
| castorbean\|11v1\|SRR020784.102470_T1 | 3810 | 8391 | 625 | LYM802 | 88.1 | glotblastn |
| eschscholzia\|11v1\|CD478412_P1 | 3811 | 8392 | 625 | LYM802 | 88.1 | globlastp |
| flaveria\|11v1\|SRR149229.106199_P1 | 3812 | 8393 | 625 | LYM802 | 88.1 | globlastp |
| flaveria\|11v1\|SRR149229.107813_P1 | 3813 | 8393 | 625 | LYM802 | 88.1 | globlastp |
| flaveria\|11v1\|SRR149229.117290_P1 | 3814 | 8393 | 625 | LYM802 | 88.1 | globlastp |
| gossypium_raimondii\|12v1\|BE053213_P1 | 3815 | 8394 | 625 | LYM802 | 87.9 | globlastp |
| sunflower\|12v1\|AJ828555_P1 | 3816 | 8395 | 625 | LYM802 | 87.9 | globlastp |
| b_rapa\|11v1\|AT002142_P1 | 3817 | 8396 | 625 | LYM802 | 87.9 | globlastp |
| b_rapa\|11v1\|CD835634_P1 | 3818 | 8397 | 625 | LYM802 | 87.9 | globlastp |
| canola\|11v1\|EE464426_P1 | 3819 | 8397 | 625 | LYM802 | 87.9 | globlastp |
| cotton\|11v1\|AI725585_P1 | 3820 | 8398 | 625 | LYM802 | 87.9 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| flaveria\|11v1\|SRR149232.441496_P1 | 3821 | 8399 | 625 | LYM802 | 87.9 | globlastp |
| prunus\|10v1\|CN491847 | 3822 | 8400 | 625 | LYM802 | 87.9 | globlastp |
| strawberry\|11v1\|CO816900 | 3823 | 8401 | 625 | LYM802 | 87.9 | globlastp |
| chelidonium\|11v1\|SRR084752X100517_P1 | 3824 | 8402 | 625 | LYM802 | 87.8 | globlastp |
| tripterygium\|11v1\|SRR098677X106968 | 3825 | 8403 | 625 | LYM802 | 87.8 | globlastp |
| flaveria\|11v1\|SRR149229.103282_T1 | 3826 | 8404 | 625 | LYM802 | 87.77 | glotblastn |
| ambrosia\|11v1\|SRR346935.111596_T1 | 3827 | 8405 | 625 | LYM802 | 87.7 | glotblastn |
| arabidopsis\|10v1\|AT5G08530_P1 | 3828 | 8406 | 625 | LYM802 | 87.7 | globlastp |
| basilicum\|10v1\|DY321453_T1 | 3829 | 8407 | 625 | LYM802 | 87.7 | glotblastn |
| orange\|11v1\|CF830968_P1 | 3830 | 8408 | 625 | LYM802 | 87.7 | globlastp |
| poppy\|11v1\|SRR030259.108439_P1 | 3831 | 8409 | 625 | LYM802 | 87.7 | globlastp |
| thellungiella_halophilum\|11v1\|DN773005 | 3832 | 8410 | 625 | LYM802 | 87.7 | globlastp |
| thellungiella_parvulum\|11v1\|DN773005 | 3833 | 8411 | 625 | LYM802 | 87.7 | glotblastn |
| beech\|11v1\|SRR006293.24955_P1 | 3834 | 8412 | 625 | LYM802 | 87.6 | globlastp |
| cacao\|10v1\|CU475028_P1 | 3835 | 8413 | 625 | LYM802 | 87.6 | globlastp |
| tripterygium\|11v1\|SRR098677X105164 | 3836 | 8414 | 625 | LYM802 | 87.6 | globlastp |
| flaveria\|11v1\|SRR149232.135814_T1 | 3837 | 8415 | 625 | LYM802 | 87.52 | glotblastn |
| arabidopsis_lyrata\|09v1\|JGIAL020563_P1 | 3838 | 8416 | 625 | LYM802 | 87.5 | globlastp |
| canola\|11v1\|DW997793_P1 | 3839 | 8417 | 625 | LYM802 | 87.5 | globlastp |
| canola\|11v1\|EE440775_P1 | 3840 | 8418 | 625 | LYM802 | 87.5 | globlastp |
| cassava\|09v1\|DB925448_P1 | 3841 | 8419 | 625 | LYM802 | 87.5 | globlastp |
| citrus\|gb166\|CF830968 | 3842 | 8420 | 625 | LYM802 | 87.5 | globlastp |
| flax\|11v1\|CV478866_T1 | 3843 | 8421 | 625 | LYM802 | 87.5 | glotblastn |
| monkeyflower\|10v1\|DV212089_P1 | 3844 | 8422 | 625 | LYM802 | 87.5 | globlastp |
| poppy\|11v1\|SRR030259.103397_P1 | 3845 | 8423 | 625 | LYM802 | 87.5 | globlastp |
| radish\|gb164\|EV566713 | 3846 | 8424 | 625 | LYM802 | 87.5 | globlastp |
| canola\|11v1\|EV090290_P1 | 3847 | 8425 | 625 | LYM802 | 87.4 | globlastp |
| ambrosia\|11v1\|SRR346943.160124_T1 | 3848 | 8426 | 625 | LYM802 | 87.33 | glotblastn |
| rose\|12v1\|BI977918_P1 | 3849 | 8427 | 625 | LYM802 | 87.3 | globlastp |
| sunflower\|12v1\|CD856203_P1 | 3850 | 8428 | 625 | LYM802 | 87.3 | globlastp |
| ambrosia\|11v1\|SRR346935.115872_P1 | 3851 | 8429 | 625 | LYM802 | 87.3 | globlastp |
| b_rapa\|11v1\|CD827770_P1 | 3852 | 8430 | 625 | LYM802 | 87.3 | globlastp |
| sunflower\|10v1\|CD856203 | 3853 | 8428 | 625 | LYM802 | 87.3 | globlastp |
| triphysaria\|10v1\|EY005560 | 3854 | 8431 | 625 | LYM802 | 87.3 | glotblastn |
| banana\|12v1\|BBS1271T3_P1 | 3855 | 8432 | 625 | LYM802 | 87.1 | globlastp |
| ambrosia\|11v1\|SRR346935.107496_P1 | 3856 | 8433 | 625 | LYM802 | 87.1 | globlastp |
| ambrosia\|11v1\|SRR346935.277932_P1 | 3857 | 8434 | 625 | LYM802 | 87.1 | globlastp |
| arnica\|11v1\|SRR099034X108162_P1 | 3858 | 8435 | 625 | LYM802 | 87.1 | globlastp |
| banana\|10v1\|BBS1271T3 | 3859 | 8436 | 625 | LYM802 | 87.1 | globlastp |
| castorbean\|11v1\|EG665646_P1 | 3860 | 8437 | 625 | LYM802 | 87.1 | globlastp |
| flaveria\|11v1\|SRR149242.7271_P1 | 3861 | 8438 | 625 | LYM802 | 87.1 | globlastp |
| nasturtium\|11v1\|GH171079_P1 | 3862 | 8439 | 625 | LYM802 | 87.1 | globlastp |
| oak\|10v1\|FP025013_P1 | 3863 | 8440 | 625 | LYM802 | 87.1 | globlastp |
| peanut\|10v1\|CX127921_P1 | 3864 | 8441 | 625 | LYM802 | 87.1 | globlastp |
| cowpea\|12v1\|FC457320_P1 | 3865 | 8442 | 625 | LYM802 | 87 | globlastp |
| cowpea\|gb166\|FC457320 | 3866 | 8442 | 625 | LYM802 | 87 | globlastp |
| ambrosia\|11v1\|SRR346935.13474_T1 | 3867 | 8443 | 625 | LYM802 | 86.98 | glotblastn |
| catharanthus\|11v1\|EG559737_T1 | 3868 | 8444 | 625 | LYM802 | 86.98 | glotblastn |
| arnica\|11v1\|SRR099034X101538_P1 | 3869 | 8445 | 625 | LYM802 | 86.9 | globlastp |
| flaveria\|11v1\|SRR149232.133183_T1 | 3870 | 8446 | 625 | LYM802 | 86.9 | glotblastn |
| papaya\|gb165\|EX229217_P1 | 3871 | 8447 | 625 | LYM802 | 86.9 | globlastp |
| poplar\|10v1\|AI163800_P1 | 3872 | 8448 | 625 | LYM802 | 86.9 | globlastp |
| euonymus\|11v1\|SRR070038X104832_P1 | 3873 | 8449 | 625 | LYM802 | 86.8 | globlastp |
| blueberry\|12v1\|SRR353282X17581D1_T1 | 3874 | 8450 | 625 | LYM802 | 86.71 | glotblastn |
| cannabis\|12v1\|EW700903_P1 | 3875 | 8451 | 625 | LYM802 | 86.7 | globlastp |
| cannabis\|12v1\|GR222055_P1 | 3876 | 8451 | 625 | LYM802 | 86.7 | globlastp |
| lettuce\|12v1\|DW049937_P1 | 3877 | 8452 | 625 | LYM802 | 86.7 | globlastp |
| aquilegia\|10v1\|DR917470 | 3878 | 8453 | 625 | LYM802 | 86.7 | globlastp |
| chestnut\|gb170\|SRR006295S0001554_P1 | 3879 | 8454 | 625 | LYM802 | 86.7 | globlastp |
| kiwi\|gb166\|FG396650_P1 | 3880 | 8455 | 625 | LYM802 | 86.7 | globlastp |
| lettuce\|10v1\|DW049937 | 3881 | 8452 | 625 | LYM802 | 86.7 | globlastp |
| poppy\|11v1\|SRR030260.120527_P1 | 3882 | 8456 | 625 | LYM802 | 86.7 | globlastp |
| senecio\|gb170\|CO553371 | 3883 | 8457 | 625 | LYM802 | 86.7 | globlastp |
| aquilegia\|10v2\|DR917470_P1 | 3884 | 8458 | 625 | LYM802 | 86.5 | globlastp |
| cichorium\|gb171\|DT213112_P1 | 3885 | 8459 | 625 | LYM802 | 86.5 | globlastp |
| cirsium\|11v1\|SRR346952.102675_P1 | 3886 | 8460 | 625 | LYM802 | 86.5 | globlastp |
| euonymus\|11v1\|SRR070038X112727_P1 | 3887 | 8461 | 625 | LYM802 | 86.5 | globlastp |
| pigeonpea\|11v1\|GW348129_P1 | 3888 | 8462 | 625 | LYM802 | 86.5 | globlastp |
| amborella\|12v3\|SRR038635.95481_P1 | 3889 | 8463 | 625 | LYM802 | 86.4 | globlastp |
| brachypodium\|12v1\|BRADI1G53800_P1 | 3890 | 8464 | 625 | LYM802 | 86.4 | globlastp |
| amsonia\|11v1\|SRR098688X100337_P1 | 3891 | 8465 | 625 | LYM802 | 86.4 | globlastp |
| bean\|gb167\|CX129870 | 3892 | 8466 | 625 | LYM802 | 86.4 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| brachypodium\|09v1\|DV470930 | 3893 | 8464 | 625 | LYM802 | 86.4 | globlastp |
| phalaenopsis\|11v1\|SRR125771.1012225_P1 | 3894 | 8467 | 625 | LYM802 | 86.4 | globlastp |
| cleome_gynandra\|10v1\|SRR015532S0000978_P1 | 3895 | 8468 | 625 | LYM802 | 86.3 | globlastp |
| grape\|11v1\|GSVIVT01020401001_P1 | 3896 | 8469 | 625 | LYM802 | 86.3 | globlastp |
| melon\|10v1\|DV634911_P1 | 3897 | 8470 | 625 | LYM802 | 86.3 | globlastp |
| watermelon\|11v1\|CO996586 | 3898 | 8471 | 625 | LYM802 | 86.3 | globlastp |
| bean\|12v1\|CB539416_P1 | 3899 | 8472 | 625 | LYM802 | 86.2 | globlastp |
| medicago\|12v1\|AI974782_P1 | 3900 | 8473 | 625 | LYM802 | 86.2 | globlastp |
| antirrhinum\|gb166\|AJ559895_P1 | 3901 | 8474 | 625 | LYM802 | 86.2 | globlastp |
| olea\|11v1\|SRR014463.111_P1 | 3902 | 8475 | 625 | LYM802 | 86.2 | globlastp |
| potato\|10v1\|X83999_P1 | 3903 | 8476 | 625 | LYM802 | 86.2 | globlastp |
| solanum_phureja\|09v1\|SPHX83999 | 3904 | 8476 | 625 | LYM802 | 86.2 | globlastp |
| tomato\|11v1\|X83999 | 3905 | 8477 | 625 | LYM802 | 86.1 | globlastp |
| watermelon\|11v1\|VMEL01289008711732 | 3906 | 8478 | 625 | LYM802 | 86.1 | globlastp |
| tabernaemontana\|11v1\|SRR098689X11379 | 3907 | 8479 | 625 | LYM802 | 86 | globlastp |
| vinca\|11v1\|SRR098690X111477 | 3908 | 8480 | 625 | LYM802 | 86 | globlastp |
| trigonella\|11v1\|SRR066194X135631 | 3909 | 8481 | 625 | LYM802 | 85.9 | globlastp |
| triphysaria\|10v1\|BE574864 | 3910 | 8482 | 625 | LYM802 | 85.9 | globlastp |
| aristolochia\|10v1\|FD762297_P1 | 3911 | 8483 | 625 | LYM802 | 85.8 | globlastp |
| oil_palm\|11v1\|SRR190698.106127_T1 | 3912 | 8484 | 625 | LYM802 | 85.8 | glotblastn |
| amborella\|12v3\|SRR038634.27796_P1 | 3913 | 8485 | 625 | LYM802 | 85.7 | globlastp |
| cucumber\|09v1\|DN910426_P1 | 3914 | 8486 | 625 | LYM802 | 85.7 | globlastp |
| chickpea\|11v1\|DY475325_P1 | 3915 | 8487 | 625 | LYM802 | 85.6 | globlastp |
| euphorbia\|11v1\|DV126462_P1 | 3916 | 8488 | 625 | LYM802 | 85.6 | globlastp |
| b_juncea\|12v1\|E6ANDIZ01AWYFB_P1 | 3917 | 8489 | 625 | LYM802 | 85.5 | globlastp |
| maritime_pine\|10v1\|BX252920_P1 | 3918 | 8490 | 625 | LYM802 | 85.5 | globlastp |
| oil_palm\|11v1\|SRR190698.100199_P1 | 3919 | 8491 | 625 | LYM802 | 85.5 | globlastp |
| pine\|10v2\|AW011512_P1 | 3920 | 8492 | 625 | LYM802 | 85.5 | globlastp |
| soybean\|11v1\|GLYMA10G00820 | 3921 | 8493 | 625 | LYM802 | 85.5 | globlastp |
| zostera\|10v1\|AM767752 | 3922 | 8494 | 625 | LYM802 | 85.5 | globlastp |
| beet\|12v1\|AW697792_P1 | 3923 | 8495 | 625 | LYM802 | 85.4 | globlastp |
| vinca\|11v1\|SRR098690X120326 | 3924 | 8496 | 625 | LYM802 | 85.4 | globlastp |
| abies\|11v2\|SRR098676X11672_P1 | 3925 | 8497 | 625 | LYM802 | 85.3 | globlastp |
| eucalyptus\|11v2\|ES594951_P1 | 3926 | 8498 | 625 | LYM802 | 85.3 | globlastp |
| eucalyptus\|11v2\|SRR001658X2821_P1 | 3927 | 8499 | 625 | LYM802 | 85.3 | globlastp |
| soybean\|11v1\|GLYMA02G00590 | 3928 | 8500 | 625 | LYM802 | 85.3 | globlastp |
| valeriana\|11v1\|SRR099039X113217 | 3929 | 8501 | 625 | LYM802 | 85.2 | globlastp |
| spruce\|11v1\|ES253828 | 3930 | 8502 | 625 | LYM802 | 85.1 | globlastp |
| clementine\|11v1\|CF830968_P1 | 3931 | 8503 | 625 | LYM802 | 85 | globlastp |
| tobacco\|gb162\|EB443279 | 3932 | 8504 | 625 | LYM802 | 85 | globlastp |
| canola\|11v1\|SRR329671.213461_P1 | 3933 | 8505 | 625 | LYM802 | 84.7 | globlastp |
| gnetum\|10v1\|SRR064399S0007689_P1 | 3934 | 8506 | 625 | LYM802 | 84.6 | globlastp |
| cephalotaxus\|11v1\|SRR064395X114122_T1 | 3935 | 8507 | 625 | LYM802 | 84.52 | glotblastn |
| sequoia\|10v1\|SRR065044S0002796 | 3936 | 8508 | 625 | LYM802 | 84.52 | glotblastn |
| sciadopitys\|10v1\|SRR065035S0002088 | 3937 | 8509 | 625 | LYM802 | 84.5 | globlastp |
| silene\|11v1\|SRR096785X11597 | 3938 | 8510 | 625 | LYM802 | 84.5 | globlastp |
| silene\|11v1\|SRR096785X104914 | 3939 | 8511 | 625 | LYM802 | 84.3 | globlastp |
| gossypium_raimondii\|12v1\|SRR032368.1045593_T1 | 3940 | 8512 | 625 | LYM802 | 83.96 | glotblastn |
| b_juncea\|12v1\|E6ANDIZ01ANVQ0_P1 | 3941 | 8513 | 625 | LYM802 | 83.1 | globlastp |
| centaurea\|gb166\|EL930880_P1 | 3942 | 8514 | 625 | LYM802 | 83.1 | globlastp |
| scabiosa\|11v1\|SRR063723X102267 | 3943 | 8515 | 625 | LYM802 | 83 | globlastp |
| flaveria\|11v1\|SRR149229.210981_T1 | 3944 | 8516 | 625 | LYM802 | 82.94 | glotblastn |
| flaveria\|11v1\|SRR149232.138505_T1 | 3945 | 8517 | 625 | LYM802 | 82.94 | glotblastn |
| ceratodon\|10v1\|SRR074890S0042487_T1 | 3946 | 8518 | 625 | LYM802 | 81.73 | glotblastn |
| physcomitrella\|10v1\|BJ156899_P1 | 3947 | 8519 | 625 | LYM802 | 81.5 | globlastp |
| physcomitrella\|10v1\|BJ176165_P1 | 3948 | 8520 | 625 | LYM802 | 81.2 | globlastp |
| cenchrus\|gb166\|EB653903_P1 | 3949 | 8521 | 625 | LYM802 | 81 | globlastp |
| distylium\|11v1\|SRR065077X103119_P1 | 3950 | 8522 | 625 | LYM802 | 81 | globlastp |
| utricularia\|11v1\|SRR094438.11014 | 3951 | 8523 | 625 | LYM802 | 80.95 | glotblastn |
| vinca\|11v1\|SRR098690X109654 | 3952 | 8524 | 625 | LYM802 | 80.87 | glotblastn |
| phyla\|11v2\|SRR099035X102090XX2_P1 | 3953 | 8525 | 625 | LYM802 | 80.6 | globlastp |
| orobanche\|10v1\|SRR023189S0006655_P1 | 3954 | 8526 | 625 | LYM802 | 80.2 | globlastp |
| flaveria\|11v1\|SRR149229.40063_P1 | 3955 | 8527 | 625 | LYM802 | 80 | globlastp |
| sorghum\|12v1\|SB06G033130_P1 | 3956 | 8528 | 626 | LYM803 | 98.2 | globlastp |
| sorghum\|11v1\|SB06G033130 | 3957 | 8528 | 626 | LYM803 | 98.2 | globlastp |
| foxtail_millet\|11v3\|PHY7SI013723M_P1 | 3958 | 8529 | 626 | LYM803 | 94.7 | globlastp |
| switchgrass\|gb167\|FE627430 | 3959 | 8530 | 626 | LYM803 | 94.7 | globlastp |
| rice\|11v1\|CA767109 | 3960 | 8531 | 626 | LYM803 | 90 | globlastp |
| brachypodium\|12v1\|BRADI5G26360_P1 | 3961 | 8532 | 626 | LYM803 | 88.2 | globlastp |
| brachypodium\|09v1\|GT839894 | 3962 | 8532 | 626 | LYM803 | 88.2 | globlastp |
| wheat\|12v3\|SRR043323X51096D1_P1 | 3963 | 8533 | 626 | LYM803 | 86.3 | globlastp |
| wheat\|12v3\|BF474567_P1 | 3964 | 8534 | 626 | LYM803 | 86.3 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| brachypodium\|09v1\|BRADI1G30300 | 3965 | 8535 | 626 | LYM803 | 86.28 | glotblastn |
| sugarcane\|10v1\|CA068408 | 3966 | 8536 | 626 | LYM803 | 86.25 | glotblastn |
| barley\|12v1\|AV834994_P1 | 3967 | 8537 | 626 | LYM803 | 86 | globlastp |
| wheat\|10v2\|BF474567 | 3968 | — | 626 | LYM803 | 86 | globlastp |
| rye\|12v1\|DRR001012.14075_P1 | 3969 | 8538 | 626 | LYM803 | 85.8 | globlastp |
| sorghum\|11v1\|SB02G039690 | 3970 | 8539 | 627 | LYM804 | 97.3 | globlastp |
| sorghum\|12v1\|SB02G039690_P1 | 3971 | 8539 | 627 | LYM804 | 97.3 | globlastp |
| maize\|10v1\|BG836474_P1 | 3972 | 8540 | 627 | LYM804 | 96.4 | globlastp |
| foxtail_millet\|11v3\|GT091042_P1 | 3973 | 8541 | 627 | LYM804 | 92.9 | globlastp |
| millet\|10v1\|PMSLX0080343D1_P1 | 3974 | 8542 | 627 | LYM804 | 92.9 | globlastp |
| rice\|11v1\|BM037809 | 3975 | 8543 | 627 | LYM804 | 91.1 | globlastp |
| brachypodium\|12v1\|BRADI1G21360_P1 | 3976 | 8544 | 627 | LYM804 | 86.6 | globlastp |
| brachypodium\|09v1\|DV471398 | 3977 | 8544 | 627 | LYM804 | 86.6 | globlastp |
| rye\|12v1\|DRR001012.121153_P1 | 3978 | 8545 | 627 | LYM804 | 85 | globlastp |
| barley\|10v2\|BE215519 | 3979 | 8545 | 627 | LYM804 | 85 | globlastp |
| wheat\|10v2\|BF200385 | 3980 | 8545 | 627 | LYM804 | 85 | globlastp |
| wheat\|12v3\|BQ788869_P1 | 3981 | 8545 | 627 | LYM804 | 85 | globlastp |
| sugarcane\|10v1\|CA071533_T1 | 3982 | 8546 | 630 | LYM807 | 86.15 | glotblastn |
| sugarcane\|10v1\|CA075417 | 3983 | 8547 | 632 | LYM809 | 84.5 | globlastp |
| maize\|10v1\|DN215924_T1 | 3984 | 8548 | 632 | LYM809 | 81.03 | glotblastn |
| switchgrass\|gb167\|FL741959 | 3985 | 8549 | 633 | LYM811 | 85.8 | globlastp |
| foxtail_millet\|11v3\|PHY7SI018338M_P1 | 3986 | 8550 | 633 | LYM811 | 84.9 | globlastp |
| switchgrass\|gb167\|FL692128 | 3987 | 8551 | 633 | LYM811 | 84.4 | globlastp |
| millet\|10v1\|EVO454PM026405_P1 | 3988 | 8552 | 633 | LYM811 | 82.1 | globlastp |
| sorghum\|11v1\|SB02G013130 | 3989 | 8553 | 635 | LYM813 | 86.7 | globlastp |
| sorghum\|12v1\|SB02G013130_P1 | 3990 | 8553 | 635 | LYM813 | 86.7 | globlastp |
| maize\|10v1\|T15320_P1 | 3991 | 8554 | 635 | LYM813 | 83.4 | globlastp |
| foxtail_millet\|11v3\|PHY7SI028771M_P1 | 3992 | 8555 | 635 | LYM813 | 80.8 | globlastp |
| sugarcane\|10v1\|CA123925 | 3993 | 8556 | 637 | LYM815 | 86.6 | globlastp |
| sorghum\|11v1\|SOLX00011374 | 3994 | 8557 | 637 | LYM815 | 84.9 | globlastp |
| sorghum\|12v1\|SB12V1CRP032790_P1 | 3995 | 8557 | 637 | LYM815 | 84.9 | globlastp |
| sugarcane\|10v1\|CA108379 | 3996 | 8558 | 637 | LYM815 | 83.5 | globlastp |
| wheat\|10v2\|CA487000 | 3997 | 8559 | 637 | LYM815 | 82.8 | globlastp |
| sorghum\|11v1\|SB06G033410 | 3998 | 8560 | 639 | LYM817 | 89.2 | globlastp |
| sorghum\|12v1\|SB06G033410_P1 | 3999 | 8560 | 639 | LYM817 | 89.2 | globlastp |
| foxtail_millet\|11v3\|PHY7SI021736M_P1 | 4000 | 8561 | 639 | LYM817 | 82.7 | globlastp |
| sugarcane\|10v1\|CA076203 | 4001 | 8562 | 640 | LYM818 | 95.6 | globlastp |
| maize\|10v1\|AW067555_P1 | 4002 | 8563 | 640 | LYM818 | 94.9 | globlastp |
| sorghum\|11v1\|SB03G035360 | 4003 | 8564 | 640 | LYM818 | 94.9 | globlastp |
| sorghum\|12v1\|SB03G035360_P1 | 4004 | 8564 | 640 | LYM818 | 94.9 | globlastp |
| switchgrass\|gb167\|DN146919 | 4005 | 8565 | 640 | LYM818 | 94.2 | globlastp |
| wheat\|10v2\|CA626880 | 4006 | 8566 | 640 | LYM818 | 94.16 | glotblastn |
| foxtail_millet\|11v3\|PHY7SI000875M_T1 | 4007 | 8567 | 640 | LYM818 | 93.43 | glotblastn |
| foxtail_millet\|11v3\|SOLX00012840_P1 | 4008 | 8568 | 640 | LYM818 | 93.4 | globlastp |
| millet\|10v1\|CD725782_P1 | 4009 | 8569 | 640 | LYM818 | 93.4 | globlastp |
| switchgrass\|gb167\|FL778458 | 4010 | 8570 | 640 | LYM818 | 93.4 | globlastp |
| wheat\|10v2\|CA620441 | 4011 | 8571 | 640 | LYM818 | 89.05 | glotblastn |
| sugarcane\|10v1\|CA149184 | 4012 | 8572 | 642 | LYM820 | 95.3 | globlastp |
| sorghum\|11v1\|SB04G025320 | 4013 | 8573 | 642 | LYM820 | 93.8 | globlastp |
| sorghum\|12v1\|SB04G025320_P1 | 4014 | 8573 | 642 | LYM820 | 93.8 | globlastp |
| cenchrus\|gb166\|EB654709_P1 | 4015 | 8574 | 642 | LYM820 | 91.5 | globlastp |
| millet\|10v1\|EVO454PM103092_P1 | 4016 | 8575 | 642 | LYM820 | 91.5 | globlastp |
| foxtail_millet\|11v3\|PHY7SI018693M_P1 | 4017 | 8576 | 642 | LYM820 | 90.7 | globlastp |
| sugarcane\|10v1\|CA128413 | 4018 | 8577 | 642 | LYM820 | 89.9 | globlastp |
| switchgrass\|gb167\|FL975806 | 4019 | 8578 | 642 | LYM820 | 87.6 | glotblastn |
| rice\|11v1\|AA751715 | 4020 | 8579 | 642 | LYM820 | 80.6 | globlastp |
| maize\|10v1\|AI901508_P1 | 4021 | 8580 | 643 | LYM821 | 82.4 | globlastp |
| sorghum\|12v1\|SB10G000300_P1 | 4022 | 8581 | 644 | LYM822 | 80.3 | globlastp |
| sugarcane\|10v1\|BQ536022 | 4023 | 8582 | 645 | LYM823 | 93 | globlastp |
| maize\|10v1\|AI395938_P1 | 4024 | 8583 | 645 | LYM823 | 92.4 | globlastp |
| sorghum\|11v1\|SB01G046980 | 4025 | 8584 | 645 | LYM823 | 92.4 | globlastp |
| sorghum\|12v1\|SB01G046980_P1 | 4026 | 8584 | 645 | LYM823 | 92.4 | globlastp |
| cenchrus\|gb166\|EB652764_P1 | 4027 | 8585 | 645 | LYM823 | 91.1 | globlastp |
| foxtail_millet\|11v3\|EC613078_P1 | 4028 | 8586 | 645 | LYM823 | 90.4 | globlastp |
| millet\|10v1\|EVO454PM022385_P1 | 4029 | 8587 | 645 | LYM823 | 89.8 | globlastp |
| switchgrass\|gb167\|DN144395 | 4030 | 8588 | 645 | LYM823 | 89.8 | globlastp |
| switchgrass\|gb167\|DN149704 | 4031 | 8589 | 645 | LYM823 | 89.8 | globlastp |
| switchgrass\|gb167\|FL742506 | 4032 | 8590 | 645 | LYM823 | 88.5 | globlastp |
| maize\|10v1\|SRR014549S0164949_P1 | 4033 | 8591 | 645 | LYM823 | 86.6 | globlastp |
| rice\|11v1\|AU031272 | 4034 | 8592 | 645 | LYM823 | 80.9 | globlastp |
| fescue\|gb161\|DT680544_P1 | 4035 | 8593 | 645 | LYM823 | 80.3 | globlastp |
| rice\|11v1\|BI806914 | 4036 | 8594 | 647 | LYM825 | 85.27 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sorghum\|11v1\|SB06G027000 | 4037 | 8595 | 647 | LYM825 | 83.2 | globlastp |
| sorghum\|12v1\|SB06G027000_P1 | 4038 | 8595 | 647 | LYM825 | 83.2 | globlastp |
| switchgrass\|gb167\|FE628292 | 4039 | 8596 | 647 | LYM825 | 83.2 | globlastp |
| foxtail_millet\|11v3\|PHY7SI010911M_P1 | 4040 | 8597 | 647 | LYM825 | 82.6 | globlastp |
| maize\|10v1\|BM379394_P1 | 4041 | 8598 | 647 | LYM825 | 82.1 | globlastp |
| millet\|10v1\|EVO454PM064158_P1 | 4042 | 8599 | 647 | LYM825 | 80.5 | globlastp |
| sorghum\|11v1\|SB10G030430 | 4043 | 8600 | 648 | LYM826 | 91 | globlastp |
| sorghum\|12v1\|SB10G030430_P1 | 4044 | 8600 | 648 | LYM826 | 91 | globlastp |
| foxtail_millet\|11v3\|PHY7SI006351M_P1 | 4045 | 8601 | 648 | LYM826 | 90.5 | globlastp |
| maize\|10v1\|CD964562_P1 | 4046 | 8602 | 648 | LYM826 | 90.3 | globlastp |
| rice\|11v1\|AU089810 | 4047 | 8603 | 648 | LYM826 | 84.8 | globlastp |
| brachypodium\|12v1\|BRADI1G29960_P1 | 4048 | 8604 | 648 | LYM826 | 84.2 | globlastp |
| brachypodium\|09v1\|SRR031797S0012622 | 4049 | 8604 | 648 | LYM826 | 84.2 | globlastp |
| rye\|12v1\|DRR001012.145349_P1 | 4050 | 8605 | 648 | LYM826 | 80.9 | globlastp |
| sorghum\|11v1\|SB09G016210 | 4051 | 8606 | 649 | LYM827 | 99.4 | globlastp |
| sorghum\|12v1\|SB09G016210_P1 | 4052 | 8606 | 649 | LYM827 | 99.4 | globlastp |
| sugarcane\|10v1\|CA081838 | 4053 | 8607 | 649 | LYM827 | 98.8 | globlastp |
| foxtail_millet\|11v3\|PHY7SI023629M_T1 | 4054 | 8608 | 649 | LYM827 | 97.65 | glotblastn |
| switchgrass\|gb167\|FL781841 | 4055 | 8609 | 649 | LYM827 | 97.6 | globlastp |
| millet\|10v1\|EVO454PM040743_P1 | 4056 | 8610 | 649 | LYM827 | 97.1 | globlastp |
| switchgrass\|gb167\|FL841871 | 4057 | 8611 | 649 | LYM827 | 96.5 | globlastp |
| rice\|11v1\|AU029868 | 4058 | 8612 | 649 | LYM827 | 95.3 | globlastp |
| cynodon\|10v1\|ES293577_P1 | 4059 | 8613 | 649 | LYM827 | 94.1 | globlastp |
| lovegrass\|gb167\|EH185478_P1 | 4060 | 8614 | 649 | LYM827 | 94.1 | globlastp |
| rye\|12v1\|DRR001012.100714_P1 | 4061 | 8615 | 649 | LYM827 | 93.5 | globlastp |
| lolium\|10v1\|AU249847_P1 | 4062 | 8615 | 649 | LYM827 | 93.5 | globlastp |
| oat\|11v1\|CN818763_P1 | 4063 | 8616 | 649 | LYM827 | 93.5 | globlastp |
| pseudoroegneria\|gb167\|FF347979 | 4064 | 8615 | 649 | LYM827 | 93.5 | globlastp |
| wheat\|10v2\|BE405854 | 4065 | 8615 | 649 | LYM827 | 93.5 | globlastp |
| wheat\|12v3\|BE405854_P1 | 4066 | 8615 | 649 | LYM827 | 93.5 | globlastp |
| barley\|12v1\|BF624705_P1 | 4067 | 8617 | 649 | LYM827 | 92.9 | globlastp |
| barley\|10v2\|BF624705 | 4068 | 8617 | 649 | LYM827 | 92.9 | globlastp |
| fescue\|gb161\|DT687884_P1 | 4069 | 8618 | 649 | LYM827 | 92.9 | globlastp |
| oat\|11v1\|CN815087_P1 | 4070 | 8619 | 649 | LYM827 | 92.9 | globlastp |
| wheat\|10v2\|BE430354 | 4071 | 8620 | 649 | LYM827 | 92.9 | globlastp |
| brachypodium\|12v1\|BRADI1G14117_P1 | 4072 | 8621 | 649 | LYM827 | 90.6 | globlastp |
| brachypodium\|09v1\|DV472840 | 4073 | 8621 | 649 | LYM827 | 90.6 | globlastp |
| oil_palm\|11v1\|EL930370_P1 | 4074 | 8622 | 649 | LYM827 | 81.2 | globlastp |
| brachypodium\|12v1\|XM_003562091_T1 | 4075 | — | 649 | LYM827 | 81.18 | glotblastn |
| brachypodium\|09v1\|BRADI1G14120 | 4076 | 8623 | 649 | LYM827 | 80 | glotblastn |
| sorghum\|11v1\|SB02G032270 | 4077 | 8624 | 650 | LYM828 | 95.5 | globlastp |
| sorghum\|12v1\|SB02G032270_P1 | 4078 | 8624 | 650 | LYM828 | 95.5 | globlastp |
| foxtail_millet\|11v3\|PHY7SI030366M_P1 | 4079 | 8625 | 650 | LYM828 | 86.2 | globlastp |
| brachypodium\|12v1\|BRADI4G37380_P1 | 4080 | 8626 | 650 | LYM828 | 84.6 | globlastp |
| brachypodium\|09v1\|DV470315 | 4081 | 8626 | 650 | LYM828 | 84.6 | globlastp |
| rice\|11v1\|BI813497 | 4082 | 8627 | 650 | LYM828 | 83 | globlastp |
| rye\|12v1\|DRR001013.299708_P1 | 4083 | 8628 | 650 | LYM828 | 80.6 | globlastp |
| millet\|10v1\|EVO454PM009576_P1 | 4084 | 8629 | 650 | LYM828 | 80.3 | globlastp |
| rye\|12v1\|DRR001013.210382_P1 | 4085 | 8630 | 650 | LYM828 | 80.1 | globlastp |
| maize\|10v1\|EE298038_T1 | 4086 | 8631 | 652 | LYM830 | 90.65 | glotblastn |
| sorghum\|11v1\|SB07G025880 | 4087 | 8632 | 652 | LYM830 | 83.33 | glotblastn |
| sorghum\|12v1\|SB07G025880_T1 | 4088 | 8632 | 652 | LYM830 | 83.33 | glotblastn |
| sugarcane\|10v1\|CA192574 | 4089 | 8633 | 652 | LYM830 | 82.46 | glotblastn |
| maize\|10v1\|SRR014549S0259380_T1 | 4090 | 8634 | 652 | LYM830 | 80.51 | glotblastn |
| maize\|10v1\|ZMCRP2V066995_T1 | 4091 | 8635 | 652 | LYM830 | 80.51 | glotblastn |
| sugarcane\|10v1\|CA127008 | 4092 | 8636 | 654 | LYM832 | 82 | globlastp |
| sorghum\|11v1\|SB09G024330 | 4093 | 8637 | 654 | LYM832 | 81.2 | globlastp |
| sorghum\|12v1\|SB09G024330_P1 | 4094 | 8637 | 654 | LYM832 | 81.2 | globlastp |
| sorghum\|11v1\|SB04G033880 | 4095 | 8638 | 656 | LYM835 | 87.1 | globlastp |
| sorghum\|12v1\|SB04G033880_P1 | 4096 | 8639 | 656 | LYM835 | 82.9 | globlastp |
| maize\|10v1\|AI948308_P1 | 4097 | 8640 | 656 | LYM835 | 82.9 | globlastp |
| sugarcane\|10v1\|AA080657 | 4098 | 8641 | 656 | LYM835 | 82.5 | globlastp |
| maize\|10v1\|DN216813_P1 | 4099 | 8642 | 658 | LYM837 | 90.4 | globlastp |
| sorghum\|11v1\|SB04G023520 | 4100 | 8643 | 658 | LYM837 | 85.3 | globlastp |
| sorghum\|12v1\|SB04G023520_P1 | 4101 | 8643 | 658 | LYM837 | 85.3 | globlastp |
| sorghum\|11v1\|SB03G006020 | 4102 | 8644 | 660 | LYM839 | 93.2 | globlastp |
| sorghum\|12v1\|SB03G006020_P1 | 4103 | 8644 | 660 | LYM839 | 93.2 | globlastp |
| maize\|10v1\|CF075404_P1 | 4104 | 8645 | 660 | LYM839 | 91.7 | globlastp |
| foxtail_millet\|11v3\|PHY7SI000963M_P1 | 4105 | 8646 | 660 | LYM839 | 90.7 | globlastp |
| rye\|12v1\|DRR001012.166972_P1 | 4106 | 8647 | 660 | LYM839 | 85.8 | globlastp |
| wheat\|10v2\|BE444620 | 4107 | 8648 | 660 | LYM839 | 85.8 | globlastp |
| wheat\|12v3\|BE402102_P1 | 4108 | 8649 | 660 | LYM839 | 85.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| barley\|12v1\|AV832580_P1 | 4109 | 8650 | 660 | LYM839 | 85.7 | globlastp |
| rye\|12v1\|BF145729_P1 | 4110 | 8651 | 660 | LYM839 | 85.5 | globlastp |
| brachypodium\|12v1\|BRADI2G03340_P1 | 4111 | 8652 | 660 | LYM839 | 84.9 | globlastp |
| rice\|11v1\|BE229610 | 4112 | 8653 | 660 | LYM839 | 84.9 | globlastp |
| brachypodium\|09v1\|GT758285 | 4113 | 8654 | 660 | LYM839 | 82.36 | glotblastn |
| sorghum\|11v1\|SB09G021960 | 4114 | 8655 | 661 | LYM840 | 92.3 | globlastp |
| sorghum\|12v1\|SB09G021960_P1 | 4115 | 8655 | 661 | LYM840 | 92.3 | globlastp |
| switchgrass\|gb167\|FE613310 | 4116 | 8656 | 661 | LYM840 | 88.7 | globlastp |
| sugarcane\|10v1\|CA131608 | 4117 | 8657 | 661 | LYM840 | 88.69 | glotblastn |
| switchgrass\|gb167\|FE657927 | 4118 | 8658 | 661 | LYM840 | 87.6 | globlastp |
| foxtail_millet\|11v3\|PHY7SI023451M_P1 | 4119 | 8659 | 661 | LYM840 | 86 | globlastp |
| brachypodium\|09v1\|GT764552 | 4120 | 8660 | 661 | LYM840 | 83.73 | glotblastn |
| brachypodium\|12v1\|BRADI2G23770_P1 | 4121 | 8661 | 661 | LYM840 | 83.2 | globlastp |
| wheat\|10v2\|BQ905249 | 4122 | 8662 | 661 | LYM840 | 83.2 | globlastp |
| rye\|12v1\|DRR001012.113828_P1 | 4123 | 8663 | 661 | LYM840 | 82.7 | globlastp |
| rice\|11v1\|C22651 | 4124 | 8664 | 661 | LYM840 | 82.6 | globlastp |
| oat\|11v1\|SRR020741.219607_P1 | 4125 | 8665 | 661 | LYM840 | 82 | globlastp |
| barley\|10v2\|BE194031 | 4126 | 8666 | 661 | LYM840 | 81.3 | globlastp |
| barley\|12v1\|BE194031_P1 | 4127 | 8666 | 661 | LYM840 | 81.3 | globlastp |
| wheat\|12v3\|BE426452_P1 | 4128 | 8667 | 661 | LYM840 | 80.2 | globlastp |
| lolium\|10v1\|ES699264_P1 | 4129 | 8668 | 661 | LYM840 | 80.2 | globlastp |
| sorghum\|11v1\|SB03G045760 | 4130 | 8669 | 663 | LYM842 | 87.2 | globlastp |
| sorghum\|12v1\|SB03G045760_P1 | 4131 | 8669 | 663 | LYM842 | 87.2 | globlastp |
| foxtail_millet\|11v3\|PHY7SI002405M_P1 | 4132 | 8670 | 663 | LYM842 | 86.2 | globlastp |
| switchgrass\|gb167\|FL760085 | 4133 | 8671 | 663 | LYM842 | 81.91 | glotblastn |
| maize\|10v1\|BG841646_P1 | 4134 | 8672 | 664 | LYM843 | 80.3 | globlastp |
| maize\|10v1\|AI947934_P1 | 4135 | 8673 | 666 | LYM845 | 83.1 | globlastp |
| switchgrass\|gb167\|DN147803 | 4136 | 8674 | 667 | LYM846 | 89.6 | globlastp |
| sorghum\|11v1\|SOLX00014634 | 4137 | 8675 | 667 | LYM846 | 88.5 | globlastp |
| sorghum\|12v1\|SB12V1CUFF15665T1_P1 | 4138 | 8675 | 667 | LYM846 | 88.5 | globlastp |
| foxtail_millet\|11v3\|PHY7SI031651M_P1 | 4139 | 8676 | 667 | LYM846 | 87.5 | globlastp |
| sorghum\|11v1\|SB04G022930 | 4140 | 8677 | 669 | LYM848 | 81.6 | globlastp |
| sorghum\|12v1\|SB04G022930_P1 | 4141 | 8677 | 669 | LYM848 | 81.6 | globlastp |
| sugarcane\|10v1\|CA103370_T1 | 4142 | 8678 | 669 | LYM848 | 81.39 | glotblastn |
| maize\|10v1\|BM660001_T1 | 4143 | 8679 | 669 | LYM848 | 80.39 | glotblastn |
| sorghum\|11v1\|SB07G024440 | 4144 | 8680 | 672 | LYM851 | 95.4 | globlastp |
| sorghum\|12v1\|SB07G024440_P1 | 4145 | 8680 | 672 | LYM851 | 95.4 | globlastp |
| foxtail_millet\|11v3\|PHY7SI013196M_P1 | 4146 | 8681 | 672 | LYM851 | 90.7 | globlastp |
| maize\|10v1\|AI601018_P1 | 4147 | 8682 | 674 | LYM853 | 95.8 | globlastp |
| sorghum\|11v1\|SB02G004540 | 4148 | 8683 | 674 | LYM853 | 95.8 | globlastp |
| sorghum\|12v1\|SB02G004540_P1 | 4149 | 8683 | 674 | LYM853 | 95.8 | globlastp |
| foxtail_millet\|11v3\|PHY7SI034455M_P1 | 4150 | 8684 | 674 | LYM853 | 93.7 | globlastp |
| millet\|10v1\|CD724596_P1 | 4151 | 8685 | 674 | LYM853 | 93.4 | globlastp |
| rice\|11v1\|BQ908102 | 4152 | 8686 | 674 | LYM853 | 88 | globlastp |
| barley\|12v1\|BG310139_P1 | 4153 | 8687 | 674 | LYM853 | 85.7 | globlastp |
| brachypodium\|12v1\|BRADI1G15780_P1 | 4154 | 8688 | 674 | LYM853 | 85.5 | globlastp |
| brachypodium\|09v1\|DV487052 | 4155 | 8688 | 674 | LYM853 | 85.5 | globlastp |
| rye\|12v1\|DRR001012.163809_T1 | 4156 | 8689 | 674 | LYM853 | 84.59 | glotblastn |
| wheat\|12v3\|CA609861_P1 | 4157 | 8690 | 674 | LYM853 | 83.3 | globlastp |
| switchgrass\|gb167\|DN147694 | 4158 | 8691 | 674 | LYM853 | 80.5 | globlastp |
| maize\|10v1\|BG349963_P1 | 4159 | 8692 | 675 | LYM856 | 98.9 | globlastp |
| sorghum\|11v1\|SB01G010980 | 4160 | 8693 | 675 | LYM856 | 87.6 | globlastp |
| sorghum\|12v1\|SB01G010980_P1 | 4161 | 8693 | 675 | LYM856 | 87.6 | globlastp |
| foxtail_millet\|11v3\|PHY7SI018181M_P1 | 4162 | 8694 | 676 | LYM857 | 90 | globlastp |
| foxtail_millet\|11v3\|PHY7SI018181M_P1 | 4162 | 8694 | 753 | LYM937 | 90.2 | globlastp |
| foxtail_millet\|11v3\|PHY7SI032210M_T1 | 4163 | 8695 | 677 | LYM858 | 95.59 | glotblastn |
| sugarcane\|10v1\|CA133787 | 4164 | 8696 | 677 | LYM858 | 95.5 | globlastp |
| sorghum\|11v1\|AW286734 | 4165 | 8697 | 677 | LYM858 | 95.3 | globlastp |
| sorghum\|11v1\|SB02G034570 | 4166 | 8697 | 677 | LYM858 | 95.3 | globlastp |
| switchgrass\|gb167\|FE635877 | 4167 | 8698 | 677 | LYM858 | 95.3 | globlastp |
| sorghum\|12v1\|SB02G034570_P1 | 4168 | 8697 | 677 | LYM858 | 95.3 | globlastp |
| switchgrass\|gb167\|FE637927 | 4169 | 8699 | 677 | LYM858 | 93.9 | globlastp |
| rice\|11v0\|AA753340 | 4170 | 8700 | 677 | LYM858 | 91.8 | globlastp |
| brachypodium\|12v1\|BRADI1G26350_P1 | 4171 | 8701 | 677 | LYM858 | 89.5 | globlastp |
| brachypodium\|09v1\|GT758223 | 4172 | 8701 | 677 | LYM858 | 89.5 | globlastp |
| wheat\|10v2\|BE213370 | 4173 | 8702 | 677 | LYM858 | 87.5 | globlastp |
| wheat\|12v3\|BE430733_P1 | 4174 | 8702 | 677 | LYM858 | 87.5 | globlastp |
| barley\|10v2\|BE420580 | 4175 | 8703 | 677 | LYM858 | 86.9 | globlastp |
| barley\|12v1\|BE420580_P1 | 4176 | 8703 | 677 | LYM858 | 86.9 | globlastp |
| rye\|12v1\|BE704824_P1 | 4177 | 8704 | 677 | LYM858 | 86.7 | globlastp |
| oat\|11v1\|CN817828_P1 | 4178 | 8705 | 677 | LYM858 | 86.7 | globlastp |
| leymus\|gb166\|CD808934_P1 | 4179 | 8706 | 677 | LYM858 | 86.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| millet\|10v1\|CD726507_P1 | 4180 | 8707 | 677 | LYM858 | 86 | globlastp |
| sorghum\|12v1\|AW286734_P1 | 4181 | 8708 | 677 | LYM858 | 82.8 | globlastp |
| fescue\|gb161\|CK803057_P1 | 4182 | 8709 | 677 | LYM858 | 82.2 | globlastp |
| switchgrass\|gb167\|FE637928 | 4183 | 8710 | 677 | LYM858 | 82.2 | globlastp |
| wheat\|10v2\|CA617726 | 4184 | 678 | 678 | LYM859 | 100 | globlastp |
| wheat\|10v2\|CA619800 | 4185 | 678 | 678 | LYM859 | 100 | globlastp |
| wheat\|12v3\|CA617726_P1 | 4186 | 678 | 678 | LYM859 | 100 | globlastp |
| wheat\|10v2\|CA619099 | 4187 | 8711 | 678 | LYM859 | 96.25 | glotblastn |
| sorghum\|12v1\|SB02G010030_T1 | 4188 | 8712 | 683 | LYM865 | 80.88 | glotblastn |
| brachypodium\|12v1\|BRADI1G15030_P1 | 4189 | 8713 | 685 | LYM867 | 88.3 | globlastp |
| brachypodium\|09v1\|DV468983 | 4190 | 8713 | 685 | LYM867 | 88.3 | globlastp |
| foxtail_millet\|11v3\|PHY7SI035549M_P1 | 4191 | 8714 | 685 | LYM867 | 85.1 | globlastp |
| wheat\|12v3\|AK334449_P1 | 4192 | 8715 | 685 | LYM867 | 84.3 | globlastp |
| wheat\|10v2\|AL821132 | 4193 | 8716 | 685 | LYM867 | 84.1 | globlastp |
| maize\|10v1\|CD973459_P1 | 4194 | 8717 | 685 | LYM867 | 83.4 | globlastp |
| sorghum\|11v1\|SB01G015040 | 4195 | 8718 | 685 | LYM867 | 83.4 | globlastp |
| sorghum\|12v1\|SB01G015040_P1 | 4196 | 8718 | 685 | LYM867 | 83.4 | globlastp |
| barley\|10v2\|BQ461420 | 4197 | 8719 | 685 | LYM867 | 83 | globlastp |
| rye\|12v1\|DRR001012.147572_T1 | 4198 | 8720 | 685 | LYM867 | 82.28 | glotblastn |
| maize\|10v1\|BQ619293_P1 | 4199 | 8721 | 686 | LYM868 | 80.8 | globlastp |
| foxtail_millet\|11v3\|GT090841_P1 | 4200 | 8722 | 686 | LYM868 | 80.5 | globlastp |
| oat\|11v1\|GR356351_T1 | 4201 | 8723 | 687 | LYM869 | 80.73 | glotblastn |
| rice\|11v1\|AU031331 | 4202 | 8724 | 694 | LYM876 | 85.1 | globlastp |
| lovegrass\|gb167\|DN481021_P1 | 4203 | 8725 | 695 | LYM877 | 84.7 | globlastp |
| millet\|10v1\|EVO454PM021510_P1 | 4204 | 8726 | 695 | LYM877 | 83 | globlastp |
| sorghum\|12v1\|SB06G031940_P1 | 4205 | 8727 | 695 | LYM877 | 82.8 | globlastp |
| sorghum\|11v1\|SB06G031940 | 4206 | 8727 | 695 | LYM877 | 82.8 | globlastp |
| switchgrass\|gb167\|FL758170 | 4207 | 8728 | 695 | LYM877 | 82.8 | globlastp |
| rye\|12v1\|DRR001012.223025_P1 | 4208 | 8729 | 695 | LYM877 | 82.4 | globlastp |
| pseudoroegneria\|gb167\|FF364930 | 4209 | 8730 | 695 | LYM877 | 82.4 | globlastp |
| maize\|10v1\|AI901671_P1 | 4210 | 8731 | 695 | LYM877 | 81.6 | globlastp |
| brachypodium\|12v1\|BRADI5G25277_P1 | 4211 | 8732 | 695 | LYM877 | 81.4 | globlastp |
| brachypodium\|09v1\|SRR031795S0015152 | 4212 | 8732 | 695 | LYM877 | 81.4 | globlastp |
| wheat\|10v2\|BE402431 | 4213 | 8733 | 695 | LYM877 | 81.4 | globlastp |
| wheat\|10v2\|CD928089 | 4214 | 8734 | 695 | LYM877 | 81.4 | globlastp |
| wheat\|12v3\|BE402431_P1 | 4215 | 8735 | 695 | LYM877 | 81.4 | globlastp |
| rye\|12v1\|BE494356_P1 | 4216 | 8736 | 695 | LYM877 | 81.2 | globlastp |
| rye\|12v1\|DRR001012.385651_P1 | 4217 | 8736 | 695 | LYM877 | 81.2 | globlastp |
| lolium\|10v1\|AU245797_T1 | 4218 | 8737 | 695 | LYM877 | 80 | glotblastn |
| oat\|11v1\|SRR020741.106807_P1 | 4219 | 8738 | 695 | LYM877 | 80 | globlastp |
| rye\|gb164\|BE494356 | 4220 | 8739 | 695 | LYM877 | 80 | glotblastn |
| sorghum\|12v1\|SB01G027690_T1 | 4221 | 8740 | 699 | LYM881 | 99.65 | glotblastn |
| sorghum\|11v1\|BE592418 | 4222 | 8741 | 699 | LYM881 | 99.3 | globlastp |
| maize\|10v1\|AI677288_P1 | 4223 | 8742 | 699 | LYM881 | 97.6 | globlastp |
| sugarcane\|10v1\|CA107353 | 4224 | 8743 | 699 | LYM881 | 97.2 | globlastp |
| foxtail_millet\|11v3\|PHY7SI036887M_P1 | 4225 | 8744 | 699 | LYM881 | 95.8 | globlastp |
| switchgrass\|gb167\|FE638563 | 4226 | 8745 | 699 | LYM881 | 94.1 | globlastp |
| millet\|10v1\|EVO454PM015239_P1 | 4227 | 8746 | 699 | LYM881 | 92.4 | globlastp |
| rice\|11v1\|GFXAC018727X61 | 4228 | 8747 | 699 | LYM881 | 84.5 | globlastp |
| oat\|11v1\|CN818986_P1 | 4229 | 8748 | 699 | LYM881 | 80.8 | globlastp |
| brachypodium\|12v1\|BRADI3G21620_T1 | 4230 | 8749 | 699 | LYM881 | 80.4 | glotblastn |
| brachypodium\|09v1\|DV475786 | 4231 | 8749 | 699 | LYM881 | 80.4 | glotblastn |
| barley\|12v1\|BF623251_P1 | 4232 | 8750 | 699 | LYM881 | 80.3 | globlastp |
| barley\|10v2\|BF623251 | 4233 | 8750 | 699 | LYM881 | 80.3 | globlastp |
| maize\|10v1\|AW506667_P1 | 4234 | 8751 | 700 | LYM882 | 95.5 | globlastp |
| foxtail_millet\|11v3\|PHY7SI029784M_P1 | 4235 | 8752 | 700 | LYM882 | 93.9 | globlastp |
| maize\|10v1\|AW067342_P1 | 4236 | 8753 | 700 | LYM882 | 92 | globlastp |
| brachypodium\|12v1\|BRADI1G26530_P1 | 4237 | 8754 | 700 | LYM882 | 86.5 | globlastp |
| brachypodium\|09v1\|GT782217 | 4238 | 8754 | 700 | LYM882 | 86.5 | globlastp |
| wheat\|12v3\|BE604455_P1 | 4239 | 8755 | 700 | LYM882 | 85.7 | globlastp |
| barley\|10v2\|BF623476 | 4240 | 8756 | 700 | LYM882 | 85.5 | globlastp |
| barley\|12v1\|BF623476_P1 | 4241 | 8756 | 700 | LYM882 | 85.5 | globlastp |
| leymus\|gb166\|EG376624_P1 | 4242 | 8757 | 700 | LYM882 | 85.5 | globlastp |
| wheat\|10v2\|BE404980 | 4243 | 8758 | 700 | LYM882 | 85.3 | globlastp |
| wheat\|12v3\|BE404980_P1 | 4244 | 8758 | 700 | LYM882 | 85.3 | globlastp |
| rice\|11v1\|BI808288 | 4245 | 8759 | 700 | LYM882 | 84.9 | globlastp |
| rye\|12v1\|BE496046_P1 | 4246 | 8760 | 700 | LYM882 | 84.6 | globlastp |
| oat\|11v1\|GO596187_P1 | 4247 | 8761 | 700 | LYM882 | 84.3 | globlastp |
| sugarcane\|10v1\|CA069784 | 4248 | 8762 | 700 | LYM882 | 84.1 | globlastp |
| wheat\|10v2\|BE403404 | 4249 | 8763 | 700 | LYM882 | 84 | globlastp |
| wheat\|12v3\|BE403404_P1 | 4250 | 8763 | 700 | LYM882 | 84 | globlastp |
| millet\|10v1\|PMSLX0006843D1_P1 | 4251 | 8764 | 700 | LYM882 | 81.7 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sugarcane\|10v1\|CA093806 | 4252 | 8765 | 701 | LYM883 | 88 | globlastp |
| foxtail_millet\|11v3\|PHY7SI003018M_P1 | 4253 | 8766 | 701 | LYM883 | 80.9 | globlastp |
| maize\|10v1\|AW787815_P1 | 4254 | 8767 | 702 | LYM884 | 95 | globlastp |
| foxtail_millet\|11v3\|PHY7SI030507M_P1 | 4255 | 8768 | 702 | LYM884 | 92.3 | globlastp |
| foxtail_millet\|11v3\|PHY7SI002897M_P1 | 4256 | 8769 | 702 | LYM884 | 91.1 | globlastp |
| switchgrass\|gb167\|DN140935 | 4257 | 8770 | 702 | LYM884 | 90.85 | glotblastn |
| maize\|10v1\|AI947910_P1 | 4258 | 8771 | 703 | LYM885 | 83.4 | globlastp |
| foxtail_millet\|11v3\|PHY7SI023514M_P1 | 4259 | 8772 | 703 | LYM885 | 80.6 | globlastp |
| sugarcane\|10v1\|CA111988 | 4260 | 8773 | 703 | LYM885 | 80.6 | globlastp |
| maize\|10v1\|CF004751_T1 | 4261 | 8774 | 704 | LYM886 | 94.67 | glotblastn |
| foxtail_millet\|11v3\|PHY7SI028274M_P1 | 4262 | 8775 | 704 | LYM886 | 93.7 | globlastp |
| rice\|11v1\|CA766993 | 4263 | 8776 | 704 | LYM886 | 88.1 | globlastp |
| wheat\|10v2\|CA627687 | 4264 | 8777 | 704 | LYM886 | 85.6 | globlastp |
| brachypodium\|12v1\|BRADI4G11300_P1 | 4265 | 8778 | 704 | LYM886 | 85.3 | globlastp |
| brachypodium\|09v1\|GT769582 | 4266 | 8778 | 704 | LYM886 | 85.3 | globlastp |
| wheat\|12v3\|CA627687_P1 | 4267 | 8779 | 704 | LYM886 | 85.1 | globlastp |
| maize\|10v1\|BM339347_T1 | 4268 | 8780 | 705 | LYM887 | 81.68 | glotblastn |
| switchgrass\|gb167\|DN150208 | 4269 | 8781 | 706 | LYM888 | 93.7 | globlastp |
| maize\|10v1\|AI600577_P1 | 4270 | 8782 | 706 | LYM888 | 92.8 | globlastp |
| rice\|11v1\|CB649228 | 4271 | 8783 | 706 | LYM888 | 90.3 | globlastp |
| wheat\|10v2\|BE430508 | 4272 | 8784 | 706 | LYM888 | 89.4 | globlastp |
| wheat\|12v3\|BE430508_P1 | 4273 | 8785 | 706 | LYM888 | 88.8 | globlastp |
| rye\|12v1\|DRR001012.114211_T1 | 4274 | 8786 | 706 | LYM888 | 88.66 | glotblastn |
| rice\|11v1\|BE228888 | 4275 | 8787 | 706 | LYM888 | 88.5 | globlastp |
| sorghum\|12v1\|SB04G032410_P1 | 4276 | 8788 | 706 | LYM888 | 88.2 | globlastp |
| barley\|10v2\|BG299560 | 4277 | 8789 | 706 | LYM888 | 87.9 | globlastp |
| sorghum\|12v1\|SB04G032420_T1 | 4278 | 8790 | 706 | LYM888 | 87.82 | glotblastn |
| sorghum\|11v1\|SB04G032410 | 4279 | 8790 | 706 | LYM888 | 87.82 | glotblastn |
| brachypodium\|12v1\|BRADI3G51370_P1 | 4280 | 8791 | 706 | LYM888 | 87.5 | globlastp |
| brachypodium\|09v1\|GT789692 | 4281 | 8792 | 706 | LYM888 | 87.08 | glotblastn |
| maize\|10v1\|EC904109_P1 | 4282 | 8793 | 706 | LYM888 | 87 | globlastp |
| wheat\|12v3\|AF123609_P1 | 4283 | 8794 | 706 | LYM888 | 86.6 | globlastp |
| maize\|10v1\|EC904110_T1 | 4284 | 8795 | 706 | LYM888 | 86.43 | glotblastn |
| wheat\|10v2\|AF123609 | 4285 | 8796 | 706 | LYM888 | 86.4 | globlastp |
| barley\|12v1\|BG299560_P1 | 4286 | 8797 | 706 | LYM888 | 85.5 | globlastp |
| maize\|10v1\|AW324619_P1 | 4287 | 8798 | 707 | LYM889 | 89.5 | globlastp |
| foxtail_millet\|11v3\|PHY7SI014097M_P1 | 4288 | 8799 | 707 | LYM889 | 83.6 | globlastp |
| sugarcane\|10v1\|CA167331 | 4289 | 8800 | 707 | LYM889 | 80.63 | glotblastn |
| maize\|10v1\|AW399894_P1 | 4290 | 8801 | 709 | LYM891 | 81.9 | globlastp |
| foxtail_millet\|11v3\|PHY7SI014246M_T1 | 4291 | 8802 | 709 | LYM891 | 80.88 | glotblastn |
| maize\|10v1\|AI438830_P1 | 4292 | 8803 | 710 | LYM892 | 96.2 | globlastp |
| maize\|10v1\|AI491577_P1 | 4293 | 8804 | 710 | LYM892 | 95.6 | globlastp |
| foxtail_millet\|11v3\|PHY7SI009446M_P1 | 4294 | 8805 | 710 | LYM892 | 95.5 | globlastp |
| millet\|10v1\|EVO454PM009845_P1 | 4295 | 8806 | 710 | LYM892 | 91.6 | globlastp |
| wheat\|12v3\|BE443894_P1 | 4296 | 8807 | 710 | LYM892 | 89.1 | globlastp |
| barley\|10v2\|AV836530 | 4297 | 8808 | 710 | LYM892 | 88.7 | globlastp |
| brachypodium\|12v1\|BRADI4G41777_P1 | 4298 | 8809 | 710 | LYM892 | 88.5 | globlastp |
| brachypodium\|09v1\|DV476524 | 4299 | 8809 | 710 | LYM892 | 88.5 | globlastp |
| rice\|11v1\|BI805661 | 4300 | 8810 | 710 | LYM892 | 87 | globlastp |
| switchgrass\|gb167\|FL750862 | 4301 | 8811 | 711 | LYM893 | 83.22 | glotblastn |
| foxtail_millet\|11v3\|PHY7SI021898M_T1 | 4302 | 8812 | 711 | LYM893 | 82.31 | glotblastn |
| maize\|10v1\|AW563022_T1 | 4303 | 8813 | 711 | LYM893 | 80.21 | glotblastn |
| sugarcane\|10v1\|CA255566 | 4304 | 8814 | 712 | LYM894 | 93.6 | globlastp |
| maize\|10v1\|BE761724_P1 | 4305 | 8815 | 712 | LYM894 | 85.4 | globlastp |
| foxtail_millet\|11v3\|PHY7SI023071M_P1 | 4306 | 8816 | 712 | LYM894 | 80.6 | globlastp |
| sorghum\|11v1\|CD206054 | 4307 | 8817 | 713 | LYM895 | 99.58 | glotblastn |
| switchgrass\|gb167\|DN144661 | 4308 | 8818 | 713 | LYM895 | 94.77 | glotblastn |
| foxtail_millet\|11v3\|PHY7SI021937M_P1 | 4309 | 8819 | 713 | LYM895 | 94.6 | globlastp |
| millet\|10v1\|EVO454PM043454_P1 | 4310 | 8820 | 713 | LYM895 | 94.6 | globlastp |
| rice\|11v1\|OSPRD071775 | 4311 | 8821 | 713 | LYM895 | 91.04 | glotblastn |
| rice\|11v1\|BI811726 | 4312 | 8822 | 713 | LYM895 | 91 | globlastp |
| brachypodium\|12v1\|BRADI3G34340_P1 | 4313 | 8823 | 713 | LYM895 | 89.6 | globlastp |
| rye\|12v1\|DRR001012.104034_P1 | 4314 | 8824 | 713 | LYM895 | 89.6 | globlastp |
| brachypodium\|09v1\|GT797060 | 4315 | 8823 | 713 | LYM895 | 89.6 | globlastp |
| wheat\|12v3\|BE412380_P1 | 4316 | 8824 | 713 | LYM895 | 89.6 | globlastp |
| brachypodium\|12v1\|SRR031795.688_T1 | 4317 | 8825 | 713 | LYM895 | 89.46 | glotblastn |
| barley\|12v1\|AV835250_P1 | 4318 | 8826 | 713 | LYM895 | 89.4 | globlastp |
| wheat\|12v3\|CJ591918_P1 | 4319 | 8827 | 713 | LYM895 | 89.4 | globlastp |
| wheat\|10v2\|BE412380 | 4320 | 8828 | 713 | LYM895 | 89.4 | globlastp |
| brachypodium\|12v1\|BRADI2G26870T2_P1 | 4321 | 8829 | 713 | LYM895 | 89.2 | globlastp |
| brachypodium\|09v1\|SRR031797S0063448 | 4322 | 8829 | 713 | LYM895 | 89.2 | globlastp |
| wheat\|10v2\|CA679614 | 4323 | 8830 | 713 | LYM895 | 89.2 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| wheat\|12v3\|CA679614_P1 | 4324 | 8830 | 713 | LYM895 | 89.2 | globlastp |
| rye\|12v1\|DRR001012.137243_T1 | 4325 | 8831 | 713 | LYM895 | 89.17 | glotblastn |
| rye\|12v1\|DRR001012.146876_T1 | 4326 | 8832 | 713 | LYM895 | 89.17 | glotblastn |
| brachypodium\|12v1\|BDPRD12V1013568_T1 | 4327 | 8833 | 713 | LYM895 | 89.05 | glotblastn |
| barley\|12v1\|HV12v1PRD011615_T1 | 4328 | 8834 | 713 | LYM895 | 88.98 | glotblastn |
| oat\|11v1\|GO588854_P1 | 4329 | 8835 | 713 | LYM895 | 88.6 | globlastp |
| foxtail_millet\|11v3\|PHY7SI024153M_P1 | 4330 | 8836 | 714 | LYM896 | 92.5 | globlastp |
| switchgrass\|gb167\|FE645016 | 4331 | 8837 | 714 | LYM896 | 91.2 | globlastp |
| maize\|10v1\|AW308648_T1 | 4332 | 8838 | 714 | LYM896 | 90.06 | glotblastn |
| wheat\|10v2\|BG607168 | 4333 | 8839 | 714 | LYM896 | 88.6 | globlastp |
| wheat\|12v3\|CK204792_P1 | 4334 | 8840 | 714 | LYM896 | 88.3 | globlastp |
| rye\|12v1\|DRR001012.307484_P1 | 4335 | 8841 | 714 | LYM896 | 88 | globlastp |
| rice\|11v1\|CR291470 | 4336 | 8842 | 714 | LYM896 | 87.1 | globlastp |
| brachypodium\|09v1\|DV485835 | 4337 | 8843 | 714 | LYM896 | 87 | globlastp |
| millet\|10v1\|EVO454PM002783_T1 | 4338 | 8844 | 714 | LYM896 | 81.31 | glotblastn |
| sugarcane\|10v1\|CA242897 | 4339 | 8845 | 715 | LYM897 | 94.5 | globlastp |
| switchgrass\|gb167\|FE621462 | 4340 | 8846 | 715 | LYM897 | 81.1 | globlastp |
| maize\|10v1\|W59819_P1 | 4341 | 8847 | 716 | LYM898 | 96.6 | globlastp |
| switchgrass\|gb167\|FE646196 | 4342 | 8848 | 716 | LYM898 | 93.6 | globlastp |
| cenchrus\|gb166\|EB658623_P1 | 4343 | 8849 | 716 | LYM898 | 92.9 | globlastp |
| millet\|10v1\|CD726125_P1 | 4344 | 8850 | 716 | LYM898 | 92.6 | globlastp |
| foxtail_millet\|11v3\|PHY7SI006887M_P1 | 4345 | 8851 | 716 | LYM898 | 92.3 | globlastp |
| rice\|11v1\|BI800133 | 4346 | 8852 | 716 | LYM898 | 89 | globlastp |
| rye\|12v1\|DRR001012.102450_P1 | 4347 | 8853 | 716 | LYM898 | 87.5 | globlastp |
| rye\|12v1\|DRR001012.170161_P1 | 4348 | 8854 | 716 | LYM898 | 87.5 | globlastp |
| wheat\|12v3\|CJ540774_P1 | 4349 | 8855 | 716 | LYM898 | 87.5 | globlastp |
| wheat\|12v3\|BE399353_P1 | 4350 | 8855 | 716 | LYM898 | 87.5 | globlastp |
| wheat\|12v3\|CA728491_P1 | 4351 | 8856 | 716 | LYM898 | 87.5 | globlastp |
| wheat\|12v3\|BE429677_P1 | 4352 | 8857 | 716 | LYM898 | 87.2 | globlastp |
| wheat\|10v2\|BE399353 | 4353 | 8858 | 716 | LYM898 | 87.2 | globlastp |
| wheat\|10v2\|BE406003 | 4354 | 8859 | 716 | LYM898 | 87.2 | globlastp |
| oat\|11v1\|GO591746_P1 | 4355 | 8860 | 716 | LYM898 | 86.9 | globlastp |
| pseudoroegneria\|gb167\|FF344482 | 4356 | 8861 | 716 | LYM898 | 86.7 | globlastp |
| brachypodium\|12v1\|BRADI1G33340_P1 | 4357 | 8862 | 716 | LYM898 | 86.6 | globlastp |
| wheat\|12v3\|BQ743302_P1 | 4358 | 8863 | 716 | LYM898 | 86.6 | globlastp |
| wheat\|12v3\|CK198929_P1 | 4359 | 8863 | 716 | LYM898 | 86.6 | globlastp |
| barley\|10v2\|BE420752 | 4360 | 8864 | 716 | LYM898 | 86.6 | globlastp |
| brachypodium\|09v1\|DV472159 | 4361 | 8862 | 716 | LYM898 | 86.6 | globlastp |
| rice\|11v1\|BI805159 | 4362 | 8865 | 716 | LYM898 | 86.6 | globlastp |
| cynodon\|10v1\|ES294233_P1 | 4363 | 8866 | 716 | LYM898 | 83.4 | globlastp |
| oat\|11v1\|GO591799_P1 | 4364 | 8867 | 716 | LYM898 | 81.1 | globlastp |
| sugarcane\|10v1\|CA246001 | 4365 | 8868 | 717 | LYM899 | 94.23 | glotblastn |
| maize\|10v1\|BE344851_T1 | 4366 | 8869 | 717 | LYM899 | 84.62 | glotblastn |
| switchgrass\|gb167\|FE624753_T1 | 4367 | 8870 | 717 | LYM899 | 80.77 | glotblastn |
| maize\|10v1\|BM269026_P1 | 4368 | 8871 | 718 | LYM900 | 94.3 | globlastp |
| maize\|10v1\|CF243987_P1 | 4369 | 8872 | 718 | LYM900 | 94 | globlastp |
| foxtail_millet\|11v3\|PHY7SI020049M_P1 | 4370 | 8873 | 718 | LYM900 | 93.4 | globlastp |
| switchgrass\|gb167\|DN146394 | 4371 | 8874 | 718 | LYM900 | 93.22 | glotblastn |
| rice\|11v1\|CI328798 | 4372 | 8875 | 718 | LYM900 | 89.9 | globlastp |
| brachypodium\|12v1\|BRADI3G56970_P1 | 4373 | 8876 | 718 | LYM900 | 86.8 | globlastp |
| brachypodium\|09v1\|SRR031795S0007848 | 4374 | 8876 | 718 | LYM900 | 86.8 | globlastp |
| wheat\|12v3\|CA704269_P1 | 4375 | 8877 | 718 | LYM900 | 85.9 | globlastp |
| sugarcane\|10v1\|CA067470 | 4376 | 8878 | 719 | LYM901 | 86.83 | glotblastn |
| maize\|10v1\|AI629549_P1 | 4377 | 8879 | 719 | LYM901 | 86.8 | globlastp |
| rice\|11v1\|AA749843 | 4378 | 8880 | 719 | LYM901 | 86.59 | glotblastn |
| foxtail_millet\|11v3\|PHY7SI026440M_P1 | 4379 | 8881 | 719 | LYM901 | 85.2 | globlastp |
| switchgrass\|gb167\|DN142158 | 4380 | 8882 | 719 | LYM901 | 84.8 | globlastp |
| brachypodium\|12v1\|BRADI4G19010_T1 | 4381 | 8883 | 719 | LYM901 | 82.93 | glotblastn |
| brachypodium\|09v1\|DV476491 | 4382 | 8883 | 719 | LYM901 | 82.93 | glotblastn |
| sugarcane\|10v1\|CA111590 | 4383 | 8884 | 720 | LYM903 | 100 | glotblastn |
| maize\|10v1\|BM073602_T1 | 4384 | 8885 | 720 | LYM903 | 99.4 | glotblastn |
| millet\|10v1\|EVO454PM032842_T1 | 4385 | 8886 | 720 | LYM903 | 98.81 | glotblastn |
| switchgrass\|gb167\|FL703887 | 4386 | 8887 | 720 | LYM903 | 98.21 | glotblastn |
| foxtail_millet\|11v3\|PHY7SI001010M_T1 | 4387 | 8888 | 720 | LYM903 | 97.62 | glotblastn |
| maize\|10v1\|CD990863_T1 | 4388 | 8889 | 720 | LYM903 | 97.62 | glotblastn |
| brachypodium\|12v1\|BRADI2G04197_T1 | 4389 | 8890 | 720 | LYM903 | 94.64 | glotblastn |
| brachypodium\|09v1\|GT759917 | 4390 | 8891 | 720 | LYM903 | 94.64 | glotblastn |
| switchgrass\|gb167\|FL718795 | 4391 | 8892 | 720 | LYM903 | 94.3 | globlastp |
| oat\|11v1\|GR318726_T1 | 4392 | 8893 | 720 | LYM903 | 94.05 | glotblastn |
| barley\|12v1\|BE194305_T1 | 4393 | 8894 | 720 | LYM903 | 93.45 | glotblastn |
| aristolochia\|10v1\|FD758738_T1 | 4394 | 8895 | 720 | LYM903 | 92.86 | glotblastn |
| wheat\|10v2\|CA644006 | 4395 | 8896 | 720 | LYM903 | 92.86 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| wheat\|12v3\|CV761316XX2_T1 | 4396 | 8897 | 720 | LYM903 | 92.86 | glotblastn |
| rye\|12v1\|DRR001012.182393_T1 | 4397 | 8898 | 720 | LYM903 | 92.26 | glotblastn |
| sesame\|12v1\|SESI12V1385427_T1 | 4398 | 8899 | 720 | LYM903 | 92.26 | glotblastn |
| monkeyflower\|10v1\|GO946289_T1 | 4399 | 8900 | 720 | LYM903 | 92.26 | glotblastn |
| amorphophallus\|11v2\|SRR089351X184046_T1 | 4400 | 8901 | 720 | LYM903 | 91.67 | glotblastn |
| chelidonium\|11v1\|SRR084752X114876_T1 | 4401 | 8902 | 720 | LYM903 | 91.67 | glotblastn |
| oat\|11v1\|CN819014_T1 | 4402 | 8903 | 720 | LYM903 | 91.67 | glotblastn |
| oil_palm\|11v1\|EL687752_T1 | 4403 | 8904 | 720 | LYM903 | 91.67 | glotblastn |
| poppy\|11v1\|SRR030259.107109_T1 | 4404 | 8905 | 720 | LYM903 | 91.67 | glotblastn |
| poppy\|11v1\|SRR030259.241055_T1 | 4405 | 8906 | 720 | LYM903 | 91.67 | glotblastn |
| brachypodium\|12v1\|BRADI2G31250_T1 | 4406 | 8907 | 720 | LYM903 | 91.07 | glotblastn |
| wheat\|12v3\|CA687250_T1 | 4407 | 8908 | 720 | LYM903 | 91.07 | glotblastn |
| beech\|11v1\|SRR006293.10251_T1 | 4408 | 8909 | 720 | LYM903 | 91.07 | glotblastn |
| cynodon\|10v1\|ES300647_T1 | 4409 | 8910 | 720 | LYM903 | 91.07 | glotblastn |
| grape\|11v1\|GSVIVT01024532001_T1 | 4410 | 8911 | 720 | LYM903 | 91.07 | glotblastn |
| oak\|10v1\|DN950259_T1 | 4411 | 8912 | 720 | LYM903 | 91.07 | glotblastn |
| oil_palm\|11v1\|GH637220_T1 | 4412 | 8913 | 720 | LYM903 | 91.07 | glotblastn |
| rice\|11v1\|AU057822 | 4413 | 8914 | 720 | LYM903 | 91.07 | glotblastn |
| switchgrass\|gb167\|FE599746 | 4414 | 8915 | 720 | LYM903 | 91.07 | glotblastn |
| tabernaemontana\|11v1\|SRR098689X115661 | 4415 | 8916 | 720 | LYM903 | 91.07 | glotblastn |
| vinca\|11v1\|SRR098690X220286 | 4416 | 8917 | 720 | LYM903 | 91.07 | glotblastn |
| wheat\|10v2\|BQ483505 | 4417 | 8918 | 720 | LYM903 | 91.07 | glotblastn |
| wheat\|12v3\|BQ483505_T1 | 4418 | 8919 | 720 | LYM903 | 91.07 | glotblastn |
| onion\|12v1\|CF449521_T1 | 4419 | 8920 | 720 | LYM903 | 91.07 | glotblastn |
| banana\|12v1\|MAGEN2012010088_T1 | 4420 | 8921 | 720 | LYM903 | 90.48 | glotblastn |
| banana\|12v1\|MAGEN2012017372_T1 | 4421 | 8922 | 720 | LYM903 | 90.48 | glotblastn |
| rye\|12v1\|DRR001012.12329_T1 | 4422 | 8923 | 720 | LYM903 | 90.48 | glotblastn |
| sorghum\|12v1\|SB09G010430_T1 | 4423 | 8924 | 720 | LYM903 | 90.48 | glotblastn |
| amaranthus\|10v1\|SRR039411S0004447_T1 | 4424 | 8925 | 720 | LYM903 | 90.48 | glotblastn |
| apple\|11v1\|CN869401_T1 | 4425 | 8926 | 720 | LYM903 | 90.48 | glotblastn |
| avocado\|10v1\|FD506453_T1 | 4426 | 8927 | 720 | LYM903 | 90.48 | glotblastn |
| barley\|10v2\|BF625809 | 4427 | 8928 | 720 | LYM903 | 90.48 | glotblastn |
| cucumber\|09v1\|AM736599_T1 | 4428 | 8929 | 720 | LYM903 | 90.48 | glotblastn |
| eschscholzia\|11v1\|SRR014116.104162_T1 | 4429 | 8930 | 720 | LYM903 | 90.48 | glotblastn |
| millet\|10v1\|EVO454PM000466_T1 | 4430 | 8931 | 720 | LYM903 | 90.48 | glotblastn |
| onion\|gb162\|CF449521 | 4431 | 8932 | 720 | LYM903 | 90.48 | glotblastn |
| pigeonpea\|11v1\|SRR054580X108619_T1 | 4432 | 8933 | 720 | LYM903 | 90.48 | glotblastn |
| sorghum\|11v1\|SB09G010430 | 4433 | 8924 | 720 | LYM903 | 90.48 | glotblastn |
| soybean\|11v1\|GLYMA18G45010 | 4434 | 8934 | 720 | LYM903 | 90.48 | glotblastn |
| strawberry\|11v1\|EX688528 | 4435 | 8935 | 720 | LYM903 | 90.48 | glotblastn |
| watermelon\|11v1\|AM730897 | 4436 | 8936 | 720 | LYM903 | 90.48 | glotblastn |
| aquilegia\|10v2\|DR937383_T1 | 4437 | 8937 | 720 | LYM903 | 89.88 | glotblastn |
| bean\|12v1\|SRR001334.260907_T1 | 4438 | 8938 | 720 | LYM903 | 89.88 | glotblastn |
| amorphophallus\|11v2\|SRR089351X191297_T1 | 4439 | 8939 | 720 | LYM903 | 89.88 | glotblastn |
| aquilegia\|10v1\|DT756384 | 4440 | 8940 | 720 | LYM903 | 89.88 | glotblastn |
| chickpea\|11v1\|GR395853_T1 | 4441 | 8941 | 720 | LYM903 | 89.88 | glotblastn |
| fagopyrum\|11v1\|SRR063689X124707_T1 | 4442 | 8942 | 720 | LYM903 | 89.88 | glotblastn |
| foxtail_millet\|11v3\|PHY7SI022012M_T1 | 4443 | 8943 | 720 | LYM903 | 89.88 | glotblastn |
| maize\|10v1\|AI855253_T1 | 4444 | 8944 | 720 | LYM903 | 89.88 | glotblastn |
| melon\|10v1\|AM736599_T1 | 4445 | 8945 | 720 | LYM903 | 89.88 | glotblastn |
| peanut\|10v1\|ES716020_T1 | 4446 | 8946 | 720 | LYM903 | 89.88 | glotblastn |
| platanus\|11v1\|SRR096786X265226_T1 | 4447 | 8947 | 720 | LYM903 | 89.88 | glotblastn |
| prunus\|10v1\|CN902448 | 4448 | 8948 | 720 | LYM903 | 89.88 | glotblastn |
| solanum_phureja\|09v1\|SPHBG735036 | 4449 | 8949 | 720 | LYM903 | 89.88 | glotblastn |
| tomato\|11v1\|BG735036 | 4450 | 8950 | 720 | LYM903 | 89.88 | glotblastn |
| triphysaria\|10v1\|EX984061 | 4451 | 8951 | 720 | LYM903 | 89.88 | glotblastn |
| beet\|12v1\|BV12V1547131_T1 | 4452 | 8952 | 720 | LYM903 | 89.29 | glotblastn |
| medicago\|12v1\|BE322857_T1 | 4453 | 8953 | 720 | LYM903 | 89.29 | glotblastn |
| eucalyptus\|11v2\|ES595738_T1 | 4454 | 8954 | 720 | LYM903 | 89.29 | glotblastn |
| euphorbia\|11v1\|DV132968_T1 | 4455 | 8955 | 720 | LYM903 | 89.29 | glotblastn |
| euphorbia\|11v1\|DV135734_T1 | 4456 | 8956 | 720 | LYM903 | 89.29 | glotblastn |
| grape\|11v1\|GSVIVT01029861001_T1 | 4457 | 8957 | 720 | LYM903 | 89.29 | glotblastn |
| silene\|11v1\|GH294256 | 4458 | 8958 | 720 | LYM903 | 89.29 | glotblastn |
| gossypium_raimondii\|12v1\|DT461328_T1 | 4459 | 8959 | 720 | LYM903 | 88.69 | glotblastn |
| abies\|11v2\|SRR098676X105566_T1 | 4460 | 8960 | 720 | LYM903 | 88.69 | glotblastn |
| amsonia\|11v1\|SRR098688X290285_T1 | 4461 | 8961 | 720 | LYM903 | 88.69 | glotblastn |
| cassava\|09v1\|DV445234_T1 | 4462 | 8962 | 720 | LYM903 | 88.69 | glotblastn |
| castorbean\|11v1\|XM_002531765_T1 | 4463 | 8963 | 720 | LYM903 | 88.69 | glotblastn |
| cedrus\|11v1\|SRR065007X110580_T1 | 4464 | 8964 | 720 | LYM903 | 88.69 | glotblastn |
| coffea\|10v1\|DV692370_T1 | 4465 | 8965 | 720 | LYM903 | 88.69 | glotblastn |
| cotton\|11v1\|CO104942_T1 | 4466 | 8966 | 720 | LYM903 | 88.69 | glotblastn |
| cotton\|11v1\|DT053081XX1_T1 | 4467 | 8967 | 720 | LYM903 | 88.69 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| lotus\|09v1\|CRPLJ025278_T1 | 4468 | 8968 | 720 | LYM903 | 88.69 | glotblastn |
| maritime_pine\|10v1\|SRR073317S0041991_T1 | 4469 | 8969 | 720 | LYM903 | 88.69 | glotblastn |
| pine\|10v2\|CF664852_T1 | 4470 | 8970 | 720 | LYM903 | 88.69 | glotblastn |
| pseudotsuga\|10v1\|SRR065119S0006458 | 4471 | 8971 | 720 | LYM903 | 88.69 | glotblastn |
| spruce\|11v1\|ES257783 | 4472 | 8972 | 720 | LYM903 | 88.69 | glotblastn |
| zostera\|10v1\|SRR057351S0068057 | 4473 | 8973 | 720 | LYM903 | 88.69 | glotblastn |
| amborella\|12v3\|SRR038641.112014_T1 | 4474 | — | 720 | LYM903 | 88.69 | glotblastn |
| arabidopsis\|10v1\|AT5G01960_T1 | 4475 | 8974 | 720 | LYM903 | 88.1 | glotblastn |
| cacao\|10v1\|CU509907_T1 | 4476 | 8975 | 720 | LYM903 | 88.1 | glotblastn |
| cassava\|09v1\|DV446485_T1 | 4477 | 8976 | 720 | LYM903 | 88.1 | glotblastn |
| catharanthus\|11v1\|SRR098691X12196_T1 | 4478 | 8977 | 720 | LYM903 | 88.1 | glotblastn |
| cephalotaxus\|11v1\|SRR064395X159543_T1 | 4479 | 8978 | 720 | LYM903 | 88.1 | glotblastn |
| citrus\|gb166\|CN181533 | 4480 | 8979 | 720 | LYM903 | 88.1 | glotblastn |
| clementine\|11v1\|CN190590_T1 | 4481 | 8979 | 720 | LYM903 | 88.1 | glotblastn |
| kiwi\|gb166\|FG477235_T1 | 4482 | 8980 | 720 | LYM903 | 88.1 | glotblastn |
| papaya\|gb165\|EX240309_T1 | 4483 | 8981 | 720 | LYM903 | 88.1 | glotblastn |
| taxus\|10v1\|SRR065067S0031754 | 4484 | 8982 | 720 | LYM903 | 88.1 | glotblastn |
| trigonella\|11v1\|SRR066194X151553 | 4485 | 8983 | 720 | LYM903 | 88.1 | glotblastn |
| banana\|12v1\|FF557778_T1 | 4486 | 8984 | 720 | LYM903 | 87.5 | glotblastn |
| amsonia\|11v1\|SRR098688X138262_T1 | 4487 | 8985 | 720 | LYM903 | 87.5 | glotblastn |
| arabidopsis_lyrata\|09v1\|BQ834438_T1 | 4488 | 8986 | 720 | LYM903 | 87.5 | glotblastn |
| nasturtium\|11v1\|SRR032558.15431_T1 | 4489 | 8987 | 720 | LYM903 | 87.5 | glotblastn |
| nasturtium\|11v1\|SRR032559.14733_T1 | 4490 | 8988 | 720 | LYM903 | 87.5 | glotblastn |
| phalaenopsis\|11v1\|SRR125771.1002514_T1 | 4491 | 8989 | 720 | LYM903 | 87.5 | glotblastn |
| poplar\|10v1\|CN550301_T1 | 4492 | 8990 | 720 | LYM903 | 87.5 | glotblastn |
| sarracenia\|11v1\|SRR192669.398527 | 4493 | 8991 | 720 | LYM903 | 87.5 | glotblastn |
| strawberry\|11v1\|DY667510 | 4494 | 8992 | 720 | LYM903 | 87.5 | glotblastn |
| tabernaemontana\|11v1\|SRR098689X184504 | 4495 | 8993 | 720 | LYM903 | 87.5 | glotblastn |
| thellungiella_halophilum\|11v1\|BY808465 | 4496 | 8994 | 720 | LYM903 | 87.5 | glotblastn |
| thellungiella_parvulum\|11v1\|BY808465 | 4497 | 8995 | 720 | LYM903 | 87.5 | glotblastn |
| tripterygium\|11v1\|SRR098677X101497 | 4498 | 8996 | 720 | LYM903 | 87.5 | glotblastn |
| b_juncea\|12v1\|E6ANDIZ01EL8X4_T1 | 4499 | 8997 | 720 | LYM903 | 86.9 | glotblastn |
| apple\|11v1\|CN995799_T1 | 4500 | 8998 | 720 | LYM903 | 86.9 | glotblastn |
| b_rapa\|11v1\|CD835284_T1 | 4501 | 8999 | 720 | LYM903 | 86.9 | glotblastn |
| beech\|11v1\|SRR364509.100280_T1 | 4502 | 9000 | 720 | LYM903 | 86.9 | glotblastn |
| canola\|11v1\|EE483502_T1 | 4503 | 9001 | 720 | LYM903 | 86.9 | glotblastn |
| canola\|11v1\|EE552258_T1 | 4504 | 9002 | 720 | LYM903 | 86.9 | glotblastn |
| eucalyptus\|11v2\|SRR001659X109870_T1 | 4505 | 9003 | 720 | LYM903 | 86.9 | glotblastn |
| podocarpus\|10v1\|SRR065014S0026785_T1 | 4506 | 9004 | 720 | LYM903 | 86.9 | glotblastn |
| podocarpus\|10v1\|SRR065014S0127658_T1 | 4507 | 9005 | 720 | LYM903 | 86.9 | glotblastn |
| poplar\|10v1\|BU862854_T1 | 4508 | 9006 | 720 | LYM903 | 86.9 | glotblastn |
| silene\|11v1\|SRR096785X102567 | 4509 | 9007 | 720 | LYM903 | 86.9 | glotblastn |
| solanum_phureja\|09v1\|SPHBE354455 | 4510 | 9008 | 720 | LYM903 | 86.9 | glotblastn |
| tomato\|11v1\|BE354455 | 4511 | 9009 | 720 | LYM903 | 86.9 | glotblastn |
| zostera\|10v1\|SRR057351S0002074_T1 | 4512 | 9010 | 720 | LYM903 | 86.31 | glotblastn |
| b_juncea\|10v2\|E6ANDIZ01EL8X4 | 4513 | 9011 | 720 | LYM903 | 86.31 | glotblastn |
| canola\|11v1\|ES911537_T1 | 4514 | 9012 | 720 | LYM903 | 85.8 | glotblastn |
| cassava\|09v1\|FF536521_T1 | 4515 | 9013 | 720 | LYM903 | 85.71 | glotblastn |
| euonymus\|11v1\|SRR070038X119035_T1 | 4516 | 9014 | 720 | LYM903 | 85.71 | glotblastn |
| euonymus\|11v1\|SRR070038X165528_T1 | 4517 | 9015 | 720 | LYM903 | 85.71 | glotblastn |
| euonymus\|11v1\|SRR070038X20701_T1 | 4518 | 9016 | 720 | LYM903 | 85.71 | glotblastn |
| peanut\|10v1\|SRR042416S0023241_T1 | 4519 | 9017 | 720 | LYM903 | 85.71 | glotblastn |
| barley\|10v2\|BE194305 | 4520 | 9018 | 720 | LYM903 | 85.7 | globlastp |
| sarracenia\|11v1\|SRR192669.154991 | 4521 | 9019 | 720 | LYM903 | 85.21 | glotblastn |
| cannabis\|12v1\|EW701142_T1 | 4522 | 9020 | 720 | LYM903 | 85.12 | glotblastn |
| medicago\|12v1\|BE325922_T1 | 4523 | 9021 | 720 | LYM903 | 85.12 | glotblastn |
| brachypodium\|09v1\|GT804966 | 4524 | 9022 | 720 | LYM903 | 85.12 | glotblastn |
| castorbean\|11v1\|XM_002533785_T1 | 4525 | 9023 | 720 | LYM903 | 85.12 | glotblastn |
| cephalotaxus\|11v1\|SRR064395X133141_T1 | 4526 | 9024 | 720 | LYM903 | 85.12 | glotblastn |
| clementine\|11v1\|CK935416_T1 | 4527 | 9025 | 720 | LYM903 | 85.12 | glotblastn |
| cleome_spinosa\|10v1\|SRR015531S0024872_T1 | 4528 | 9026 | 720 | LYM903 | 85.12 | glotblastn |
| cucurbita\|11v1\|SRR091276X127345_T1 | 4529 | 9027 | 720 | LYM903 | 85.12 | glotblastn |
| melon\|10v1\|AM723808_T1 | 4530 | 9028 | 720 | LYM903 | 85.12 | glotblastn |
| monkeyflower\|10v1\|DV209684_T1 | 4531 | 9029 | 720 | LYM903 | 85.12 | glotblastn |
| orange\|11v1\|CK935416_T1 | 4532 | 9025 | 720 | LYM903 | 85.12 | glotblastn |
| phalaenopsis\|11v1\|SRR125771.1000728_T1 | 4533 | 9030 | 720 | LYM903 | 85.12 | glotblastn |
| pigeonpea\|11v1\|GR468239_T1 | 4534 | 9031 | 720 | LYM903 | 85.12 | glotblastn |
| sciadopitys\|10v1\|SRR065035S0008125 | 4535 | 9032 | 720 | LYM903 | 85.12 | glotblastn |
| soybean\|11v1\|GLYMA06G14590 | 4536 | 9033 | 720 | LYM903 | 85.12 | glotblastn |
| trigonella\|11v1\|SRR066194X172611 | 4537 | 9034 | 720 | LYM903 | 85.12 | glotblastn |
| vinca\|11v1\|SRR098690X111839 | 4538 | 9035 | 720 | LYM903 | 85.12 | glotblastn |
| watermelon\|11v1\|AM723808 | 4539 | 9036 | 720 | LYM903 | 85.12 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| bean\|12v1\|SRR001334.115709_T1 | 4540 | 9037 | 720 | LYM903 | 84.52 | glotblastn |
| rye\|12v1\|DRR001012.123663_T1 | 4541 | 9038 | 720 | LYM903 | 84.52 | glotblastn |
| chickpea\|11v1\|SRR133517.130897_T1 | 4542 | 9039 | 720 | LYM903 | 84.52 | glotblastn |
| cichorium\|gb171\|EH678693_T1 | 4543 | 9040 | 720 | LYM903 | 84.52 | glotblastn |
| cowpea\|12v1\|FF395548_T1 | 4544 | 9041 | 720 | LYM903 | 84.52 | glotblastn |
| cowpea\|gb166\|FF395548 | 4545 | 9041 | 720 | LYM903 | 84.52 | glotblastn |
| euphorbia\|11v1\|DV122759_T1 | 4546 | 9042 | 720 | LYM903 | 84.52 | glotblastn |
| soybean\|11v1\|GLYMA04G40220 | 4547 | 9043 | 720 | LYM903 | 84.52 | glotblastn |
| tomato\|11v1\|BG129596 | 4548 | 9044 | 720 | LYM903 | 84.52 | glotblastn |
| b_oleracea\|gb161\|DY027047_P1 | 4549 | 9045 | 720 | LYM903 | 84.5 | globlastp |
| barley\|10v2\|BE216449 | 4550 | 9046 | 720 | LYM903 | 83.93 | glotblastn |
| barley\|12v1\|BE216449_T1 | 4551 | 9047 | 720 | LYM903 | 83.93 | glotblastn |
| cacao\|10v1\|CGD0005641_T1 | 4552 | 9048 | 720 | LYM903 | 83.93 | glotblastn |
| centaurea\|gb166\|EH731326_T1 | 4553 | 9049 | 720 | LYM903 | 83.93 | glotblastn |
| flaveria\|11v1\|SRR149229.155851_T1 | 4554 | 9050 | 720 | LYM903 | 83.93 | glotblastn |
| radish\|gb164\|EV568623 | 4555 | 9051 | 720 | LYM903 | 83.93 | glotblastn |
| solanum_phureja\|09v1\|SPHBG129596 | 4556 | 9052 | 720 | LYM903 | 83.93 | glotblastn |
| spurge\|gb161\|DV122759 | 4557 | 9053 | 720 | LYM903 | 83.93 | glotblastn |
| wheat\|10v2\|BE428984 | 4558 | 9054 | 720 | LYM903 | 83.93 | glotblastn |
| wheat\|12v3\|AL817616_T1 | 4559 | 9055 | 720 | LYM903 | 83.93 | glotblastn |
| brachypodium\|12v1\|BRADI2G34420_T1 | 4560 | 9056 | 720 | LYM903 | 83.33 | glotblastn |
| rose\|12v1\|SRR397984.120589_T1 | 4561 | 9057 | 720 | LYM903 | 83.33 | glotblastn |
| beech\|11v1\|SRR006293.7455_T1 | 4562 | 9058 | 720 | LYM903 | 83.33 | glotblastn |
| brachypodium\|09v1\|GT822174 | 4563 | 9056 | 720 | LYM903 | 83.33 | glotblastn |
| lotus\|09v1\|LLCB829482_T1 | 4564 | 9059 | 720 | LYM903 | 83.33 | glotblastn |
| monkeyflower\|10v1\|GR175863_T1 | 4565 | 9060 | 720 | LYM903 | 83.33 | glotblastn |
| poplar\|10v1\|BI128949_T1 | 4566 | 9061 | 720 | LYM903 | 83.33 | glotblastn |
| primula\|11v1\|SRR098680X117871_T1 | 4567 | 9062 | 720 | LYM903 | 83.33 | glotblastn |
| cowpea\|gb166\|FF382732 | 4568 | 9063 | 720 | LYM903 | 83.1 | globlastp |
| b_juncea\|12v1\|E6ANDIZ01AVQX4_T1 | 4569 | 9064 | 720 | LYM903 | 82.74 | glotblastn |
| sunflower\|12v1\|CD851434_T1 | 4570 | 9065 | 720 | LYM903 | 82.74 | glotblastn |
| sunflower\|12v1\|EL436978_T1 | 4571 | 9066 | 720 | LYM903 | 82.74 | glotblastn |
| lettuce\|10v1\|DY961925 | 4572 | 9067 | 720 | LYM903 | 82.74 | glotblastn |
| sunflower\|10v1\|CF098700 | 4573 | 9068 | 720 | LYM903 | 82.74 | glotblastn |
| sunflower\|10v1\|EL436978 | 4574 | 9069 | 720 | LYM903 | 82.74 | glotblastn |
| tobacco\|gb162\|BP529419 | 4575 | 9070 | 720 | LYM903 | 82.74 | glotblastn |
| blueberry\|12v1\|SRR353282X6963D1_P1 | 4576 | 9071 | 720 | LYM903 | 82.7 | globlastp |
| cucumber\|09v1\|AM723808_T1 | 4577 | 9072 | 720 | LYM903 | 82.29 | glotblastn |
| sunflower\|12v1\|CF098700_T1 | 4578 | 9073 | 720 | LYM903 | 82.25 | glotblastn |
| eschscholzia\|11v1\|SRR096788.243918_T1 | 4579 | — | 720 | LYM903 | 82.25 | glotblastn |
| tripterygium\|11v1\|SRR098677X204453 | 4580 | 9074 | 720 | LYM903 | 82.2 | globlastp |
| banana\|12v1\|ES434025_T1 | 4581 | 9075 | 720 | LYM903 | 82.14 | glotblastn |
| lettuce\|12v1\|DW145212_T1 | 4582 | 9076 | 720 | LYM903 | 82.14 | glotblastn |
| ambrosia\|11v1\|SRR346935.16042_T1 | 4583 | 9077 | 720 | LYM903 | 82.14 | glotblastn |
| ambrosia\|11v1\|SRR346935.162003_T1 | 4584 | 9078 | 720 | LYM903 | 82.14 | glotblastn |
| centaurea\|gb166\|EH724510_T1 | 4585 | 9079 | 720 | LYM903 | 82.14 | glotblastn |
| flaveria\|11v1\|SRR149229.198216_T1 | 4586 | 9080 | 720 | LYM903 | 82.14 | glotblastn |
| triphysaria\|10v1\|EY150396 | 4587 | 9081 | 720 | LYM903 | 82.14 | glotblastn |
| cirsium\|11v1\|SRR346952.1047071_T1 | 4588 | 9082 | 720 | LYM903 | 81.66 | glotblastn |
| sunflower\|12v1\|GE486297_T1 | 4589 | 9083 | 720 | LYM903 | 81.55 | glotblastn |
| ambrosia\|11v1\|SRR346935.162156_T1 | 4590 | 9084 | 720 | LYM903 | 81.55 | glotblastn |
| ambrosia\|11v1\|SRR346943.115905_T1 | 4591 | 9085 | 720 | LYM903 | 81.55 | glotblastn |
| ceratodon\|10v1\|SRR074890S0034307_T1 | 4592 | 9086 | 720 | LYM903 | 81.55 | glotblastn |
| flaveria\|11v1\|SRR149229.128144_T1 | 4593 | 9087 | 720 | LYM903 | 81.55 | glotblastn |
| flaveria\|11v1\|SRR149229.411109_T1 | 4594 | 9088 | 720 | LYM903 | 81.55 | glotblastn |
| lotus\|09v1\|AV428025_T1 | 4595 | 9089 | 720 | LYM903 | 81.55 | glotblastn |
| utricularia\|11v1\|SRR094438.158766 | 4596 | 9090 | 720 | LYM903 | 81.55 | glotblastn |
| apple\|11v1\|CN902448_P1 | 4597 | 9091 | 720 | LYM903 | 81 | globlastp |
| eschscholzia\|11v1\|SRR014116.83162_P1 | 4598 | 9092 | 720 | LYM903 | 81 | globlastp |
| cannabis\|12v1\|SOLX00030421_T1 | 4599 | 9093 | 720 | LYM903 | 80.95 | glotblastn |
| cannabis\|12v1\|SOLX00057888_T1 | 4600 | 9094 | 720 | LYM903 | 80.95 | glotblastn |
| sunflower\|12v1\|BQ915276_T1 | 4601 | 9095 | 720 | LYM903 | 80.95 | glotblastn |
| ambrosia\|11v1\|SRR346935.148688_T1 | 4602 | 9096 | 720 | LYM903 | 80.95 | glotblastn |
| flaveria\|11v1\|SRR149229.10778_T1 | 4603 | 9097 | 720 | LYM903 | 80.95 | glotblastn |
| sunflower\|10v1\|BQ915276 | 4604 | 9098 | 720 | LYM903 | 80.95 | glotblastn |
| bean\|gb167\|CV534035 | 4605 | 9099 | 720 | LYM903 | 80.7 | globlastp |
| lettuce\|12v1\|DY965010_T1 | 4606 | 9100 | 720 | LYM903 | 80.36 | glotblastn |
| ambrosia\|11v1\|SRR346935.73358_T1 | 4607 | 9101 | 720 | LYM903 | 80.36 | glotblastn |
| arnica\|11v1\|SRR099034X124192_T1 | 4608 | 9102 | 720 | LYM903 | 80.36 | glotblastn |
| arnica\|11v1\|SRR099034X169584_T1 | 4609 | 9103 | 720 | LYM903 | 80.36 | glotblastn |
| chickpea\|11v1\|SRR133517.358506_T1 | 4610 | 9104 | 720 | LYM903 | 80.36 | glotblastn |
| citrus\|gb166\|CK935416 | 4611 | 9105 | 720 | LYM903 | 80.36 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| phalaenopsis\|11v1\|SRR125771.1007694_T1 | 4612 | 9106 | 720 | LYM903 | 80.36 | glotblastn |
| utricularia\|11v1\|SRR094438.115376 | 4613 | 9107 | 720 | LYM903 | 80.36 | glotblastn |
| maize\|10v1\|AW331101_P1 | 4614 | 9108 | 721 | LYM904 | 99.5 | globlastp |
| foxtail_millet\|11v3\|PHY7SI037690M_P1 | 4615 | 9109 | 721 | LYM904 | 95.6 | globlastp |
| maize\|10v1\|AA979904_P1 | 4616 | 9110 | 721 | LYM904 | 92 | globlastp |
| rice\|11v1\|AU183588 | 4617 | 9111 | 721 | LYM904 | 89.1 | globlastp |
| rye\|12v1\|DRR001012.815527_T1 | 4618 | 9112 | 721 | LYM904 | 89.01 | glotblastn |
| wheat\|10v2\|BE213377 | 4619 | 9113 | 721 | LYM904 | 89 | globlastp |
| wheat\|12v3\|BE213377_P1 | 4620 | 9113 | 721 | LYM904 | 89 | globlastp |
| barley\|10v2\|BE194912 | 4621 | 9114 | 721 | LYM904 | 88.6 | globlastp |
| barley\|12v1\|BE194912_P1 | 4622 | 9114 | 721 | LYM904 | 88.6 | globlastp |
| leymus\|gb166\|EG385963_P1 | 4623 | 9115 | 721 | LYM904 | 87.9 | globlastp |
| switchgrass\|gb167\|FL942555 | 4624 | 9116 | 721 | LYM904 | 84.6 | globlastp |
| millet\|10v1\|EVO454PM170276_P1 | 4625 | 9117 | 721 | LYM904 | 82.4 | globlastp |
| sugarcane\|10v1\|CA271398 | 4626 | 9118 | 721 | LYM904 | 82.08 | glotblastn |
| rice\|11v1\|AA749920 | 4627 | 9119 | 721 | LYM904 | 80.22 | glotblastn |
| maize\|10v1\|AW017660_P1 | 4628 | 9120 | 722 | LYM905 | 94.4 | globlastp |
| foxtail_millet\|11v3\|PHY7SI037725M_P1 | 4629 | 9121 | 722 | LYM905 | 93.9 | globlastp |
| switchgrass\|gb167\|DN150146 | 4630 | 9122 | 722 | LYM905 | 92.2 | globlastp |
| rice\|11v1\|AA754337 | 4631 | 9123 | 722 | LYM905 | 83.6 | globlastp |
| brachypodium\|12v1\|BRADI1G06930_P1 | 4632 | 9124 | 722 | LYM905 | 80.2 | globlastp |
| brachypodium\|09v1\|DV477706 | 4633 | 9124 | 722 | LYM905 | 80.2 | globlastp |
| maize\|10v1\|FK961731_T1 | 4634 | 9125 | 723 | LYM906 | 89.52 | glotblastn |
| foxtail_millet\|11v3\|PHY7SI035645M_P1 | 4635 | 9126 | 723 | LYM906 | 86 | globlastp |
| foxtail_millet\|11v3\|SIPRD091300_T1 | 4636 | 9127 | 723 | LYM906 | 85.15 | glotblastn |
| brachypodium\|12v1\|BRADI1G09840_P1 | 4637 | 9128 | 723 | LYM906 | 80.7 | globlastp |
| brachypodium\|09v1\|SRR031798S0234817 | 4638 | 9128 | 723 | LYM906 | 80.7 | globlastp |
| sorghum\|12v1\|SB01G009860_T1 | 4639 | 9129 | 724 | LYM907 | 93.09 | glotblastn |
| sorghum\|11v1\|SB01G009860 | 4640 | 9130 | 724 | LYM907 | 92.75 | glotblastn |
| maize\|10v1\|AI665988_P1 | 4641 | 9131 | 724 | LYM907 | 91.1 | globlastp |
| foxtail_millet\|11v3\|PHY7SI034811M_P1 | 4642 | 9132 | 724 | LYM907 | 86.3 | globlastp |
| foxtail_millet\|11v3\|PHY7SI039987M_T1 | 4643 | 9133 | 724 | LYM907 | 80.61 | glotblastn |
| maize\|10v1\|AI586610_P1 | 4644 | 9134 | 725 | LYM908 | 85.4 | globlastp |
| sorghum\|12v1\|SB01G017970_T1 | 4645 | 9135 | 725 | LYM908 | 81.75 | glotblastn |
| sugarcane\|10v1\|CA175149 | 4646 | 9136 | 726 | LYM909 | 95.7 | globlastp |
| foxtail_millet\|11v3\|PHY7SI035715M_P1 | 4647 | 9137 | 726 | LYM909 | 91.9 | globlastp |
| maize\|10v1\|AI691863_P1 | 4648 | 9138 | 726 | LYM909 | 91.4 | globlastp |
| rice\|11v1\|BI806059 | 4649 | 9139 | 726 | LYM909 | 85.1 | globlastp |
| foxtail_millet\|11v3\|PHY7SI034727M_P1 | 4650 | 9140 | 727 | LYM910 | 89.2 | globlastp |
| wheat\|10v2\|BQ619763 | 4651 | 9141 | 727 | LYM910 | 83.5 | globlastp |
| wheat\|12v3\|BQ619763_P1 | 4652 | 9142 | 727 | LYM910 | 83.5 | globlastp |
| brachypodium\|12v1\|BRADI1G60050_P1 | 4653 | 9143 | 727 | LYM910 | 83.4 | globlastp |
| brachypodium\|09v1\|DV479206 | 4654 | 9143 | 727 | LYM910 | 83.4 | globlastp |
| barley\|10v2\|BE411586 | 4655 | 9144 | 727 | LYM910 | 83.3 | globlastp |
| barley\|12v1\|BE411586_P1 | 4656 | 9144 | 727 | LYM910 | 83.3 | globlastp |
| rye\|12v1\|DRR001012.108003_T1 | 4657 | 9145 | 727 | LYM910 | 82.58 | glotblastn |
| rice\|11v1\|BQ907196 | 4658 | 9146 | 727 | LYM910 | 81.4 | globlastp |
| oat\|11v1\|GR313193_P1 | 4659 | 9147 | 727 | LYM910 | 81.1 | globlastp |
| wheat\|10v2\|CD491314 | 4660 | 728 | 728 | LYM911 | 100 | globlastp |
| foxtail_millet\|11v3\|PHY7SI038227M_P1 | 4661 | 9148 | 728 | LYM911 | 98.9 | globlastp |
| millet\|10v1\|EVO454PM030954_P1 | 4662 | 9148 | 728 | LYM911 | 98.9 | globlastp |
| sugarcane\|10v1\|CA115680 | 4663 | 9148 | 728 | LYM911 | 98.9 | globlastp |
| lovegrass\|gb167\|EH193301_P1 | 4664 | 9149 | 728 | LYM911 | 97.8 | globlastp |
| maize\|10v1\|AI677471_P1 | 4665 | 9150 | 728 | LYM911 | 97.8 | globlastp |
| rice\|11v1\|AF150113 | 4666 | 9149 | 728 | LYM911 | 97.8 | globlastp |
| switchgrass\|gb167\|FE607135 | 4667 | 9151 | 728 | LYM911 | 97.8 | globlastp |
| switchgrass\|gb167\|FE626076 | 4668 | 9151 | 728 | LYM911 | 97.8 | globlastp |
| sorghum\|11v1\|SB08G018820 | 4669 | 9152 | 728 | LYM911 | 96.8 | globlastp |
| sorghum\|12v1\|SB08G018820_P1 | 4670 | 9152 | 728 | LYM911 | 96.8 | globlastp |
| sugarcane\|10v1\|CA150363 | 4671 | 9153 | 728 | LYM911 | 96.8 | globlastp |
| switchgrass\|gb167\|FL731598 | 4672 | 9154 | 728 | LYM911 | 96.8 | globlastp |
| cynodon\|10v1\|ES294434_T1 | 4673 | 9155 | 728 | LYM911 | 96.77 | glotblastn |
| foxtail_millet\|11v3\|PHY7SI023600M_P1 | 4674 | 9156 | 728 | LYM911 | 95.7 | globlastp |
| lolium\|10v1\|ES699040_P1 | 4675 | 9157 | 728 | LYM911 | 93.5 | globlastp |
| tabernaemontana\|11v1\|SRR098689X136339 | 4676 | 9158 | 728 | LYM911 | 93.5 | globlastp |
| valeriana\|11v1\|SRR099039X10220 | 4677 | 9159 | 728 | LYM911 | 93.5 | globlastp |
| vinca\|11v1\|SRR098690X122387 | 4678 | 9159 | 728 | LYM911 | 93.5 | globlastp |
| brachypodium\|12v1\|BRADI4G04290_P1 | 4679 | 9160 | 728 | LYM911 | 92.6 | globlastp |
| brachypodium\|09v1\|DV488227 | 4680 | 9160 | 728 | LYM911 | 92.6 | globlastp |
| antirrhinum\|gb166\|AJ559231_P1 | 4681 | 9161 | 728 | LYM911 | 92.5 | globlastp |
| fraxinus\|11v1\|SRR058827.101495_P1 | 4682 | 9162 | 728 | LYM911 | 92.5 | globlastp |
| fraxinus\|11v1\|SRR058827.129116_P1 | 4683 | 9163 | 728 | LYM911 | 92.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| oat\|11v1\|GO595233_P1 | 4684 | 9164 | 728 | LYM911 | 92.5 | globlastp |
| phyla\|11v2\|SRR099037X104167_P1 | 4685 | 9165 | 728 | LYM911 | 92.5 | globlastp |
| salvia\|10v1\|CV171369 | 4686 | 9166 | 728 | LYM911 | 92.5 | globlastp |
| salvia\|10v1\|FE535971 | 4687 | 9166 | 728 | LYM911 | 92.5 | globlastp |
| triphysaria\|10v1\|EY128870 | 4688 | 9167 | 728 | LYM911 | 92.5 | globlastp |
| blueberry\|12v1\|SRR353282X41412D1_P1 | 4689 | 9168 | 728 | LYM911 | 91.4 | globlastp |
| kiwi\|gb166\|FG413132_P1 | 4690 | 9169 | 728 | LYM911 | 91.4 | globlastp |
| olea\|11v1\|SRR014463.19237_T1 | 4691 | 9170 | 728 | LYM911 | 91.4 | glotblastn |
| phyla\|11v2\|SRR099037X139391_P1 | 4692 | 9171 | 728 | LYM911 | 91.4 | globlastp |
| sarracenia\|11v1\|SRR192669.107050 | 4693 | 9172 | 728 | LYM911 | 91.4 | globlastp |
| sarracenia\|11v1\|SRR192669.111540 | 4694 | 9172 | 728 | LYM911 | 91.4 | globlastp |
| scabiosa\|11v1\|SRR063723X154639 | 4695 | 9173 | 728 | LYM911 | 91.4 | globlastp |
| vinca\|11v1\|SRR098690X543218 | 4696 | 9174 | 728 | LYM911 | 91.4 | glotblastn |
| utricularia\|11v1\|SRR094438.105787 | 4697 | 9175 | 728 | LYM911 | 90.32 | glotblastn |
| rye\|12v1\|BE587008_P1 | 4698 | 9176 | 728 | LYM911 | 90.3 | globlastp |
| avocado\|10v1\|CO998031_P1 | 4699 | 9177 | 728 | LYM911 | 90.3 | globlastp |
| monkeyflower\|10v1\|GO976300_P1 | 4700 | 9178 | 728 | LYM911 | 90.3 | globlastp |
| oil_palm\|11v1\|SRR190698.290903_P1 | 4701 | 9179 | 728 | LYM911 | 90.3 | globlastp |
| orobanche\|10v1\|SRR023189S0000003_P1 | 4702 | 9180 | 728 | LYM911 | 90.3 | globlastp |
| phalaenopsis\|11v1\|SRR125771.1139224XX1_P1 | 4703 | 9181 | 728 | LYM911 | 90.3 | globlastp |
| platanus\|11v1\|SRR096786X145618_P1 | 4704 | 9182 | 728 | LYM911 | 90.3 | globlastp |
| rye\|gb164\|BE587008 | 4705 | 9176 | 728 | LYM911 | 90.3 | globlastp |
| wheat\|10v2\|BE420292 | 4706 | 9176 | 728 | LYM911 | 90.3 | globlastp |
| wheat\|10v2\|BE443213 | 4707 | 9176 | 728 | LYM911 | 90.3 | globlastp |
| wheat\|12v3\|BE420292_P1 | 4708 | 9176 | 728 | LYM911 | 90.3 | globlastp |
| phyla\|11v2\|SRR099035X100161_T1 | 4709 | 9183 | 728 | LYM911 | 89.25 | glotblastn |
| banana\|12v1\|MAGEN2012016419_P1 | 4710 | 9184 | 728 | LYM911 | 89.2 | globlastp |
| blueberry\|12v1\|SRR353282X27334D1_P1 | 4711 | 9185 | 728 | LYM911 | 89.2 | globlastp |
| barley\|10v2\|BF255083 | 4712 | 9186 | 728 | LYM911 | 89.2 | globlastp |
| barley\|12v1\|BF255083_P1 | 4713 | 9186 | 728 | LYM911 | 89.2 | globlastp |
| beet\|gb162\|BQ589868 | 4714 | 9187 | 728 | LYM911 | 89.2 | globlastp |
| catharanthus\|11v1\|EG560555_P1 | 4715 | 9188 | 728 | LYM911 | 89.2 | globlastp |
| cichorium\|gb171\|EH708969_P1 | 4716 | 9189 | 728 | LYM911 | 89.2 | globlastp |
| dandelion\|10v1\|DR399802_P1 | 4717 | 9190 | 728 | LYM911 | 89.2 | globlastp |
| grape\|11v1\|GSVIVT01024961001_P1 | 4718 | 9191 | 728 | LYM911 | 89.2 | globlastp |
| lettuce\|10v1\|DW043677 | 4719 | 9189 | 728 | LYM911 | 89.2 | globlastp |
| lettuce\|10v1\|DW059634 | 4720 | 9189 | 728 | LYM911 | 89.2 | globlastp |
| liriodendron\|gb166\|DT584476_P1 | 4721 | 9192 | 728 | LYM911 | 89.2 | globlastp |
| monkeyflower\|10v1\|DV209890_P1 | 4722 | 9193 | 728 | LYM911 | 89.2 | globlastp |
| phyla\|11v2\|SRR099036X54829_P1 | 4723 | 9194 | 728 | LYM911 | 89.2 | globlastp |
| beet\|12v1\|BQ589868_P1 | 4724 | 9195 | 728 | LYM911 | 88.2 | globlastp |
| apple\|11v1\|CN492509_P1 | 4725 | 9196 | 728 | LYM911 | 88.2 | globlastp |
| cirsium\|11v1\|SRR346952.23975_P1 | 4726 | 9197 | 728 | LYM911 | 88.2 | globlastp |
| dandelion\|10v1\|DY811086_P1 | 4727 | 9198 | 728 | LYM911 | 88.2 | globlastp |
| eggplant\|10v1\|FS001937_P1 | 4728 | 9199 | 728 | LYM911 | 88.2 | globlastp |
| grape\|11v1\|GSVIVT01034172001_P1 | 4729 | 9200 | 728 | LYM911 | 88.2 | globlastp |
| prunus\|10v1\|CN492509 | 4730 | 9201 | 728 | LYM911 | 88.2 | globlastp |
| sunflower\|10v1\|DY912491 | 4731 | 9202 | 728 | LYM911 | 88.2 | globlastp |
| tragopogon\|10v1\|SRR020205S0163272 | 4732 | 9203 | 728 | LYM911 | 88.2 | globlastp |
| zostera\|10v1\|SRR057351S0006274 | 4733 | 9204 | 728 | LYM911 | 88.2 | globlastp |
| flaveria\|11v1\|SRR149232.132012_P1 | 4734 | 9205 | 728 | LYM911 | 87.2 | globlastp |
| flaveria\|11v1\|SRR149232.165470_P1 | 4735 | 9205 | 728 | LYM911 | 87.2 | globlastp |
| flaveria\|11v1\|SRR149238.152349_P1 | 4736 | 9205 | 728 | LYM911 | 87.2 | globlastp |
| flaveria\|11v1\|SRR149244.100937_P1 | 4737 | 9205 | 728 | LYM911 | 87.2 | globlastp |
| banana\|12v1\|ES435188_P1 | 4738 | 9206 | 728 | LYM911 | 87.1 | globlastp |
| bupleurum\|11v1\|SRR301254.128145_P1 | 4739 | 9207 | 728 | LYM911 | 87.1 | globlastp |
| onion\|12v1\|SRR073446X100963D1_P1 | 4740 | 9208 | 728 | LYM911 | 87.1 | globlastp |
| rose\|12v1\|EC586838_P1 | 4741 | 9209 | 728 | LYM911 | 87.1 | globlastp |
| fagopyrum\|11v1\|SRR063689X102889_P1 | 4742 | 9210 | 728 | LYM911 | 87.1 | globlastp |
| gerbera\|09v1\|AJ755045_P1 | 4743 | 9211 | 728 | LYM911 | 87.1 | globlastp |
| hornbeam\|12v1\|SRR364455.108582_P1 | 4744 | 9212 | 728 | LYM911 | 87.1 | globlastp |
| hornbeam\|12v1\|SRR364455.199793_P1 | 4745 | 9213 | 728 | LYM911 | 87.1 | globlastp |
| nicotiana_benthamiana\|gb162\|EH366588_P1 | 4746 | 9214 | 728 | LYM911 | 87.1 | globlastp |
| rose\|10v1\|EC586838 | 4747 | 9209 | 728 | LYM911 | 87.1 | globlastp |
| safflower\|gb162\|EL411470 | 4748 | 9215 | 728 | LYM911 | 87.1 | globlastp |
| sunflower\|12v1\|CD851025_P1 | 4749 | 9216 | 728 | LYM911 | 86.2 | globlastp |
| flaveria\|11v1\|SRR149229.105188_P1 | 4750 | 9217 | 728 | LYM911 | 86.2 | globlastp |
| guizotia\|10v1\|GE574944_P1 | 4751 | 9218 | 728 | LYM911 | 86.2 | globlastp |
| prunus\|10v1\|CV044615 | 4752 | 9219 | 728 | LYM911 | 86.2 | globlastp |
| sunflower\|10v1\|CD851025 | 4753 | 9216 | 728 | LYM911 | 86.2 | globlastp |
| cucumber\|09v1\|CSCRP014807_P1 | 4754 | 9220 | 728 | LYM911 | 86 | globlastp |
| cynara\|gb167\|GE590950_P1 | 4755 | 9221 | 728 | LYM911 | 86 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| fagopyrum\|11v1\|SRR063689X123786_P1 | 4756 | 9222 | 728 | LYM911 | 86 | globlastp |
| fagopyrum\|11v1\|SRR063703X105062_P1 | 4757 | 9223 | 728 | LYM911 | 86 | globlastp |
| iceplant\|gb164\|AF150112_P1 | 4758 | 9224 | 728 | LYM911 | 86 | globlastp |
| melon\|10v1\|VMEL00489335753817_P1 | 4759 | 9220 | 728 | LYM911 | 86 | globlastp |
| pepper\|12v1\|CA518672_P1 | 4760 | 9225 | 728 | LYM911 | 86 | globlastp |
| pepper\|gb171\|CA518672 | 4761 | 9225 | 728 | LYM911 | 86 | globlastp |
| petunia\|gb171\|FN008562_P1 | 4762 | 9226 | 728 | LYM911 | 86 | globlastp |
| potato\|10v1\|BG887860_P1 | 4763 | 9225 | 728 | LYM911 | 86 | globlastp |
| solanum_phureja\|09v1\|SPHBG125134 | 4764 | 9225 | 728 | LYM911 | 86 | globlastp |
| tomato\|11v1\|BG125134 | 4765 | 9227 | 728 | LYM911 | 86 | globlastp |
| utricularia\|11v1\|SRR094438.356305 | 4766 | 9228 | 728 | LYM911 | 85.4 | globlastp |
| primula\|11v1\|SRR098679X98772_P1 | 4767 | 9229 | 728 | LYM911 | 85.1 | globlastp |
| banana\|10v1\|ES434290 | 4768 | 9230 | 728 | LYM911 | 84.95 | glotblastn |
| epimedium\|11v1\|SRR013507.37831_P1 | 4769 | 9231 | 728 | LYM911 | 84.9 | globlastp |
| acacia\|10v1\|FS590946_P1 | 4770 | 9232 | 728 | LYM911 | 84.9 | globlastp |
| artemisia\|10v1\|EY040279_P1 | 4771 | 9233 | 728 | LYM911 | 84.9 | globlastp |
| centaurea\|gb166\|EH721004_P1 | 4772 | 9234 | 728 | LYM911 | 84.9 | globlastp |
| eschscholzia\|11v1\|SRR014116.101424_P1 | 4773 | 9235 | 728 | LYM911 | 84.9 | globlastp |
| gerbera\|09v1\|AJ756094_P1 | 4774 | 9236 | 728 | LYM911 | 84.9 | globlastp |
| lotus\|09v1\|LLGO007985_P1 | 4775 | 9237 | 728 | LYM911 | 84.9 | globlastp |
| oak\|10v1\|CF369279_P1 | 4776 | 9238 | 728 | LYM911 | 84.9 | globlastp |
| pigeonpea\|11v1\|GR471039_P1 | 4777 | 9239 | 728 | LYM911 | 84.9 | globlastp |
| soybean\|11v1\|GLYMA11G14830 | 4778 | 9240 | 728 | LYM911 | 84.9 | globlastp |
| soybean\|11v1\|GLYMA12G06770 | 4779 | 9241 | 728 | LYM911 | 84.9 | globlastp |
| walnuts\|gb166\|CV198017 | 4780 | 9242 | 728 | LYM911 | 84.9 | globlastp |
| watermelon\|11v1\|VMEL00489335753817 | 4781 | 9243 | 728 | LYM911 | 84.9 | globlastp |
| flax\|11v1\|JG022711_P1 | 4782 | 9244 | 728 | LYM911 | 84 | globlastp |
| humulus\|11v1\|GD245825XX1_P1 | 4783 | 9245 | 728 | LYM911 | 84 | globlastp |
| amorphophallus\|11v2\|SRR089351X203758_P1 | 4784 | 9246 | 728 | LYM911 | 83.9 | globlastp |
| artemisia\|10v1\|SRR019254S0004389_P1 | 4785 | 9247 | 728 | LYM911 | 83.9 | globlastp |
| beech\|11v1\|FR606818_P1 | 4786 | 9248 | 728 | LYM911 | 83.9 | globlastp |
| cucurbita\|11v1\|SRR091276X103412_P1 | 4787 | 9249 | 728 | LYM911 | 83.9 | globlastp |
| eucalyptus\|11v2\|ES590193_P1 | 4788 | 9250 | 728 | LYM911 | 83.9 | globlastp |
| cirsium\|11v1\|SRR346952.1069711_T1 | 4789 | 9251 | 728 | LYM911 | 83.87 | glotblastn |
| flaveria\|11v1\|SRR149229.23168_P1 | 4790 | 9252 | 728 | LYM911 | 83 | globlastp |
| strawberry\|11v1\|CO381230 | 4791 | 9253 | 728 | LYM911 | 83 | globlastp |
| nasturtium\|11v1\|SRR032558.114374_T1 | 4792 | 9254 | 728 | LYM911 | 82.8 | glotblastn |
| senecio\|gb170\|DY662262 | 4793 | 9255 | 728 | LYM911 | 82.8 | globlastp |
| sequoia\|10v1\|SRR065044S0004880 | 4794 | 9256 | 728 | LYM911 | 82.8 | globlastp |
| silene\|11v1\|GH292305 | 4795 | 9257 | 728 | LYM911 | 82.8 | globlastp |
| tea\|10v1\|GW342749 | 4796 | 9258 | 728 | LYM911 | 82.8 | globlastp |
| ambrosia\|11v1\|SRR346943.135157_P1 | 4797 | 9259 | 728 | LYM911 | 81.9 | globlastp |
| wheat\|12v3\|CA624120_T1 | 4798 | 9260 | 728 | LYM911 | 81.72 | glotblastn |
| medicago\|12v1\|AW171690_P1 | 4799 | 9261 | 728 | LYM911 | 81.7 | globlastp |
| chickpea\|11v1\|GR403089_P1 | 4800 | 9262 | 728 | LYM911 | 81.7 | globlastp |
| cowpea\|12v1\|FC460112_P1 | 4801 | 9263 | 728 | LYM911 | 81.7 | globlastp |
| cowpea\|gb166\|FC460112 | 4802 | 9263 | 728 | LYM911 | 81.7 | globlastp |
| cryptomeria\|gb166\|AU299938_P1 | 4803 | 9264 | 728 | LYM911 | 81.7 | globlastp |
| euonymus\|11v1\|SRR070038X173785_P1 | 4804 | 9265 | 728 | LYM911 | 81.7 | globlastp |
| liquorice\|gb171\|FS247650_P1 | 4805 | 9266 | 728 | LYM911 | 81.7 | globlastp |
| taxus\|10v1\|SRR065067S0029540 | 4806 | 9267 | 728 | LYM911 | 81.7 | globlastp |
| tripterygium\|11v1\|SRR098677X125634 | 4807 | 9268 | 728 | LYM911 | 81.7 | globlastp |
| sesame\|12v1\|SESI12V1365157_P1 | 4808 | 9269 | 728 | LYM911 | 80.6 | globlastp |
| cleome_gynandra\|10v1\|SRR015532S0010384_P1 | 4809 | 9270 | 728 | LYM911 | 80.6 | globlastp |
| cleome_spinosa\|10v1\|GR930915_P1 | 4810 | 9271 | 728 | LYM911 | 80.6 | globlastp |
| humurus\|11v1\|SRR098683X35042_P1 | 4811 | 9272 | 728 | LYM911 | 80.6 | globlastp |
| nasturtium\|11v1\|SRR032558.117603_P1 | 4812 | 9273 | 728 | LYM911 | 80.6 | globlastp |
| oak\|10v1\|DN950278_P1 | 4813 | 9274 | 728 | LYM911 | 80.6 | globlastp |
| papaya\|gb165\|EX294168_P1 | 4814 | 9275 | 728 | LYM911 | 80.6 | globlastp |
| podocarpus\|10v1\|SRR065014S0105967_P1 | 4815 | 9276 | 728 | LYM911 | 80.6 | globlastp |
| thellungiella_parvulum\|11v1\|EPCRP007394 | 4816 | 9277 | 728 | LYM911 | 80.6 | globlastp |
| poppy\|11v1\|FE964324_P1 | 4817 | 9278 | 728 | LYM911 | 80.4 | globlastp |
| maize\|10v1\|CA404425_P1 | 4818 | 9279 | 730 | LYM913 | 95.2 | globlastp |
| foxtail_millet\|11v3\|PHY7SI030906M_P1 | 4819 | 9280 | 730 | LYM913 | 94.8 | globlastp |
| maize\|10v1\|BM381899_P1 | 4820 | 9281 | 730 | LYM913 | 92.4 | globlastp |
| brachypodium\|12v1\|BRADI1G53857_P1 | 4821 | 9282 | 730 | LYM913 | 86 | globlastp |
| brachypodium\|09v1\|GT771108 | 4822 | 9282 | 730 | LYM913 | 86 | globlastp |
| wheat\|10v2\|CA697362 | 4823 | 9283 | 730 | LYM913 | 86 | globlastp |
| wheat\|12v3\|CA697362_P1 | 4824 | 9283 | 730 | LYM913 | 86 | globlastp |
| rice\|11v1\|CK074003 | 4825 | 9284 | 730 | LYM913 | 85.3 | globlastp |
| barley\|10v2\|AJ473765 | 4826 | 9285 | 730 | LYM913 | 83.7 | globlastp |
| switchgrass\|gb167\|FL783669 | 4827 | 9286 | 730 | LYM913 | 82.1 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| maize\|10v1\|AI855326_P1 | 4828 | 9287 | 731 | LYM914 | 85.8 | globlastp |
| switchgrass\|gb167\|DN143187_P1 | 4829 | 9288 | 731 | LYM914 | 81.7 | globlastp |
| foxtail_millet\|11v3\|PHY7SI030487M_P1 | 4830 | 9289 | 731 | LYM914 | 80.1 | globlastp |
| maize\|10v1\|AI637084_P1 | 4831 | 9290 | 732 | LYM915 | 91.5 | globlastp |
| foxtail_millet\|11v3\|PHY7SI030954M_P1 | 4832 | 9291 | 732 | LYM915 | 90.4 | globlastp |
| foxtail_millet\|11v3\|PHY7SI030949M_P1 | 4833 | 9292 | 732 | LYM915 | 89.6 | globlastp |
| rice\|11v1\|CA766422 | 4834 | 9293 | 732 | LYM915 | 81.7 | globlastp |
| wheat\|12v3\|BF474157_P1 | 4835 | 9294 | 732 | LYM915 | 80.3 | globlastp |
| sugarcane\|10v1\|CA084924 | 4836 | 9295 | 735 | LYM919 | 97.8 | globlastp |
| switchgrass\|gb167\|FE632107 | 4837 | 9296 | 735 | LYM919 | 96.4 | globlastp |
| cenchrus\|gb166\|EB659256_P1 | 4838 | 9297 | 735 | LYM919 | 94.9 | globlastp |
| maize\|10v1\|AI943621_P1 | 4839 | 9298 | 735 | LYM919 | 94.9 | globlastp |
| millet\|10v1\|EVO454PM122929_P1 | 4840 | 9299 | 735 | LYM919 | 93.5 | globlastp |
| rice\|11v1\|AU063508 | 4841 | 9300 | 735 | LYM919 | 93.5 | globlastp |
| foxtail_millet\|11v3\|PHY7SI031472M_P1 | 4842 | 9301 | 735 | LYM919 | 92.8 | globlastp |
| pseudoroegneria\|gb167\|FF353299 | 4843 | 9302 | 735 | LYM919 | 90.6 | globlastp |
| brachypodium\|12v1\|BRADI4G34170_P1 | 4844 | 9303 | 735 | LYM919 | 89.2 | globlastp |
| wheat\|12v3\|BE419598_P1 | 4845 | 9304 | 735 | LYM919 | 89.2 | globlastp |
| brachypodium\|09v1\|DV471490 | 4846 | 9303 | 735 | LYM919 | 89.2 | globlastp |
| wheat\|10v2\|BE419598 | 4847 | 9304 | 735 | LYM919 | 89.2 | globlastp |
| barley\|10v2\|BG300493 | 4848 | 9305 | 735 | LYM919 | 88.7 | globlastp |
| barley\|12v1\|BG300493_P1 | 4849 | 9306 | 735 | LYM919 | 87.9 | globlastp |
| rye\|12v1\|DRR001012.136139_T1 | 4850 | 9307 | 735 | LYM919 | 86.96 | glotblastn |
| rice\|11v1\|AU029873 | 4851 | 9308 | 735 | LYM919 | 85.6 | globlastp |
| wheat\|10v2\|CA618514 | 4852 | 9309 | 735 | LYM919 | 83.33 | glotblastn |
| cenchrus\|gb166\|EB652927_P1 | 4853 | 9310 | 735 | LYM919 | 83.3 | globlastp |
| foxtail_millet\|11v3\|PHY7SI014437M_P1 | 4854 | 9311 | 735 | LYM919 | 81.9 | globlastp |
| switchgrass\|gb167\|FE623807 | 4855 | 9312 | 735 | LYM919 | 81.2 | globlastp |
| switchgrass\|gb167\|FL787158 | 4856 | 9313 | 735 | LYM919 | 80.4 | globlastp |
| maize\|10v1\|AI770372_P1 | 4857 | 9314 | 736 | LYM920 | 96.7 | globlastp |
| switchgrass\|gb167\|FE600759 | 4858 | 9315 | 736 | LYM920 | 94.5 | globlastp |
| foxtail_millet\|11v3\|PHY7SI028928M_P1 | 4859 | 9316 | 736 | LYM920 | 93.2 | globlastp |
| rice\|11v1\|CF987861 | 4860 | 9317 | 736 | LYM920 | 89.4 | globlastp |
| brachypodium\|12v1\|BRADI4G34880_P1 | 4861 | 9318 | 736 | LYM920 | 89.2 | globlastp |
| brachypodium\|09v1\|GT797501 | 4862 | 9318 | 736 | LYM920 | 89.2 | globlastp |
| wheat\|12v3\|CJ612423_P1 | 4863 | 9319 | 736 | LYM920 | 88.1 | globlastp |
| rye\|12v1\|DRR001012.150636_P1 | 4864 | 9320 | 736 | LYM920 | 87.9 | globlastp |
| wheat\|10v2\|BE497440 | 4865 | 9321 | 736 | LYM920 | 87.8 | globlastp |
| barley\|12v1\|AJ461462_P1 | 4866 | 9322 | 736 | LYM920 | 87.5 | globlastp |
| millet\|10v1\|EVO454PM016311_P1 | 4867 | 9323 | 736 | LYM920 | 85.4 | globlastp |
| maize\|10v1\|BE453844_P1 | 4868 | 9324 | 738 | LYM922 | 89.5 | globlastp |
| sugarcane\|10v1\|BQ533758 | 4869 | 9325 | 739 | LYM923 | 96.8 | globlastp |
| maize\|10v1\|AA979984_P1 | 4870 | 9326 | 739 | LYM923 | 91.3 | globlastp |
| maize\|10v1\|W59816_P1 | 4871 | 9327 | 739 | LYM923 | 89.9 | globlastp |
| switchgrass\|gb167\|DN143566 | 4872 | 9328 | 739 | LYM923 | 85.4 | globlastp |
| switchgrass\|gb167\|DN143110 | 4873 | 9329 | 739 | LYM923 | 84.5 | globlastp |
| foxtail_millet\|11v3\|EC613302_P1 | 4874 | 9330 | 739 | LYM923 | 83.5 | globlastp |
| lovegrass\|gb167\|DN480804_P1 | 4875 | 9331 | 739 | LYM923 | 82.6 | globlastp |
| millet\|10v1\|CD724622_T1 | 4876 | 9332 | 739 | LYM923 | 82.11 | glotblastn |
| maize\|10v1\|AW091407_P1 | 4877 | 9333 | 740 | LYM924 | 89.3 | globlastp |
| foxtail_millet\|11v3\|PHY7SI030440M_P1 | 4878 | 9334 | 740 | LYM924 | 89 | globlastp |
| rice\|11v1\|C27412 | 4879 | 9335 | 740 | LYM924 | 81.9 | globlastp |
| maize\|10v1\|CD944915_P1 | 4880 | 9336 | 741 | LYM925 | 89.7 | globlastp |
| maize\|10v1\|ZMCRP2V131863_P1 | 4881 | 9337 | 741 | LYM925 | 88.5 | globlastp |
| foxtail_millet\|11v3\|PHY7SI003161M_P1 | 4882 | 9338 | 741 | LYM925 | 86.5 | globlastp |
| switchgrass\|gb167\|FE600383 | 4883 | 9339 | 741 | LYM925 | 85.9 | globlastp |
| maize\|10v1\|ZMCRP2V079869_P1 | 4884 | 9340 | 741 | LYM925 | 85.5 | globlastp |
| maize\|10v1\|ZMCRP2V227876_P1 | 4885 | 9341 | 741 | LYM925 | 85.5 | globlastp |
| wheat\|10v2\|CA593499 | 4886 | 9342 | 741 | LYM925 | 80.5 | globlastp |
| switchgrass\|gb167\|FE623141 | 4887 | 9343 | 742 | LYM926 | 89.56 | glotblastn |
| foxtail_millet\|11v3\|EC613805_T1 | 4888 | 9344 | 742 | LYM926 | 88.06 | glotblastn |
| maize\|10v1\|CD445930_P1 | 4889 | 9345 | 742 | LYM926 | 87.8 | globlastp |
| maize\|10v1\|AA979968_P1 | 4890 | 9346 | 742 | LYM926 | 87.4 | globlastp |
| rice\|11v1\|CF988213 | 4891 | 9347 | 742 | LYM926 | 82.4 | globlastp |
| rice\|11v1\|OSCRP000754 | 4892 | 9347 | 742 | LYM926 | 82.4 | globlastp |
| brachypodium\|12v1\|BRADI2G04980_P1 | 4893 | 9348 | 742 | LYM926 | 81.2 | globlastp |
| brachypodium\|09v1\|DV477922 | 4894 | 9348 | 742 | LYM926 | 81.2 | globlastp |
| brachypodium\|12v1\|BRADI2G04990_P1 | 4895 | 9349 | 742 | LYM926 | 80.8 | globlastp |
| brachypodium\|09v1\|DV489099 | 4896 | 9349 | 742 | LYM926 | 80.8 | globlastp |
| maize\|10v1\|AW562969_P1 | 4897 | 9350 | 743 | LYM927 | 93.9 | globlastp |
| foxtail_millet\|11v3\|PHY7SI001179M_P1 | 4898 | 9351 | 743 | LYM927 | 92.1 | globlastp |
| switchgrass\|gb167\|FL709403 | 4899 | 9352 | 743 | LYM927 | 91.7 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| rice\|11v1\|CR283542 | 4900 | 9353 | 743 | LYM927 | 84.9 | globlastp |
| brachypodium\|12v1\|BRADI2G04900_P1 | 4901 | 9354 | 743 | LYM927 | 83.3 | globlastp |
| brachypodium\|09v1\|GT801039 | 4902 | 9354 | 743 | LYM927 | 83.3 | globlastp |
| wheat\|12v3\|BQ246150_P1 | 4903 | 9355 | 743 | LYM927 | 82.5 | globlastp |
| barley\|10v2\|BI958842 | 4904 | 9356 | 743 | LYM927 | 82.3 | globlastp |
| barley\|12v1\|BI958842_P1 | 4905 | 9356 | 743 | LYM927 | 82.3 | globlastp |
| rye\|12v1\|DRR001012.176890_T1 | 4906 | 9357 | 743 | LYM927 | 82.02 | glotblastn |
| maize\|10v1\|AL586821_P1 | 4907 | 9358 | 744 | LYM928 | 89.8 | globlastp |
| foxtail_millet\|11v3\|PHY7SI001537M_P1 | 4908 | 9359 | 744 | LYM928 | 88.2 | globlastp |
| maize\|10v1\|BE640427_P1 | 4909 | 9360 | 745 | LYM929 | 92 | globlastp |
| foxtail_millet\|11v3\|PHY7SI001385M_P1 | 4910 | 9361 | 745 | LYM929 | 90.4 | globlastp |
| rice\|11v1\|BE228450 | 4911 | 9362 | 745 | LYM929 | 84.1 | globlastp |
| wheat\|10v2\|BE445060 | 4912 | 9363 | 745 | LYM929 | 83 | globlastp |
| wheat\|12v3\|BQ904064_P1 | 4913 | 9364 | 745 | LYM929 | 82.6 | globlastp |
| rye\|12v1\|DRR001012.397797_P1 | 4914 | 9365 | 745 | LYM929 | 82.4 | globlastp |
| brachypodium\|12v1\|BRADI2G03350_P1 | 4915 | 9366 | 745 | LYM929 | 82 | globlastp |
| oat\|11v1\|GR317242_P1 | 4916 | 9367 | 745 | LYM929 | 81.2 | globlastp |
| maize\|10v1\|AW171893_P1 | 4917 | 9368 | 746 | LYM930 | 85.8 | globlastp |
| foxtail_millet\|11v3\|PHY7SI001257M_P1 | 4918 | 9369 | 746 | LYM930 | 83.1 | globlastp |
| sugarcane\|10v1\|BQ533598 | 4919 | 9370 | 747 | LYM931 | 97.1 | globlastp |
| maize\|10v1\|AI861660_P1 | 4920 | 9371 | 747 | LYM931 | 93.8 | globlastp |
| switchgrass\|gb167\|DN141715 | 4921 | 9372 | 747 | LYM931 | 93.7 | globlastp |
| foxtail_millet\|11v3\|PHY7SI001453M_P1 | 4922 | 9373 | 747 | LYM931 | 93.1 | globlastp |
| millet\|10v1\|EVO454PM002727_P1 | 4923 | 9374 | 747 | LYM931 | 92.6 | globlastp |
| foxtail_millet\|11v3\|PHY7SI001442M_P1 | 4924 | 9375 | 747 | LYM931 | 89.9 | globlastp |
| brachypodium\|12v1\|BRADI2G41300_P1 | 4925 | 9376 | 747 | LYM931 | 87.7 | globlastp |
| brachypodium\|09v1\|DV469445 | 4926 | 9376 | 747 | LYM931 | 87.7 | globlastp |
| rice\|11v1\|BE040234 | 4927 | 9377 | 747 | LYM931 | 87.5 | globlastp |
| barley\|10v2\|BE420891 | 4928 | 9378 | 747 | LYM931 | 85.9 | globlastp |
| rye\|12v1\|DRR001012.10681_P1 | 4929 | 9379 | 747 | LYM931 | 85.5 | globlastp |
| wheat\|12v3\|BE405599_T1 | 4930 | 9380 | 747 | LYM931 | 85.01 | glotblastn |
| wheat\|10v2\|BE405599 | 4931 | 9381 | 747 | LYM931 | 85.01 | glotblastn |
| wheat\|12v3\|BQ242821_P1 | 4932 | 9382 | 747 | LYM931 | 80.1 | globlastp |
| maize\|10v1\|BG320896_P1 | 4933 | 9383 | 748 | LYM932 | 83.7 | globlastp |
| maize\|10v1\|AI396000_P1 | 4934 | 9384 | 749 | LYM933 | 91 | globlastp |
| foxtail_millet\|11v3\|PHY7SI002138M_P1 | 4935 | 9385 | 749 | LYM933 | 87.9 | globlastp |
| sugarcane\|10v1\|CA074541 | 4936 | 9386 | 749 | LYM933 | 87.87 | glotblastn |
| millet\|10v1\|EVO454PM051173_T1 | 4937 | 9387 | 749 | LYM933 | 80.47 | glotblastn |
| maize\|10v1\|AI461517_P1 | 4938 | 9388 | 751 | LYM935 | 97.7 | globlastp |
| foxtail_millet\|11v3\|PHY7SI018119M_P1 | 4939 | 9389 | 751 | LYM935 | 97.3 | globlastp |
| millet\|10v1\|EVO454PM053928_P1 | 4940 | 9390 | 751 | LYM935 | 95.8 | globlastp |
| foxtail_millet\|11v3\|SIPRD014960_P1 | 4941 | 9391 | 751 | LYM935 | 95.4 | globlastp |
| maize\|10v1\|AI668284_P1 | 4942 | 9392 | 751 | LYM935 | 94.7 | globlastp |
| switchgrass\|gb167\|FE619886 | 4943 | 9393 | 751 | LYM935 | 93.5 | globlastp |
| rice\|11v1\|BI305508 | 4944 | 9394 | 751 | LYM935 | 92.42 | glotblastn |
| rice\|11v1\|BI306581 | 4945 | 9395 | 751 | LYM935 | 92.4 | globlastp |
| wheat\|10v2\|BE403510 | 4946 | 9396 | 751 | LYM935 | 90.1 | globlastp |
| wheat\|12v3\|BE403510_P1 | 4947 | 9396 | 751 | LYM935 | 90.1 | globlastp |
| rye\|12v1\|BF429430_P1 | 4948 | 9397 | 751 | LYM935 | 89.7 | globlastp |
| brachypodium\|12v1\|BRADI3G44050_P1 | 4949 | 9398 | 751 | LYM935 | 89.4 | globlastp |
| barley\|10v2\|BE413037 | 4950 | 9399 | 751 | LYM935 | 89.4 | globlastp |
| brachypodium\|09v1\|DV476559 | 4951 | 9398 | 751 | LYM935 | 89.4 | globlastp |
| leymus\|gb166\|EG385172_P1 | 4952 | 9400 | 751 | LYM935 | 89.1 | globlastp |
| pseudoroegneria\|gb167\|FF343867 | 4953 | 9401 | 751 | LYM935 | 88.93 | glotblastn |
| fescue\|gb161\|DT680885_P1 | 4954 | 9402 | 751 | LYM935 | 88.5 | globlastp |
| oat\|11v1\|CN814874_P1 | 4955 | 9403 | 751 | LYM935 | 87.8 | globlastp |
| maize\|10v1\|EG097273_T1 | 4956 | 9404 | 751 | LYM935 | 86.64 | glotblastn |
| sugarcane\|10v1\|CA106655 | 4957 | 9405 | 751 | LYM935 | 80.9 | globlastp |
| maize\|10v1\|BM334790_P1 | 4958 | 9406 | 752 | LYM936 | 94.3 | globlastp |
| foxtail_millet\|11v3\|PHY7SI018025M_P1 | 4959 | 9407 | 752 | LYM936 | 93.3 | globlastp |
| switchgrass\|gb167\|DN140632 | 4960 | 9408 | 752 | LYM936 | 93.3 | globlastp |
| rice\|11v1\|CA764231 | 4961 | 9409 | 752 | LYM936 | 87.9 | globlastp |
| brachypodium\|12v1\|BRADI3G46980_P1 | 4962 | 9410 | 752 | LYM936 | 87.2 | globlastp |
| brachypodium\|09v1\|DV471224 | 4963 | 9410 | 752 | LYM936 | 87.2 | globlastp |
| barley\|10v2\|BF257307 | 4964 | 9411 | 752 | LYM936 | 85.5 | globlastp |
| barley\|12v1\|BF257307_P1 | 4965 | 9411 | 752 | LYM936 | 85.5 | globlastp |
| wheat\|10v2\|BE426082 | 4966 | 9412 | 752 | LYM936 | 85.5 | globlastp |
| wheat\|12v3\|BE426082_P1 | 4967 | 9413 | 752 | LYM936 | 85.1 | globlastp |
| millet\|10v1\|EVO454PM214408_P1 | 4968 | 9414 | 752 | LYM936 | 85.1 | globlastp |
| rye\|12v1\|BE494381_P1 | 4969 | 9415 | 752 | LYM936 | 84.4 | globlastp |
| leymus\|gb166\|EG401538_P1 | 4970 | 9416 | 752 | LYM936 | 84 | globlastp |
| oat\|11v1\|GO586421_P1 | 4971 | 9417 | 752 | LYM936 | 84 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sugarcane\|10v1\|CA066751 | 4972 | 9418 | 752 | LYM936 | 83.9 | globlastp |
| millet\|10v1\|EVO454PM008034_P1 | 4973 | 9419 | 752 | LYM936 | 83.5 | globlastp |
| sorghum\|11v1\|SB06G019110 | 4974 | 9420 | 752 | LYM936 | 83.5 | globlastp |
| sorghum\|12v1\|SB06G019110_P1 | 4975 | 9420 | 752 | LYM936 | 83.5 | globlastp |
| wheat\|10v2\|CA621194 | 4976 | 9421 | 752 | LYM936 | 83.33 | glotblastn |
| switchgrass\|gb167\|DN141596 | 4977 | 9422 | 752 | LYM936 | 83.2 | globlastp |
| wheat\|12v3\|CA621194_T1 | 4978 | 9423 | 752 | LYM936 | 82.98 | glotblastn |
| foxtail_millet\|11v3\|PHY7SI010774M_P1 | 4979 | 9424 | 752 | LYM936 | 82.8 | globlastp |
| maize\|10v1\|AI396064_P1 | 4980 | 9425 | 752 | LYM936 | 82.8 | globlastp |
| rice\|11v1\|AA754503 | 4981 | 9426 | 752 | LYM936 | 82.69 | glotblastn |
| barley\|10v2\|BE422250XX2 | 4982 | 9427 | 752 | LYM936 | 81.5 | globlastp |
| barley\|12v1\|BE422250_P1 | 4983 | 9427 | 752 | LYM936 | 81.5 | globlastp |
| brachypodium\|12v1\|BRADI5G12530_P1 | 4984 | 9428 | 752 | LYM936 | 81.1 | globlastp |
| brachypodium\|09v1\|GT821384 | 4985 | 9428 | 752 | LYM936 | 81.1 | globlastp |
| wheat\|10v2\|BE517027 | 4986 | 9429 | 752 | LYM936 | 81.1 | globlastp |
| wheat\|12v3\|BE517027_P1 | 4987 | 9430 | 752 | LYM936 | 81.1 | globlastp |
| pseudoroegneria\|gb167\|FF341000 | 4988 | 9431 | 752 | LYM936 | 80.9 | globlastp |
| rye\|12v1\|DRR001012.16265_P1 | 4989 | 9432 | 752 | LYM936 | 80.8 | globlastp |
| oat\|11v1\|GR320222_P1 | 4990 | 9433 | 752 | LYM936 | 80.8 | globlastp |
| sugarcane\|10v1\|CA097617 | 4991 | 9434 | 753 | LYM937 | 96.4 | globlastp |
| sugarcane\|10v1\|CA097617 | 4991 | 9434 | 901 | LYM857 | 92.9 | globlastp |
| millet\|10v1\|EB411094_P1 | 4992 | 9435 | 753 | LYM937 | 88.5 | globlastp |
| millet\|10v1\|EB411094_P1 | 4992 | 9435 | 901 | LYM857 | 89.2 | globlastp |
| switchgrass\|gb167\|FE614915 | 4993 | 9436 | 753 | LYM937 | 87.5 | globlastp |
| switchgrass\|gb167\|FE614915 | 4993 | 9436 | 901 | LYM857 | 87.4 | globlastp |
| sorghum\|11v1\|BG355619 | 4994 | 9437 | 754 | LYM938 | 94.15 | glotblastn |
| foxtail_millet\|11v3\|PHY7SI017777M_P1 | 4995 | 9438 | 754 | LYM938 | 93.5 | globlastp |
| switchgrass\|gb167\|FE642273 | 4996 | 9439 | 754 | LYM938 | 92.4 | globlastp |
| millet\|10v1\|PMSLX0001168D1_P1 | 4997 | 9440 | 754 | LYM938 | 91.1 | globlastp |
| maize\|10v1\|BE639659_P1 | 4998 | 9441 | 754 | LYM938 | 88.2 | globlastp |
| maize\|10v1\|AI737276_P1 | 4999 | 9442 | 754 | LYM938 | 88.1 | globlastp |
| rice\|11v1\|AU172549 | 5000 | 9443 | 754 | LYM938 | 85.2 | globlastp |
| rice\|11v1\|BE228434 | 5001 | 9444 | 754 | LYM938 | 80.7 | globlastp |
| maize\|10v1\|AI901328_P1 | 5002 | 9445 | 755 | LYM939 | 97.2 | globlastp |
| sorghum\|11v1\|SB04G033610 | 5003 | 9446 | 755 | LYM939 | 96.5 | globlastp |
| sorghum\|12v1\|SB04G033610_P1 | 5004 | 9446 | 755 | LYM939 | 96.5 | globlastp |
| switchgrass\|gb167\|DN152365 | 5005 | 9447 | 755 | LYM939 | 96.2 | globlastp |
| foxtail_millet\|11v3\|PHY7SI036891M_P1 | 5006 | 9448 | 755 | LYM939 | 94.8 | globlastp |
| millet\|10v1\|EVO454PM004224_P1 | 5007 | 9449 | 755 | LYM939 | 92.4 | globlastp |
| rice\|11v1\|AU030697 | 5008 | 9450 | 755 | LYM939 | 89.9 | globlastp |
| brachypodium\|12v1\|BRADI1G01770_P1 | 5009 | 9451 | 755 | LYM939 | 86.8 | globlastp |
| brachypodium\|09v1\|GT761761 | 5010 | 9451 | 755 | LYM939 | 86.8 | globlastp |
| wheat\|12v3\|CA615159_P1 | 5011 | 9452 | 755 | LYM939 | 83.3 | globlastp |
| rice\|11v1\|CA762533 | 5012 | 9453 | 755 | LYM939 | 83.3 | globlastp |
| wheat\|10v2\|CA624032XX1 | 5013 | 9454 | 755 | LYM939 | 83.2 | globlastp |
| wheat\|12v3\|BE426354_P1 | 5014 | 9454 | 755 | LYM939 | 83.2 | globlastp |
| barley\|12v1\|AK250357_P1 | 5015 | 9455 | 755 | LYM939 | 83.1 | globlastp |
| barley\|10v2\|BE438942 | 5016 | 9455 | 755 | LYM939 | 83.1 | globlastp |
| wheat\|10v2\|BE426354 | 5017 | 9456 | 755 | LYM939 | 83.1 | globlastp |
| wheat\|10v2\|BE490048 | 5018 | 9457 | 755 | LYM939 | 83.1 | globlastp |
| rye\|12v1\|DRR001012.238257_P1 | 5019 | 9458 | 755 | LYM939 | 83 | globlastp |
| brachypodium\|12v1\|BRADI1G71410_P1 | 5020 | 9459 | 755 | LYM939 | 82.6 | globlastp |
| brachypodium\|09v1\|GT797082 | 5021 | 9459 | 755 | LYM939 | 82.6 | globlastp |
| rye\|12v1\|DRR001012.189236_T1 | 5022 | 9460 | 755 | LYM939 | 82.59 | glotblastn |
| rye\|12v1\|DRR001012.579482_T1 | 5023 | 9461 | 755 | LYM939 | 82.07 | glotblastn |
| rye\|12v1\|DRR001012.112811_T1 | 5024 | 9462 | 755 | LYM939 | 81.94 | glotblastn |
| rye\|12v1\|DRR001012.372409_P1 | 5025 | 9463 | 755 | LYM939 | 81.9 | globlastp |
| wheat\|12v3\|BE490048_P1 | 5026 | 9464 | 755 | LYM939 | 81.7 | globlastp |
| barley\|12v1\|BI950367_T1 | 5027 | 9465 | 755 | LYM939 | 80.89 | glotblastn |
| cassava\|09v1\|FF381337_T1 | 5028 | 9466 | 755 | LYM939 | 80.84 | glotblastn |
| grape\|11v1\|GSVIVT01022254001_T1 | 5029 | 9467 | 755 | LYM939 | 80.69 | glotblastn |
| gossypium_raimondii\|12v1\|ES814356_T1 | 5030 | 9468 | 755 | LYM939 | 80.49 | glotblastn |
| cacao\|10v1\|CGD0019824_T1 | 5031 | 9469 | 755 | LYM939 | 80.49 | glotblastn |
| clementine\|11v1\|CF508940_T1 | 5032 | 9470 | 755 | LYM939 | 80.49 | glotblastn |
| orange\|11v1\|CF508940_T1 | 5033 | 9471 | 755 | LYM939 | 80.49 | glotblastn |
| platanus\|11v1\|SRR096786X10076_T1 | 5034 | 9472 | 755 | LYM939 | 80.49 | glotblastn |
| sugarcane\|10v1\|CA072059 | 5035 | 9473 | 756 | LYM940 | 89.7 | globlastp |
| maize\|10v1\|BM074444_P1 | 5036 | 9474 | 756 | LYM940 | 81.7 | globlastp |
| maize\|10v1\|BU498930_T1 | 5037 | 9475 | 756 | LYM940 | 80.08 | glotblastn |
| sugarcane\|10v1\|CA075938 | 5038 | 9476 | 757 | LYM941 | 96.63 | glotblastn |
| maize\|10v1\|AW059985_P1 | 5039 | 9477 | 757 | LYM941 | 94.3 | globlastp |
| switchgrass\|gb167\|FE628726 | 5040 | 9478 | 757 | LYM941 | 91.03 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| foxtail_millet|11v3|PHY7SI016294M_P1 | 5041 | 9479 | 757 | LYM941 | 89.9 | globlastp |
| millet|10v1|EVO454PM001352_P1 | 5042 | 9480 | 757 | LYM941 | 83.4 | globlastp |
| rice|11v1|BI808293 | 5043 | 9481 | 757 | LYM941 | 81.7 | globlastp |
| brachypodium|12v1|BRADI3G57260_P1 | 5044 | 9482 | 757 | LYM941 | 80 | globlastp |
| brachypodium|09v1|DV484245 | 5045 | 9482 | 757 | LYM941 | 80 | globlastp |
| maize|10v1|BG836067_P1 | 5046 | 9483 | 761 | LYM945 | 90.5 | globlastp |
| foxtail_millet|11v3|PHY7SI026450M_P1 | 5047 | 9484 | 761 | LYM945 | 84.5 | globlastp |
| switchgrass|gb167|FE643005 | 5048 | 9485 | 761 | LYM945 | 83.1 | globlastp |
| rice|11v1|BE229699 | 5049 | 9486 | 761 | LYM945 | 80.3 | glotblastn |
| switchgrass|gb167|DN141706 | 5050 | 9487 | 762 | LYM946 | 88.5 | globlastp |
| switchgrass|gb167|DN142073 | 5051 | 9488 | 762 | LYM946 | 87.09 | glotblastn |
| maize|10v1|BG410542_P1 | 5052 | 9489 | 762 | LYM946 | 85 | globlastp |
| sugarcane|10v1|CA073370 | 5053 | 9490 | 763 | LYM947 | 96.4 | globlastp |
| maize|10v1|AW520213_P1 | 5054 | 9491 | 763 | LYM947 | 91.8 | globlastp |
| maize|10v1|BG842367_P1 | 5055 | 9492 | 763 | LYM947 | 91.8 | globlastp |
| switchgrass|gb167|FL760694 | 5056 | 9493 | 763 | LYM947 | 89.8 | glotblastn |
| foxtail_millet|11v3|EC613597_P1 | 5057 | 9494 | 763 | LYM947 | 89.3 | globlastp |
| switchgrass|gb167|FE600750 | 5058 | 9495 | 763 | LYM947 | 89.3 | globlastp |
| cenchrus|gb166|EB660957_P1 | 5059 | 9496 | 763 | LYM947 | 88.3 | globlastp |
| millet|10v1|EVO454PM125700_P1 | 5060 | 9497 | 763 | LYM947 | 88.3 | globlastp |
| switchgrass|gb167|FL961174 | 5061 | 9498 | 763 | LYM947 | 87.8 | globlastp |
| oat|11v1|GO591546_P1 | 5062 | 9499 | 763 | LYM947 | 81.6 | globlastp |
| brachypodium|12v1|BRADI5G10090_P1 | 5063 | 9500 | 763 | LYM947 | 80.6 | globlastp |
| wheat|12v3|AL816698_P1 | 5064 | 9501 | 763 | LYM947 | 80.6 | globlastp |
| brachypodium|09v1|GT774092 | 5065 | 9500 | 763 | LYM947 | 80.6 | globlastp |
| rice|11v1|BI813306 | 5066 | 9502 | 763 | LYM947 | 80.6 | globlastp |
| barley|10v2|AJ473631 | 5067 | 9503 | 763 | LYM947 | 80.1 | globlastp |
| barley|12v1|AJ473631_P1 | 5068 | 9503 | 763 | LYM947 | 80.1 | globlastp |
| foxtail_millet|11v3|PHY7SI011034M_P1 | 5069 | 9504 | 764 | LYM948 | 98.1 | globlastp |
| maize|10v1|BE761675_P1 | 5070 | 9505 | 764 | LYM948 | 97.7 | globlastp |
| maize|10v1|BE518770_P1 | 5071 | 9506 | 764 | LYM948 | 94.5 | globlastp |
| brachypodium|12v1|BRADI5G20660_P1 | 5072 | 9507 | 764 | LYM948 | 92.6 | globlastp |
| wheat|12v3|CA736983_P1 | 5073 | 9508 | 764 | LYM948 | 89.9 | globlastp |
| wheat|10v2|BG606645 | 5074 | 9509 | 764 | LYM948 | 89.4 | globlastp |
| brachypodium|09v1|GT831058 | 5075 | 9510 | 764 | LYM948 | 88.9 | globlastp |
| pseudoroegneria|gb167|FF360209 | 5076 | 9511 | 764 | LYM948 | 88.5 | globlastp |
| rice|11v1|AU082958 | 5077 | 9512 | 764 | LYM948 | 88.3 | globlastp |
| wheat|10v2|CK205460XX1 | 5078 | 9513 | 764 | LYM948 | 85.71 | glotblastn |
| rye|12v1|DRR001012.140110_P1 | 5079 | 9514 | 764 | LYM948 | 85.2 | globlastp |
| fescue|gb161|DT681629_P1 | 5080 | 9515 | 764 | LYM948 | 85 | globlastp |
| switchgrass|gb167|FE628333 | 5081 | 9516 | 764 | LYM948 | 83.9 | globlastp |
| barley|12v1|BE421131_P1 | 5082 | 9517 | 764 | LYM948 | 80.1 | globlastp |
| sugarcane|10v1|BQ533738 | 5083 | 9518 | 765 | LYM949 | 86.9 | globlastp |
| maize|10v1|BE638996_T1 | 5084 | 9519 | 765 | LYM949 | 86.05 | glotblastn |
| foxtail_millet|11v3|PHY7SI023248M_P1 | 5085 | 9520 | 765 | LYM949 | 84.6 | globlastp |
| maize|10v1|AI901636_P1 | 5086 | 9521 | 765 | LYM949 | 83.3 | globlastp |
| millet|10v1|EVO454PM185176_P1 | 5087 | 9522 | 765 | LYM949 | 80.4 | globlastp |
| maize|10v1|AW179447_P1 | 5088 | 9523 | 766 | LYM950 | 85.8 | globlastp |
| maize|10v1|AI947692_P1 | 5089 | 9524 | 766 | LYM950 | 84.9 | globlastp |
| foxtail_millet|11v3|EC613793_P1 | 5090 | 9525 | 766 | LYM950 | 84.2 | globlastp |
| switchgrass|gb167|FE613925 | 5091 | 9526 | 766 | LYM950 | 82.6 | globlastp |
| foxtail_millet|11v3|PHY7SI013184M_P1 | 5092 | 9527 | 767 | LYM951 | 88.7 | globlastp |
| maize|10v1|BM500230_P1 | 5093 | 9528 | 767 | LYM951 | 86 | globlastp |
| sugarcane|10v1|BQ534164 | 5094 | 9529 | 768 | LYM952 | 97 | globlastp |
| maize|10v1|BE025267_P1 | 5095 | 9530 | 768 | LYM952 | 93.4 | globlastp |
| cenchrus|gb166|BM083995_P1 | 5096 | 9531 | 768 | LYM952 | 93.1 | globlastp |
| foxtail_millet|11v3|PHY7SI014081M_P1 | 5097 | 9532 | 768 | LYM952 | 93.1 | globlastp |
| millet|10v1|CD724576_P1 | 5098 | 9533 | 768 | LYM952 | 91.3 | globlastp |
| switchgrass|gb167|DN141276 | 5099 | 9534 | 768 | LYM952 | 90.3 | globlastp |
| oat|11v1|GR332759_P1 | 5100 | 9535 | 768 | LYM952 | 87.3 | globlastp |
| rice|11v1|BM421648 | 5101 | 9536 | 768 | LYM952 | 86.3 | globlastp |
| wheat|12v3|BG313063_P1 | 5102 | 9537 | 768 | LYM952 | 86.1 | globlastp |
| rice|11v1|AA754031 | 5103 | 9538 | 768 | LYM952 | 85.97 | glotblastn |
| rye|12v1|DRR001012.127309_P1 | 5104 | 9539 | 768 | LYM952 | 85.9 | globlastp |
| rye|12v1|DRR001012.169744_P1 | 5105 | 9539 | 768 | LYM952 | 85.9 | globlastp |
| rye|12v1|DRR001012.173295_P1 | 5106 | 9539 | 768 | LYM952 | 85.9 | globlastp |
| wheat|12v3|BE444739_P1 | 5107 | 9540 | 768 | LYM952 | 85.9 | globlastp |
| wheat|10v2|BE444739 | 5108 | 9541 | 768 | LYM952 | 85.8 | globlastp |
| brachypodium|12v1|BRADI3G38410_P1 | 5109 | 9542 | 768 | LYM952 | 85.4 | globlastp |
| brachypodium|09v1|DV473558 | 5110 | 9542 | 768 | LYM952 | 85.4 | globlastp |
| barley|10v2|BE060674 | 5111 | 9543 | 768 | LYM952 | 85.2 | globlastp |
| barley|12v1|BE060674_P1 | 5112 | 9543 | 768 | LYM952 | 85.2 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sorghum\|11v1\|SB05G000445 | 5113 | 9544 | 769 | LYM953 | 99.8 | globlastp |
| sorghum\|12v1\|SB05G000445_P1 | 5114 | 9544 | 769 | LYM953 | 99.8 | globlastp |
| maize\|10v1\|BM379489_T1 | 5115 | 9545 | 769 | LYM953 | 99.24 | glotblastn |
| foxtail_millet\|11v3\|EC612115_P1 | 5116 | 9546 | 769 | LYM953 | 99.2 | globlastp |
| foxtail_millet\|11v3\|PHY7SI009166M_P1 | 5117 | 9547 | 769 | LYM953 | 99.2 | globlastp |
| maize\|10v1\|AI667769_P1 | 5118 | 9548 | 769 | LYM953 | 99.1 | globlastp |
| maize\|10v1\|AW313152_P1 | 5119 | 9549 | 769 | LYM953 | 98.9 | globlastp |
| maize\|10v1\|AI943852_P1 | 5120 | 9550 | 769 | LYM953 | 98.8 | globlastp |
| millet\|10v1\|EVO454PM001489_P1 | 5121 | 9551 | 769 | LYM953 | 98.7 | globlastp |
| rice\|11v1\|BI305567 | 5122 | 9552 | 769 | LYM953 | 98 | globlastp |
| rice\|11v1\|AA752551 | 5123 | 9553 | 769 | LYM953 | 97.9 | globlastp |
| brachypodium\|12v1\|BRADI4G44977_P1 | 5124 | 9554 | 769 | LYM953 | 97.1 | globlastp |
| brachypodium\|09v1\|GT777109 | 5125 | 9554 | 769 | LYM953 | 97.1 | globlastp |
| rye\|12v1\|DRR001012.103240_P1 | 5126 | 9555 | 769 | LYM953 | 97 | globlastp |
| brachypodium\|12v1\|BRADI4G26877_P1 | 5127 | 9556 | 769 | LYM953 | 96.7 | globlastp |
| brachypodium\|09v1\|GT844520 | 5128 | 9556 | 769 | LYM953 | 96.7 | globlastp |
| barley\|12v1\|BE412853_P1 | 5129 | 9557 | 769 | LYM953 | 96.5 | globlastp |
| rye\|12v1\|DRR001012.103264_P1 | 5130 | 9558 | 769 | LYM953 | 94.3 | globlastp |
| oil_palm\|11v1\|ES274034_T1 | 5131 | 9559 | 769 | LYM953 | 92.97 | glotblastn |
| banana\|12v1\|FF561821_P1 | 5132 | 9560 | 769 | LYM953 | 92.9 | globlastp |
| cacao\|10v1\|CU472629_P1 | 5133 | 9561 | 769 | LYM953 | 92.8 | globlastp |
| banana\|12v1\|DT723896_P1 | 5134 | 9562 | 769 | LYM953 | 92.5 | globlastp |
| castorbean\|11v1\|EG670803_P1 | 5135 | 9563 | 769 | LYM953 | 92.5 | globlastp |
| clementine\|11v1\|CK665719_P1 | 5136 | 9564 | 769 | LYM953 | 92.5 | globlastp |
| phalaenopsis\|11v1\|CO742220XX1_P1 | 5137 | 9565 | 769 | LYM953 | 92.5 | globlastp |
| gossypium_raimondii\|12v1\|BG441197_P1 | 5138 | 9566 | 769 | LYM953 | 92.4 | globlastp |
| banana\|12v1\|BBS1221T3_P1 | 5139 | 9567 | 769 | LYM953 | 92.3 | globlastp |
| poppy\|11v1\|SRR030259.104134_P1 | 5140 | 9568 | 769 | LYM953 | 92.3 | globlastp |
| aquilegia\|10v2\|JGIAC004178_P1 | 5141 | 9569 | 769 | LYM953 | 92.2 | globlastp |
| gossypium_raimondii\|12v1\|AI055364_P1 | 5142 | 9570 | 769 | LYM953 | 92.2 | globlastp |
| cotton\|11v1\|CO086422_P1 | 5143 | 9571 | 769 | LYM953 | 92.2 | globlastp |
| gossypium_raimondii\|12v1\|BG443262_P1 | 5144 | 9572 | 769 | LYM953 | 92.1 | globlastp |
| eucalyptus\|11v2\|CB967921_P1 | 5145 | 9573 | 769 | LYM953 | 92.1 | globlastp |
| vinca\|11v1\|SRR098690X101307 | 5146 | 9574 | 769 | LYM953 | 92 | globlastp |
| apple\|11v1\|CN917750_P1 | 5147 | 9575 | 769 | LYM953 | 91.9 | globlastp |
| chelidonium\|11v1\|SRR084752X101459_P1 | 5148 | 9576 | 769 | LYM953 | 91.9 | globlastp |
| chestnut\|gb170\|SRR006295S0001765_P1 | 5149 | 9577 | 769 | LYM953 | 91.9 | globlastp |
| cotton\|11v1\|CO111885XX1_P1 | 5150 | 9578 | 769 | LYM953 | 91.9 | globlastp |
| cucumber\|09v1\|DN910682_P1 | 5151 | 9579 | 769 | LYM953 | 91.9 | globlastp |
| eucalyptus\|11v2\|SRR001659X106716_P1 | 5152 | 9580 | 769 | LYM953 | 91.9 | globlastp |
| amsonia\|11v1\|SRR098688X10295_P1 | 5153 | 9581 | 769 | LYM953 | 91.8 | globlastp |
| oak\|10v1\|FP030445_P1 | 5154 | 9582 | 769 | LYM953 | 91.8 | globlastp |
| tabernaemontana\|11v1\|SRR098689X100502 | 5155 | 9583 | 769 | LYM953 | 91.8 | globlastp |
| gossypium_raimondii\|12v1\|DR459382_P1 | 5156 | 9584 | 769 | LYM953 | 91.7 | globlastp |
| poppy\|11v1\|SRR030259.107858_P1 | 5157 | 9585 | 769 | LYM953 | 91.7 | globlastp |
| prunus\|10v1\|AJ631473 | 5158 | 9586 | 769 | LYM953 | 91.7 | globlastp |
| soybean\|11v1\|GLYMA18G02960 | 5159 | 9587 | 769 | LYM953 | 91.7 | globlastp |
| apple\|11v1\|CN895101_P1 | 5160 | 9588 | 769 | LYM953 | 91.6 | globlastp |
| cassava\|09v1\|BM259787_P1 | 5161 | 9589 | 769 | LYM953 | 91.6 | globlastp |
| grape\|11v1\|GSVIVT01032792001_P1 | 5162 | 9590 | 769 | LYM953 | 91.6 | globlastp |
| poplar\|10v1\|BI138963_P1 | 5163 | 9591 | 769 | LYM953 | 91.5 | globlastp |
| pigeonpea\|11v1\|SRR054580X117511_P1 | 5164 | 9592 | 769 | LYM953 | 91.4 | globlastp |
| pigeonpea\|11v1\|SRR054580X143029_P1 | 5165 | 9593 | 769 | LYM953 | 91.4 | globlastp |
| soybean\|11v1\|GLYMA11G35460 | 5166 | 9594 | 769 | LYM953 | 91.4 | globlastp |
| tomato\|11v1\|BG598216 | 5167 | 9595 | 769 | LYM953 | 91.3 | globlastp |
| arnica\|11v1\|SRR099034X103038_T1 | 5168 | 9596 | 769 | LYM953 | 91.23 | glotblastn |
| euphorbia\|11v1\|DV127057_P1 | 5169 | 9597 | 769 | LYM953 | 91.2 | globlastp |
| thellungiella_halophilum\|11v1\|EHJGI11004225 | 5170 | 9598 | 769 | LYM953 | 91.2 | globlastp |
| amborella\|12v3\|FD427882_P1 | 5171 | 9599 | 769 | LYM953 | 91.1 | globlastp |
| bean\|12v1\|CA907764_P1 | 5172 | 9600 | 769 | LYM953 | 91.1 | globlastp |
| flaveria\|11v1\|SRR149229.110521_P1 | 5173 | 9601 | 769 | LYM953 | 91.1 | globlastp |
| solanum_phureja\|09v1\|SPHBG598216 | 5174 | 9602 | 769 | LYM953 | 91.1 | globlastp |
| strawberry\|11v1\|CO382016 | 5175 | 9603 | 769 | LYM953 | 91.1 | globlastp |
| vinca\|11v1\|SRR098690X10291 | 5176 | 9604 | 769 | LYM953 | 91.1 | globlastp |
| arabidopsis_lyrata\|09v1\|JGIAL009541_P1 | 5177 | 9605 | 769 | LYM953 | 91 | globlastp |
| b_rapa\|11v1\|L33634_P1 | 5178 | 9606 | 769 | LYM953 | 91 | globlastp |
| poplar\|10v1\|DT496119_T1 | 5179 | 9607 | 769 | LYM953 | 91 | glotblastn |
| monkeyflower\|10v1\|DV210148_T1 | 5180 | 9608 | 769 | LYM953 | 90.97 | glotblastn |
| thellungiella_halophilum\|11v1\|DN773960 | 5181 | 9609 | 769 | LYM953 | 90.9 | globlastp |
| arabidopsis_lyrata\|09v1\|JGIAL009246_P1 | 5182 | 9610 | 769 | LYM953 | 90.8 | globlastp |
| arabidopsis\|10v1\|AT3G11130_P1 | 5183 | 9611 | 769 | LYM953 | 90.8 | globlastp |
| canola\|11v1\|ES965358_P1 | 5184 | 9612 | 769 | LYM953 | 90.8 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| soybean\|11v1\|GLYMA02G42560 | 5185 | 9613 | 769 | LYM953 | 90.8 | globlastp |
| thellungiella_parvulum\|11v1\|DN773960 | 5186 | 9614 | 769 | LYM953 | 90.8 | globlastp |
| valeriana\|11v1\|SRR099039X104712 | 5187 | 9615 | 769 | LYM953 | 90.8 | globlastp |
| lotus\|09v1\|BE122527_P1 | 5188 | 9616 | 769 | LYM953 | 90.7 | globlastp |
| silene\|11v1\|SRR096785X103009 | 5189 | 9617 | 769 | LYM953 | 90.7 | globlastp |
| chickpea\|11v1\|SRR133517.104842_T1 | 5190 | 9618 | 769 | LYM953 | 90.66 | glotblastn |
| bean\|12v1\|CA916274_P1 | 5191 | 9619 | 769 | LYM953 | 90.5 | globlastp |
| medicago\|12v1\|AW689178_P1 | 5192 | 9620 | 769 | LYM953 | 90.5 | globlastp |
| arabidopsis\|10v1\|AT3G08530_P1 | 5193 | 9621 | 769 | LYM953 | 90.5 | globlastp |
| b_rapa\|11v1\|CD826828_P1 | 5194 | 9622 | 769 | LYM953 | 90.5 | globlastp |
| plantago\|11v2\|SRR066373X13143_P1 | 5195 | 9623 | 769 | LYM953 | 90.5 | globlastp |
| soybean\|11v1\|GLYMA14G06340 | 5196 | 9624 | 769 | LYM953 | 90.5 | globlastp |
| pigeonpea\|11v1\|SRR054580X155491_P1 | 5197 | 9625 | 769 | LYM953 | 90.4 | globlastp |
| solanum_phureja\|09v1\|SPHBT014065 | 5198 | 9626 | 769 | LYM953 | 90.3 | globlastp |
| tomato\|11v1\|BG127598 | 5199 | 9627 | 769 | LYM953 | 90.3 | globlastp |
| medicago\|12v1\|AW777086_P1 | 5200 | 9628 | 769 | LYM953 | 90.2 | globlastp |
| soybean\|11v1\|GLYMA01G38580 | 5201 | 9629 | 769 | LYM953 | 90.2 | globlastp |
| prunus\|10v1\|CN495881 | 5202 | 9630 | 769 | LYM953 | 90.1 | globlastp |
| zostera\|10v1\|SRR057351S0002540 | 5203 | 9631 | 769 | LYM953 | 90.03 | glotblastn |
| b_rapa\|11v1\|CN732011_T1 | 5204 | 9632 | 769 | LYM953 | 90.01 | glotblastn |
| bean\|12v1\|SRR001334.145616_P1 | 5205 | 9633 | 769 | LYM953 | 90 | globlastp |
| abies\|11v2\|SRR098676X102605_P1 | 5206 | 9634 | 769 | LYM953 | 90 | globlastp |
| pseudotsuga\|10v1\|SRR065119S0002277 | 5207 | 9635 | 769 | LYM953 | 90 | globlastp |
| soybean\|11v1\|GLYMA11G06720 | 5208 | 9636 | 769 | LYM953 | 90 | globlastp |
| tomato\|11v1\|AI896769 | 5209 | 9637 | 769 | LYM953 | 90 | globlastp |
| b_rapa\|11v1\|BG732260_P1 | 5210 | 9638 | 769 | LYM953 | 89.9 | globlastp |
| distylium\|11v1\|SRR065077X103143_P1 | 5211 | 9639 | 769 | LYM953 | 89.9 | globlastp |
| pine\|10v2\|AI813072_P1 | 5212 | 9640 | 769 | LYM953 | 89.9 | globlastp |
| strawberry\|11v1\|EX661931 | 5213 | 9641 | 769 | LYM953 | 89.9 | globlastp |
| apple\|11v1\|CN495881_P1 | 5214 | 9642 | 769 | LYM953 | 89.8 | globlastp |
| poplar\|10v1\|BI127485_P1 | 5215 | 9643 | 769 | LYM953 | 89.8 | globlastp |
| thellungiella_parvulum\|11v1\|EPCRP011735 | 5216 | 9644 | 769 | LYM953 | 89.8 | globlastp |
| thellungiella_halophilum\|11v1\|EHJGI11010944 | 5217 | 9645 | 769 | LYM953 | 89.7 | globlastp |
| soybean\|11v1\|GLYMA02G39360 | 5218 | 9646 | 769 | LYM953 | 89.5 | globlastp |
| podocarpus\|10v1\|SRR065014S0001020_T1 | 5219 | 9647 | 769 | LYM953 | 89.43 | glotblastn |
| taxus\|10v1\|SRR032523S0008688 | 5220 | 9648 | 769 | LYM953 | 89.42 | glotblastn |
| poplar\|10v1\|BI121214_P1 | 5221 | 9649 | 769 | LYM953 | 89.3 | globlastp |
| zostera\|10v1\|SRR057351S0002915 | 5222 | 9650 | 769 | LYM953 | 89.2 | globlastp |
| valeriana\|11v1\|SRR099039X104791 | 5223 | 9651 | 769 | LYM953 | 88.85 | glotblastn |
| pigeonpea\|11v1\|SRR054580X104803_P1 | 5224 | 9652 | 769 | LYM953 | 88.8 | globlastp |
| wheat\|12v3\|BF485255_P1 | 5225 | 9653 | 769 | LYM953 | 88.8 | globlastp |
| chelidonium\|11v1\|SRR084752X101295_T1 | 5226 | 9654 | 769 | LYM953 | 88.44 | glotblastn |
| banana\|12v1\|ES431704_P1 | 5227 | 9655 | 769 | LYM953 | 87.6 | globlastp |
| soybean\|11v1\|GLYMA14G37510 | 5228 | 9656 | 769 | LYM953 | 87.4 | globlastp |
| poppy\|11v1\|SRR030259.351712_T1 | 5229 | 9657 | 769 | LYM953 | 87.25 | glotblastn |
| banana\|12v1\|MAGEN2012029581_P1 | 5230 | 9658 | 769 | LYM953 | 87 | globlastp |
| lotus\|09v1\|BE122578_P1 | 5231 | 9659 | 769 | LYM953 | 86.1 | globlastp |
| catharanthus\|11v1\|SRR098691X103934_T1 | 5232 | 9660 | 769 | LYM953 | 85.85 | glotblastn |
| cotton\|11v1\|BG441197_T1 | 5233 | 9661 | 769 | LYM953 | 85.54 | glotblastn |
| sequoia\|10v1\|SRR065044S0001049 | 5234 | 9662 | 769 | LYM953 | 85.5 | glotblastn |
| beech\|11v1\|SRR006293.15272_T1 | 5235 | 9663 | 769 | LYM953 | 85.44 | glotblastn |
| grape\|11v1\|GSVIVT01024708001_P1 | 5236 | 9664 | 769 | LYM953 | 85.2 | globlastp |
| banana\|12v1\|FF561249_P1 | 5237 | 9665 | 769 | LYM953 | 85 | globlastp |
| ceratodon\|10v1\|SRR074890S0043891_P1 | 5238 | 9666 | 769 | LYM953 | 84.7 | globlastp |
| physcomitrella\|10v1\|BJ181764_P1 | 5239 | 9667 | 769 | LYM953 | 84.3 | globlastp |
| physcomitrella\|10v1\|Z98113_P1 | 5240 | 9668 | 769 | LYM953 | 84 | globlastp |
| ceratodon\|10v1\|SRR074890S0008940_P1 | 5241 | 9669 | 769 | LYM953 | 83.9 | globlastp |
| arnica\|11v1\|SRR099034X100081_P1 | 5242 | 9670 | 769 | LYM953 | 83.8 | globlastp |
| ceratodon\|10v1\|SRR074890S0003179_P1 | 5243 | 9671 | 769 | LYM953 | 83.7 | globlastp |
| canola\|11v1\|DY010475_P1 | 5244 | 9672 | 769 | LYM953 | 83.6 | globlastp |
| cacao\|10v1\|CF973198_P1 | 5245 | 9673 | 769 | LYM953 | 83.5 | globlastp |
| wheat\|12v3\|BE406924_P1 | 5246 | 9674 | 769 | LYM953 | 83.1 | globlastp |
| physcomitrella\|10v1\|FC327333_P1 | 5247 | 9675 | 769 | LYM953 | 83.1 | globlastp |
| orange\|11v1\|CK665719_P1 | 5248 | 9676 | 769 | LYM953 | 82.9 | globlastp |
| b_rapa\|11v1\|SRR001112.36730_T1 | 5249 | 9677 | 769 | LYM953 | 82.88 | glotblastn |
| poppy\|11v1\|SRR030259.10942_T1 | 5250 | 9678 | 769 | LYM953 | 82.78 | glotblastn |
| vinca\|11v1\|SRR098690X104121 | 5251 | 9679 | 769 | LYM953 | 82.6 | globlastp |
| canola\|11v1\|CN732011_P1 | 5252 | 9680 | 769 | LYM953 | 82.4 | globlastp |
| cassava\|09v1\|DV441133_P1 | 5253 | 9681 | 769 | LYM953 | 82.3 | globlastp |
| oat\|11v1\|GR343586_T1 | 5254 | 9682 | 769 | LYM953 | 82.28 | glotblastn |
| wheat\|10v2\|BE400150 | 5255 | 9683 | 769 | LYM953 | 81.8 | globlastp |
| wheat\|12v3\|BE400570_P1 | 5256 | 9684 | 769 | LYM953 | 81.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| rye\|12v1\|DRR001012.149898_P1 | 5257 | 9685 | 769 | LYM953 | 81.4 | globlastp |
| maize\|10v1\|AI967016_P1 | 5258 | 9686 | 770 | LYM954 | 95.8 | globlastp |
| foxtail_millet\|11v3\|PHY7SI012394M_P1 | 5259 | 9687 | 770 | LYM954 | 94 | globlastp |
| switchgrass\|gb167\|FE606212 | 5260 | 9688 | 770 | LYM954 | 92.2 | globlastp |
| cenchrus\|gb166\|EB657937_P1 | 5261 | 9689 | 770 | LYM954 | 90.6 | globlastp |
| rice\|11v1\|CB681606 | 5262 | 9690 | 770 | LYM954 | 88.5 | globlastp |
| rice\|11v1\|AU065815 | 5263 | 9691 | 770 | LYM954 | 87.5 | globlastp |
| cynodon\|10v1\|ES298485_T1 | 5264 | 9692 | 770 | LYM954 | 86.23 | glotblastn |
| barley\|10v2\|AV924027 | 5265 | 9693 | 770 | LYM954 | 86 | globlastp |
| pseudoroegneria\|gb167\|FF340749 | 5266 | 9694 | 770 | LYM954 | 86 | globlastp |
| rye\|12v1\|DRR001012.101576_P1 | 5267 | 9695 | 770 | LYM954 | 85.7 | globlastp |
| barley\|12v1\|BF625620_P1 | 5268 | 9696 | 770 | LYM954 | 85.7 | globlastp |
| wheat\|12v3\|BE606223_P1 | 5269 | 9697 | 770 | LYM954 | 85.7 | globlastp |
| wheat\|10v2\|BE606223 | 5270 | 9698 | 770 | LYM954 | 85.5 | globlastp |
| brachypodium\|12v1\|BRADI4G43920_P1 | 5271 | 9699 | 770 | LYM954 | 84 | globlastp |
| brachypodium\|09v1\|GT786104 | 5272 | 9699 | 770 | LYM954 | 84 | globlastp |
| millet\|10v1\|EVO454PM008536_P1 | 5273 | 9700 | 770 | LYM954 | 83.9 | globlastp |
| rye\|12v1\|DRR001012.237979_T1 | 5274 | 9701 | 770 | LYM954 | 83.29 | glotblastn |
| maize\|10v1\|CB411025_P1 | 5275 | 9702 | 771 | LYM955 | 82.6 | globlastp |
| sugarcane\|10v1\|CA189486 | 5276 | 9703 | 774 | LYM958 | 93.3 | globlastp |
| foxtail_millet\|11v3\|PHY7SI023822M_P1 | 5277 | 9704 | 774 | LYM958 | 88.8 | globlastp |
| switchgrass\|gb167\|DN146531 | 5278 | 9705 | 774 | LYM958 | 87.6 | globlastp |
| switchgrass\|gb167\|FL734314 | 5279 | 9706 | 774 | LYM958 | 83 | globlastp |
| maize\|10v1\|CF625331_P1 | 5280 | 9707 | 774 | LYM958 | 81.9 | globlastp |
| foxtail_millet\|11v3\|EC611928_P1 | 5281 | 9708 | 775 | LYM959 | 95 | globlastp |
| maize\|10v1\|AI001333_P1 | 5282 | 9709 | 775 | LYM959 | 94 | globlastp |
| switchgrass\|gb167\|DN147729 | 5283 | 9710 | 775 | LYM959 | 93.2 | globlastp |
| maize\|10v1\|AW498229_P1 | 5284 | 9711 | 775 | LYM959 | 92.8 | globlastp |
| rice\|11v1\|AA754564 | 5285 | 9712 | 775 | LYM959 | 88.7 | globlastp |
| leymus\|gb166\|CD808541_P1 | 5286 | 9713 | 775 | LYM959 | 86.9 | globlastp |
| wheat\|12v3\|BE419045_P1 | 5287 | 9714 | 775 | LYM959 | 86.4 | globlastp |
| leymus\|gb166\|EG385130_P1 | 5288 | 9715 | 775 | LYM959 | 86.4 | globlastp |
| wheat\|10v2\|BF199807 | 5289 | 9716 | 775 | LYM959 | 86 | globlastp |
| brachypodium\|12v1\|BRADI2G21120_P1 | 5290 | 9717 | 775 | LYM959 | 85.9 | globlastp |
| brachypodium\|09v1\|DV473308 | 5291 | 9717 | 775 | LYM959 | 85.9 | globlastp |
| oat\|11v1\|GR313481_P1 | 5292 | 9718 | 775 | LYM959 | 85.7 | globlastp |
| wheat\|12v3\|BF485197_T1 | 5293 | 9719 | 775 | LYM959 | 85.63 | glotblastn |
| barley\|10v2\|BE420692 | 5294 | 9720 | 775 | LYM959 | 84.8 | globlastp |
| wheat\|12v3\|BG263576_P1 | 5295 | 9721 | 775 | LYM959 | 84.4 | globlastp |
| wheat\|12v3\|CJ664413_P1 | 5296 | 9722 | 775 | LYM959 | 84.2 | globlastp |
| millet\|10v1\|CD726756_P1 | 5297 | 9723 | 775 | LYM959 | 84.1 | globlastp |
| wheat\|12v3\|BE417941_P1 | 5298 | 9724 | 775 | LYM959 | 83.4 | globlastp |
| pseudoroegneria\|gb167\|FF341726 | 5299 | 9725 | 775 | LYM959 | 83.4 | globlastp |
| sugarcane\|10v1\|BU925808 | 5300 | 9726 | 775 | LYM959 | 83 | globlastp |
| switchgrass\|gb167\|FE605518 | 5301 | 9727 | 775 | LYM959 | 82.4 | glotblastn |
| rice\|11v1\|BE607477 | 5302 | 9728 | 775 | LYM959 | 81.94 | glotblastn |
| foxtail_millet\|11v3\|PHY7SI001253M_P1 | 5303 | 9729 | 775 | LYM959 | 81.8 | globlastp |
| castorbean\|11v1\|EG657779_P1 | 5304 | 9730 | 775 | LYM959 | 81.6 | globlastp |
| cleome_gynandra\|10v1\|SRR015532S0000116_P1 | 5305 | 9731 | 775 | LYM959 | 81.5 | globlastp |
| fescue\|gb161\|CK803102_P1 | 5306 | 9732 | 775 | LYM959 | 81.2 | globlastp |
| orange\|11v1\|BQ623969_P1 | 5307 | 9733 | 775 | LYM959 | 81.2 | globlastp |
| poplar\|10v1\|AI164148_P1 | 5308 | 9734 | 775 | LYM959 | 81.2 | globlastp |
| eucalyptus\|11v2\|CD667999_P1 | 5309 | 9735 | 775 | LYM959 | 81.1 | globlastp |
| citrus\|gb166\|BQ623969 | 5310 | 9736 | 775 | LYM959 | 81 | globlastp |
| clementine\|11v1\|BQ623969_P1 | 5311 | 9736 | 775 | LYM959 | 81 | globlastp |
| grape\|11v1\|GSVIVT01036773001_P1 | 5312 | 9737 | 775 | LYM959 | 81 | globlastp |
| soybean\|11v1\|GLYMA15G41540 | 5313 | 9738 | 775 | LYM959 | 81 | globlastp |
| catharanthus\|11v1\|EG554396_P1 | 5314 | 9739 | 775 | LYM959 | 80.9 | globlastp |
| bean\|12v1\|CA900667_P1 | 5315 | 9740 | 775 | LYM959 | 80.8 | globlastp |
| bean\|gb167\|BQ481898 | 5316 | 9740 | 775 | LYM959 | 80.8 | globlastp |
| poplar\|10v1\|BI069822_P1 | 5317 | 9741 | 775 | LYM959 | 80.8 | globlastp |
| banana\|12v1\|DN238521_P1 | 5318 | 9742 | 775 | LYM959 | 80.7 | globlastp |
| banana\|12v1\|MAGEN2012032855_P1 | 5319 | 9743 | 775 | LYM959 | 80.7 | globlastp |
| nicotiana_benthamiana\|gb162\|CN655254_P1 | 5320 | 9744 | 775 | LYM959 | 80.7 | globlastp |
| oil_palm\|11v1\|ES323683_P1 | 5321 | 9745 | 775 | LYM959 | 80.7 | globlastp |
| tobacco\|gb162\|CV016622 | 5322 | 9746 | 775 | LYM959 | 80.7 | globlastp |
| cassava\|09v1\|BM260261_P1 | 5323 | 9747 | 775 | LYM959 | 80.6 | globlastp |
| cassava\|09v1\|DR087960_P1 | 5324 | 9748 | 775 | LYM959 | 80.6 | globlastp |
| euphorbia\|11v1\|DV123968_P1 | 5325 | 9749 | 775 | LYM959 | 80.5 | globlastp |
| soybean\|11v1\|GLYMA08G17610 | 5326 | 9750 | 775 | LYM959 | 80.5 | globlastp |
| tabernaemontana\|11v1\|SRR098689X10001 | 5327 | 9751 | 775 | LYM959 | 80.5 | globlastp |
| gossypium_raimondii\|12v1\|BF272214_P1 | 5328 | 9752 | 775 | LYM959 | 80.4 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| clover\|gb162\|BB902799_P1 | 5329 | 9753 | 775 | LYM959 | 80.4 | globlastp |
| cotton\|11v1\|DN779646_P1 | 5330 | 9754 | 775 | LYM959 | 80.4 | globlastp |
| vinca\|11v1\|SRR098690X100553 | 5331 | 9755 | 775 | LYM959 | 80.4 | globlastp |
| nicotiana_benthamiana\|gb162\|CN741627_P1 | 5332 | 9756 | 775 | LYM959 | 80.3 | globlastp |
| banana\|10v1\|GFXAC186756X47 | 5333 | 9757 | 775 | LYM959 | 80.29 | glotblastn |
| medicago\|12v1\|AW698722_P1 | 5334 | 9758 | 775 | LYM959 | 80.2 | globlastp |
| cotton\|11v1\|CO069934_P1 | 5335 | 9759 | 775 | LYM959 | 80.2 | globlastp |
| pigeonpea\|11v1\|DY742679_P1 | 5336 | 9760 | 775 | LYM959 | 80.2 | globlastp |
| chickpea\|11v1\|ES560240_P1 | 5337 | 9761 | 775 | LYM959 | 80.1 | globlastp |
| trigonella\|11v1\|SRR066194X188930 | 5338 | 9762 | 775 | LYM959 | 80.1 | globlastp |
| cucurbita\|11v1\|SRR091276X103538_T1 | 5339 | 9763 | 775 | LYM959 | 80.04 | glotblastn |
| apple\|11v1\|BI203090_P1 | 5340 | 9764 | 775 | LYM959 | 80 | globlastp |
| apple\|11v1\|CN862235_P1 | 5341 | 9765 | 775 | LYM959 | 80 | globlastp |
| arabidopsis_lyrata\|09v1\|JGIAL005107_P1 | 5342 | 9766 | 775 | LYM959 | 80 | globlastp |
| aristolochia\|10v1\|SRR039082S0032578_P1 | 5343 | 9767 | 775 | LYM959 | 80 | globlastp |
| cotton\|11v1\|BF272214XX1_P1 | 5344 | 9768 | 775 | LYM959 | 80 | globlastp |
| ginger\|gb164\|DY348518_T1 | 5345 | 9769 | 775 | LYM959 | 80 | glotblastn |
| tripterygium\|11v1\|SRR098677X101453 | 5346 | 9770 | 775 | LYM959 | 80 | globlastp |
| maize\|10v1\|T23377_P1 | 5347 | 9771 | 776 | LYM960 | 96.1 | globlastp |
| foxtail_millet\|11v3\|PHY7SI022280M_P1 | 5348 | 9772 | 776 | LYM960 | 94.1 | globlastp |
| rice\|11v1\|BU099185 | 5349 | 9773 | 776 | LYM960 | 90.7 | globlastp |
| brachypodium\|12v1\|BRADI2G15560_P1 | 5350 | 9774 | 776 | LYM960 | 87.3 | globlastp |
| brachypodium\|09v1\|SRR031795S0050999 | 5351 | 9774 | 776 | LYM960 | 87.3 | globlastp |
| sorghum\|11v1\|SB03G029240 | 5352 | 9775 | 776 | LYM960 | 85.7 | globlastp |
| sorghum\|12v1\|SB03G029240_P1 | 5353 | 9775 | 776 | LYM960 | 85.7 | globlastp |
| switchgrass\|gb167\|FE648644 | 5354 | 9776 | 776 | LYM960 | 84.94 | glotblastn |
| gossypium_raimondii\|12v1\|BE053492_P1 | 5355 | 9777 | 776 | LYM960 | 84.6 | globlastp |
| foxtail_millet\|11v3\|PHY7SI001833M_P1 | 5356 | 9778 | 776 | LYM960 | 84.6 | globlastp |
| cotton\|11v1\|BE053492_P1 | 5357 | 9779 | 776 | LYM960 | 84.5 | globlastp |
| cotton\|11v1\|CO113573_P1 | 5358 | 9780 | 776 | LYM960 | 84.5 | globlastp |
| cacao\|10v1\|CA797668_P1 | 5359 | 9781 | 776 | LYM960 | 84.3 | globlastp |
| maize\|10v1\|AW288964_P1 | 5360 | 9782 | 776 | LYM960 | 84.1 | globlastp |
| maize\|10v1\|CX724842_P1 | 5361 | 9783 | 776 | LYM960 | 84.1 | globlastp |
| gossypium_raimondii\|12v1\|DT468226_P1 | 5362 | 9784 | 776 | LYM960 | 83.9 | globlastp |
| rye\|12v1\|DRR001012.321631_T1 | 5363 | 9785 | 776 | LYM960 | 83.9 | glotblastn |
| cotton\|11v1\|DT468227_P1 | 5364 | 9786 | 776 | LYM960 | 83.9 | globlastp |
| cassava\|09v1\|FF535436_P1 | 5365 | 9787 | 776 | LYM960 | 83.6 | globlastp |
| oil_palm\|11v1\|SRR190698.166028_P1 | 5366 | 9788 | 776 | LYM960 | 83.4 | globlastp |
| pigeonpea\|11v1\|SRR054580X113447_P1 | 5367 | 9789 | 776 | LYM960 | 83.4 | globlastp |
| aristolochia\|10v1\|FD748188_P1 | 5368 | 9790 | 776 | LYM960 | 83.1 | globlastp |
| cotton\|11v1\|CO122625_P1 | 5369 | 9791 | 776 | LYM960 | 83.1 | globlastp |
| oak\|10v1\|FP033515_P1 | 5370 | 9792 | 776 | LYM960 | 83.1 | globlastp |
| brachypodium\|12v1\|BRADI2G44910_P1 | 5371 | 9793 | 776 | LYM960 | 82.9 | globlastp |
| rye\|12v1\|DRR001012.402464_P1 | 5372 | 9794 | 776 | LYM960 | 82.9 | globlastp |
| brachypodium\|09v1\|GT856261 | 5373 | 9793 | 776 | LYM960 | 82.9 | globlastp |
| bean\|12v1\|SRR001334.109612_P1 | 5374 | 9795 | 776 | LYM960 | 82.8 | globlastp |
| rye\|12v1\|DRR001012.110544_P1 | 5375 | 9796 | 776 | LYM960 | 82.8 | globlastp |
| grape\|11v1\|GSVIVT01032487001_P1 | 5376 | 9797 | 776 | LYM960 | 82.6 | globlastp |
| peanut\|10v1\|ES723286_P1 | 5377 | 9798 | 776 | LYM960 | 82.6 | globlastp |
| soybean\|11v1\|GLYMA13G23840 | 5378 | 9799 | 776 | LYM960 | 82.6 | globlastp |
| soybean\|11v1\|GLYMA19G01250 | 5379 | 9800 | 776 | LYM960 | 82.6 | globlastp |
| euonymus\|11v1\|SRR070038X106763_P1 | 5380 | 9801 | 776 | LYM960 | 82.4 | globlastp |
| rice\|11v1\|CB212859 | 5381 | 9802 | 776 | LYM960 | 82.4 | globlastp |
| melon\|10v1\|VMEL01086604090176_T1 | 5382 | 9803 | 776 | LYM960 | 82.34 | glotblastn |
| aquilegia\|10v2\|DT727231_P1 | 5383 | 9804 | 776 | LYM960 | 82.3 | globlastp |
| aquilegia\|10v1\|DT727231 | 5384 | 9804 | 776 | LYM960 | 82.3 | globlastp |
| watermelon\|11v1\|CO995913 | 5385 | 9805 | 776 | LYM960 | 82.2 | globlastp |
| cassava\|09v1\|JGICASSAVA42072VALIDM1_P1 | 5386 | 9806 | 776 | LYM960 | 82.1 | globlastp |
| cucumber\|09v1\|BGI454H0173857_P1 | 5387 | 9807 | 776 | LYM960 | 82.1 | globlastp |
| watermelon\|11v1\|VMEL01086604090176 | 5388 | 9808 | 776 | LYM960 | 82.1 | globlastp |
| castorbean\|11v1\|EV520282_P1 | 5389 | 9809 | 776 | LYM960 | 82 | globlastp |
| aquilegia\|10v2\|DR934496_P1 | 5390 | 9810 | 776 | LYM960 | 81.8 | globlastp |
| euonymus\|11v1\|SRR070038X219758_P1 | 5391 | 9811 | 776 | LYM960 | 81.8 | globlastp |
| eschscholzia\|11v1\|CD477183_T1 | 5392 | 9812 | 776 | LYM960 | 81.79 | glotblastn |
| cucumber\|09v1\|CO995913_P1 | 5393 | 9813 | 776 | LYM960 | 81.7 | globlastp |
| barley\|12v1\|CA008336_P1 | 5394 | 9814 | 776 | LYM960 | 81.5 | globlastp |
| rye\|12v1\|DRR001012.200157_T1 | 5395 | 9815 | 776 | LYM960 | 81.4 | glotblastn |
| eucalyptus\|11v2\|SRR001659X187599_P1 | 5396 | 9816 | 776 | LYM960 | 81.4 | globlastp |
| amborella\|12v3\|SRR038634.10437_P1 | 5397 | 9817 | 776 | LYM960 | 81.3 | globlastp |
| cassava\|09v1\|JGICASSAVA22967VALIDM1_P1 | 5398 | 9818 | 776 | LYM960 | 81.3 | globlastp |
| blueberry\|12v1\|SRR353283X19735D1_P1 | 5399 | 9819 | 776 | LYM960 | 81.1 | globlastp |
| apple\|11v1\|MDP0000231545_P1 | 5400 | 9820 | 776 | LYM960 | 81.1 | globlastp |

TABLE 2-continued

Homologues of the identified genes/polypeptides for increasing yield, seed yield, oil yield, oil
content, fiber yield, fiber quality, growth rate, vigor, biomass, growth rate, abiotic stress tolerance,
nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| millet\|10v1\|EVO454PM010700_P1 | 5401 | 9821 | 776 | LYM960 | 81 | globlastp |
| poplar\|10v1\|DT475152_P1 | 5402 | 9822 | 776 | LYM960 | 81 | globlastp |
| prunus\|10v1\|BU574557 | 5403 | 9823 | 776 | LYM960 | 81 | globlastp |
| cassava\|09v1\|CK645088_P1 | 5404 | 9824 | 776 | LYM960 | 80.9 | globlastp |
| poplar\|10v1\|DT479267_P1 | 5405 | 9825 | 776 | LYM960 | 80.8 | globlastp |
| strawberry\|11v1\|EX657664 | 5406 | 9826 | 776 | LYM960 | 80.8 | globlastp |
| chickpea\|11v1\|GR405088_P1 | 5407 | 9827 | 776 | LYM960 | 80.7 | globlastp |
| phalaenopsis\|11v1\|CB032408_P1 | 5408 | 9828 | 776 | LYM960 | 80.7 | globlastp |
| monkeyflower\|10v1\|GR064613_P1 | 5409 | 9829 | 776 | LYM960 | 80.5 | globlastp |
| ambrosia\|11v1\|SRR346935.103251_P1 | 5410 | 9830 | 776 | LYM960 | 80.4 | globlastp |
| grape\|11v1\|GSVIVT01007775001_P1 | 5411 | 9831 | 776 | LYM960 | 80.4 | globlastp |
| arnica\|11v1\|SRR099034X114858_P1 | 5412 | 9832 | 776 | LYM960 | 80.3 | globlastp |
| ambrosia\|11v1\|SRR346935.128698_T1 | 5413 | 9833 | 776 | LYM960 | 80.21 | glotblastn |
| triphysaria\|10v1\|EY163087 | 5414 | 9834 | 776 | LYM960 | 80.1 | globlastp |
| lettuce\|12v1\|DW068304_P1 | 5415 | 9835 | 776 | LYM960 | 80 | globlastp |
| cichorium\|gb171\|EH679955_T1 | 5416 | 9836 | 776 | LYM960 | 80 | glotblastn |
| poppy\|11v1\|SRR030259.111921XX1_P1 | 5417 | 9837 | 776 | LYM960 | 80 | globlastp |
| maize\|10v1\|AI438578_P1 | 5418 | 9838 | 777 | LYM961 | 89.6 | globlastp |
| foxtail_millet\|11v3\|PHY7SI006704M_P1 | 5419 | 9839 | 777 | LYM961 | 82.4 | globlastp |
| wheat\|10v2\|CA485101 | 5420 | 778 | 778 | LYM962 | 100 | globlastp |
| wheat\|12v3\|CA485101_P1 | 5421 | 778 | 778 | LYM962 | 100 | globlastp |
| sugarcane\|10v1\|CA141024 | 5422 | 9840 | 779 | LYM963 | 94.3 | globlastp |
| maize\|10v1\|W49899_P1 | 5423 | 9841 | 779 | LYM963 | 91.4 | globlastp |
| millet\|10v1\|EVO454PM303732_P1 | 5424 | 9842 | 779 | LYM963 | 87.8 | globlastp |
| foxtail_millet\|11v3\|SOLX00017749_P1 | 5425 | 9843 | 779 | LYM963 | 86.3 | globlastp |
| maize\|10v1\|CD947115_P1 | 5426 | 9844 | 781 | LYM965 | 94.3 | globlastp |
| foxtail_millet\|11v3\|PHY7SI006784M_P1 | 5427 | 9845 | 781 | LYM965 | 92.3 | globlastp |
| switchgrass\|gb167\|FL704501 | 5428 | 9846 | 781 | LYM965 | 89.8 | globlastp |
| millet\|10v1\|EVO454PM166860_P1 | 5429 | 9847 | 781 | LYM965 | 85.1 | globlastp |
| rice\|11v1\|CB212515 | 5430 | 9848 | 781 | LYM965 | 81 | globlastp |
| brachypodium\|12v1\|BRADI1G37510_T1 | 5431 | 9849 | 781 | LYM965 | 80.57 | glotblastn |
| brachypodium\|09v1\|DV468962 | 5432 | 9849 | 781 | LYM965 | 80.57 | glotblastn |
| rye\|12v1\|DRR001012.125724_P1 | 5433 | 9850 | 781 | LYM965 | 80.2 | globlastp |
| wheat\|10v2\|CN008515 | 5434 | 9851 | 781 | LYM965 | 80.2 | globlastp |
| maize\|10v1\|AI902155_P1 | 5435 | 9852 | 782 | LYM966 | 95.3 | globlastp |
| foxtail_millet\|11v3\|PHY7SI006682M_P1 | 5436 | 9853 | 782 | LYM966 | 93.7 | globlastp |
| brachypodium\|12v1\|BRADI1G37070_P1 | 5437 | 9854 | 782 | LYM966 | 89.5 | globlastp |
| brachypodium\|09v1\|DV470279 | 5438 | 9854 | 782 | LYM966 | 89.5 | globlastp |
| rye\|12v1\|DRR001012.107209XX1_P1 | 5439 | 9855 | 782 | LYM966 | 88.7 | globlastp |
| rice\|11v1\|AA749668 | 5440 | 9856 | 782 | LYM966 | 88.7 | globlastp |
| switchgrass\|gb167\|DN147172 | 5441 | 9857 | 782 | LYM966 | 88.7 | globlastp |
| leymus\|gb166\|EG376941_P1 | 5442 | 9858 | 782 | LYM966 | 88.4 | globlastp |
| wheat\|10v2\|BE517301 | 5443 | 9859 | 782 | LYM966 | 88.4 | globlastp |
| wheat\|12v3\|BE517301_P1 | 5444 | 9859 | 782 | LYM966 | 88.4 | globlastp |
| barley\|10v2\|BI948774 | 5445 | 9860 | 782 | LYM966 | 88.1 | globlastp |
| barley\|12v1\|BI948774_P1 | 5446 | 9860 | 782 | LYM966 | 88.1 | globlastp |
| oat\|11v1\|GR323753_P1 | 5447 | 9861 | 782 | LYM966 | 88.1 | globlastp |
| brachypodium\|12v1\|BRADI1G20380_P1 | 5448 | 9862 | 782 | LYM966 | 87.6 | globlastp |
| brachypodium\|09v1\|SRR031797S0057074 | 5449 | 9862 | 782 | LYM966 | 87.6 | globlastp |
| wheat\|10v2\|CA497718 | 5450 | 9863 | 782 | LYM966 | 87.6 | globlastp |
| millet\|10v1\|EVO454PM018879_P1 | 5451 | 9864 | 782 | LYM966 | 87.3 | globlastp |
| pseudoroegneria\|gb167\|FF347086 | 5452 | 9865 | 782 | LYM966 | 87.3 | globlastp |
| sugarcane\|10v1\|CA074116 | 5453 | 9866 | 782 | LYM966 | 84 | globlastp |
| maize\|10v1\|BG321020_P1 | 5454 | 9867 | 783 | LYM967 | 95.5 | globlastp |
| foxtail_millet\|11v3\|PHY7SI006603M_P1 | 5455 | 9868 | 783 | LYM967 | 95.2 | globlastp |
| switchgrass\|gb167\|DN146368 | 5456 | 9869 | 783 | LYM967 | 92.8 | globlastp |
| rice\|11v1\|AU172754 | 5457 | 9870 | 783 | LYM967 | 88 | globlastp |
| brachypodium\|12v1\|BRADI1G29500_P1 | 5458 | 9871 | 783 | LYM967 | 84.1 | globlastp |
| brachypodium\|09v1\|GT760550 | 5459 | 9871 | 783 | LYM967 | 84.1 | globlastp |
| barley\|10v2\|BE420618XX1 | 5460 | 9872 | 783 | LYM967 | 83.5 | globlastp |
| wheat\|10v2\|BG907532 | 5461 | 9873 | 783 | LYM967 | 83.5 | globlastp |
| leymus\|gb166\|EG376719_P1 | 5462 | 9874 | 783 | LYM967 | 82.8 | globlastp |
| leymus\|gb166\|EG374584_P1 | 5463 | 9875 | 783 | LYM967 | 82.2 | globlastp |
| oat\|11v1\|GR316800_P1 | 5464 | 9876 | 783 | LYM967 | 82.1 | globlastp |
| pseudoroegneria\|gb167\|FF359603 | 5465 | 9877 | 783 | LYM967 | 81.8 | globlastp |
| grape\|11v1\|GSVIVT01012045001_T1 | 5466 | 9878 | 783 | LYM967 | 81.09 | glotblastn |
| cowpea\|12v1\|FG879690_P1 | 5467 | 9879 | 783 | LYM967 | 80.8 | globlastp |
| cowpea\|gb166\|FG879690 | 5468 | 9879 | 783 | LYM967 | 80.8 | globlastp |
| aristolochia\|10v1\|FD763739_P1 | 5469 | 9880 | 783 | LYM967 | 80.7 | globlastp |
| pigeonpea\|11v1\|SRR054580X188638_P1 | 5470 | 9881 | 783 | LYM967 | 80.7 | globlastp |
| gossypium_raimondii\|12v1\|DT568516_T1 | 5471 | 9882 | 783 | LYM967 | 80.64 | glotblastn |
| cotton\|11v1\|DT568516_T1 | 5472 | 9882 | 783 | LYM967 | 80.64 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| wheat\|12v3\|BE591753_P1 | 5473 | 9883 | 783 | LYM967 | 80.5 | globlastp |
| eggplant\|10v1\|FS065871_P1 | 5474 | 9884 | 783 | LYM967 | 80.5 | globlastp |
| peanut\|10v1\|GO260316_T1 | 5475 | 9885 | 783 | LYM967 | 80.48 | glotblastn |
| soybean\|11v1\|GLYMA12G03020 | 5476 | 9886 | 783 | LYM967 | 80 | glotblastn |
| sugarcane\|10v1\|CA158389 | 5477 | 9887 | 784 | LYM972 | 95.9 | globlastp |
| foxtail_millet\|11v3\|PHY7SI030950M_P1 | 5478 | 9888 | 784 | LYM972 | 92.6 | globlastp |
| maize\|10v1\|AI600292_P1 | 5479 | 9889 | 784 | LYM972 | 91.4 | globlastp |
| switchgrass\|gb167\|FE638413 | 5480 | 9890 | 784 | LYM972 | 89.7 | globlastp |
| brachypodium\|12v1\|BRADI4G27050_P1 | 5481 | 9891 | 784 | LYM972 | 80.2 | globlastp |
| brachypodium\|09v1\|DV482972 | 5482 | 9891 | 784 | LYM972 | 80.2 | globlastp |
| wheat\|10v2\|BE496973 | 5483 | 9892 | 784 | LYM972 | 80.2 | globlastp |
| wheat\|12v3\|BE496973_P1 | 5484 | 9893 | 784 | LYM972 | 80.1 | globlastp |
| maize\|10v1\|BI431253_P1 | 5485 | 9894 | 785 | LYM974 | 89 | globlastp |
| maize\|10v1\|DW737322_P1 | 5486 | 9895 | 785 | LYM974 | 88.5 | globlastp |
| foxtail_millet\|11v3\|PHY7SI001646M_P1 | 5487 | 9896 | 785 | LYM974 | 83 | globlastp |
| foxtail_millet\|11v3\|SOLX00021554_P1 | 5488 | 9896 | 785 | LYM974 | 83 | globlastp |
| sugarcane\|10v1\|BQ534445 | 5489 | 9897 | 786 | LYM975 | 90.1 | globlastp |
| sugarcane\|10v1\|CA077883 | 5490 | 9898 | 787 | LYM976 | 99.7 | globlastp |
| foxtail_millet\|11v3\|PHY7SI017993M_P1 | 5491 | 9899 | 787 | LYM976 | 97.6 | globlastp |
| switchgrass\|gb167\|DN144478 | 5492 | 9900 | 787 | LYM976 | 96.2 | globlastp |
| switchgrass\|gb167\|FE639788 | 5493 | 9901 | 787 | LYM976 | 96.2 | globlastp |
| millet\|10v1\|EVO454PM000530_P1 | 5494 | 9902 | 787 | LYM976 | 95.5 | globlastp |
| rice\|11v1\|BI305847 | 5495 | 9903 | 787 | LYM976 | 93.4 | globlastp |
| barley\|10v2\|BF622905 | 5496 | 9904 | 787 | LYM976 | 90.7 | globlastp |
| barley\|12v1\|BF622905_P1 | 5497 | 9904 | 787 | LYM976 | 90.7 | globlastp |
| pseudoroegneria\|gb167\|FF343788 | 5498 | 9905 | 787 | LYM976 | 90.7 | globlastp |
| oat\|11v1\|GR320146_P1 | 5499 | 9906 | 787 | LYM976 | 90.6 | globlastp |
| wheat\|10v2\|BE398701 | 5500 | 9907 | 787 | LYM976 | 90.3 | globlastp |
| wheat\|12v3\|BE398701_P1 | 5501 | 9907 | 787 | LYM976 | 90.3 | globlastp |
| brachypodium\|12v1\|BRADI3G57820T2_P1 | 5502 | 9908 | 787 | LYM976 | 90 | globlastp |
| brachypodium\|09v1\|GT772961 | 5503 | 9908 | 787 | LYM976 | 90 | globlastp |
| cenchrus\|gb166\|EB658899_P1 | 5504 | 9909 | 787 | LYM976 | 86.8 | globlastp |
| maize\|10v1\|EE019249_P1 | 5505 | 9910 | 788 | LYM977 | 86.7 | globlastp |
| foxtail_millet\|11v3\|PHY7SI014280M_P1 | 5506 | 9911 | 788 | LYM977 | 86.3 | globlastp |
| cowpea\|12v1\|FG864078_P1 | 5507 | 9912 | 790 | LYM980 | 86.3 | globlastp |
| pigeonpea\|11v1\|SRR054580X112261_P1 | 5508 | 9913 | 790 | LYM980 | 85.8 | globlastp |
| cowpea\|gb166\|FG864078 | 5509 | 9914 | 790 | LYM980 | 84.3 | globlastp |
| bean\|12v1\|SRR001336.212942_P1 | 5510 | 9915 | 790 | LYM980 | 83.9 | globlastp |
| soybean\|11v1\|GLYMA08G12080 | 5511 | 9916 | 791 | LYM981 | 95.2 | globlastp |
| pigeonpea\|11v1\|SRR054580X147703_P1 | 5512 | 9917 | 791 | LYM981 | 91.2 | globlastp |
| bean\|12v1\|SRR001334.116075_T1 | 5513 | 9918 | 791 | LYM981 | 88.42 | glotblastn |
| medicago\|12v1\|EY474701_P1 | 5514 | 9919 | 791 | LYM981 | 87 | globlastp |
| chickpea\|11v1\|SRR133517.115195_P1 | 5515 | 9920 | 791 | LYM981 | 83.9 | globlastp |
| soybean\|11v1\|GLYMA08G05560 | 5516 | 9921 | 792 | LYM982 | 94.9 | globlastp |
| pigeonpea\|11v1\|SRR054580X142650_P1 | 5517 | 9922 | 792 | LYM982 | 85.6 | globlastp |
| cowpea\|12v1\|FF542192_T1 | 5518 | 9923 | 792 | LYM982 | 80.68 | glotblastn |
| cowpea\|gb166\|FF542192 | 5519 | 9924 | 792 | LYM982 | 80.4 | globlastp |
| bean\|12v1\|SRR001334.36174_P1 | 5520 | 9925 | 792 | LYM982 | 80.3 | globlastp |
| bean\|12v1\|SRR001335.108771_T1 | 5521 | 9926 | 794 | LYM984 | 83.68 | glotblastn |
| cowpea\|12v1\|FF389754_T1 | 5522 | 9927 | 794 | LYM984 | 81.58 | glotblastn |
| cowpea\|gb166\|FF389754 | 5523 | 9927 | 794 | LYM984 | 81.58 | glotblastn |
| pigeonpea\|11v1\|SRR054580X103928_T1 | 5524 | 9928 | 794 | LYM984 | 81.58 | glotblastn |
| bean\|12v1\|FE681972_P1 | 5525 | 9929 | 795 | LYM985 | 91.8 | globlastp |
| lotus\|09v1\|LLAV413376_P1 | 5526 | 9930 | 795 | LYM985 | 88.3 | globlastp |
| cowpea\|12v1\|FF555091_P1 | 5527 | 9931 | 795 | LYM985 | 85.2 | globlastp |
| cowpea\|gb166\|FF555091 | 5527 | 9933 | 795 | LYM985 | 84.6 | globlastp |
| bean\|gb167\|FE681972 | 5528 | 9932 | 795 | LYM985 | 84.88 | glotblastn |
| chickpea\|11v1\|FE671681_P1 | 5529 | 9934 | 795 | LYM985 | 84 | globlastp |
| soybean\|11v1\|GLYMA07G05320 | 5530 | 9935 | 796 | LYM986 | 98.9 | globlastp |
| pigeonpea\|11v1\|GR472819_P1 | 5531 | 9936 | 796 | LYM986 | 97.8 | globlastp |
| cowpea\|12v1\|FF537559_P1 | 5532 | 9937 | 796 | LYM986 | 97.4 | globlastp |
| cowpea\|gb166\|FF537559 | 5533 | 9937 | 796 | LYM986 | 97.4 | globlastp |
| bean\|12v1\|CB280473_P1 | 5534 | 9938 | 796 | LYM986 | 96.3 | globlastp |
| bean\|gb167\|CB280473 | 5535 | 9938 | 796 | LYM986 | 96.3 | globlastp |
| peanut\|10v1\|CD037711_P1 | 5536 | 9939 | 796 | LYM986 | 94.8 | globlastp |
| lotus\|09v1\|LLAI967506_P1 | 5537 | 9940 | 796 | LYM986 | 93.7 | globlastp |
| pigeonpea\|11v1\|EE604853_P1 | 5538 | 9941 | 796 | LYM986 | 93.7 | globlastp |
| cyamopsis\|10v1\|EG977471_P1 | 5539 | 9942 | 796 | LYM986 | 93.3 | globlastp |
| bean\|12v1\|CB539268_P1 | 5540 | 9943 | 796 | LYM986 | 93 | globlastp |
| bean\|gb167\|CB539268 | 5541 | 9943 | 796 | LYM986 | 93 | globlastp |
| cowpea\|12v1\|FF538121_P1 | 5542 | 9944 | 796 | LYM986 | 92.6 | globlastp |
| cowpea\|gb166\|FF538121 | 5543 | 9944 | 796 | LYM986 | 92.6 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| medicago\|12v1\|AW127534_P1 | 5544 | 9945 | 796 | LYM986 | 91.5 | globlastp |
| medicago\|12v1\|AW698673_P1 | 5545 | 9946 | 796 | LYM986 | 91.5 | globlastp |
| chickpea\|11v1\|SRR133517.110321_P1 | 5546 | 9947 | 796 | LYM986 | 91.5 | globlastp |
| clover\|gb162\|BB905159_P1 | 5547 | 9948 | 796 | LYM986 | 91.5 | globlastp |
| cassava\|09v1\|CK641452_P1 | 5548 | 9949 | 796 | LYM986 | 90.7 | globlastp |
| poplar\|10v1\|BI069582_P1 | 5549 | 9950 | 796 | LYM986 | 90.7 | globlastp |
| cassava\|09v1\|DV443273_P1 | 5550 | 9951 | 796 | LYM986 | 90.4 | globlastp |
| platanus\|11v1\|SRR096786X100976_P1 | 5551 | 9952 | 796 | LYM986 | 90.4 | globlastp |
| humulus\|11v1\|ES437762_P1 | 5552 | 9953 | 796 | LYM986 | 89.7 | globlastp |
| soybean\|11v1\|GLYMA03G42310 | 5553 | 9954 | 796 | LYM986 | 89.7 | globlastp |
| castorbean\|11v1\|EE259078_P1 | 5554 | 9955 | 796 | LYM986 | 89.6 | globlastp |
| platanus\|11v1\|SRR096786X1017_P1 | 5555 | 9956 | 796 | LYM986 | 89.6 | globlastp |
| poplar\|10v1\|AI165349_P1 | 5556 | 9957 | 796 | LYM986 | 89.6 | globlastp |
| walnuts\|gb166\|EL890989 | 5557 | 9958 | 796 | LYM986 | 89.6 | globlastp |
| gossypium_raimondii\|12v1\|CA993363_P1 | 5558 | 9959 | 796 | LYM986 | 89.3 | globlastp |
| cotton\|11v1\|CA993363_P1 | 5559 | 9959 | 796 | LYM986 | 89.3 | globlastp |
| sesame\|12v1\|SESI12V1404621_P1 | 5560 | 9960 | 796 | LYM986 | 89 | globlastp |
| catharanthus\|11v1\|EG554843_P1 | 5561 | 9961 | 796 | LYM986 | 89 | globlastp |
| cannabis\|12v1\|SOLX00007897_P1 | 5562 | 9962 | 796 | LYM986 | 88.9 | globlastp |
| chestnut\|gb170\|SRR006296S0002393_P1 | 5563 | 9963 | 796 | LYM986 | 88.9 | globlastp |
| cleome_gynandra\|10v1\|SRR015532S0003569_P1 | 5564 | 9964 | 796 | LYM986 | 88.9 | globlastp |
| cotton\|11v1\|CO069633_P1 | 5565 | 9965 | 796 | LYM986 | 88.9 | globlastp |
| oak\|10v1\|CU640518_P1 | 5566 | 9966 | 796 | LYM986 | 88.9 | globlastp |
| oak\|10v1\|CU640540_P1 | 5567 | 9966 | 796 | LYM986 | 88.9 | globlastp |
| oak\|10v1\|CU657131_P1 | 5568 | 9966 | 796 | LYM986 | 88.9 | globlastp |
| oak\|10v1\|SRR039734S0045780_P1 | 5569 | 9966 | 796 | LYM986 | 88.9 | globlastp |
| papaya\|gb165\|EX229871_P1 | 5570 | 9967 | 796 | LYM986 | 88.9 | globlastp |
| tripterygium\|11v1\|SRR098677X100676 | 5571 | 9968 | 796 | LYM986 | 88.9 | globlastp |
| pigeonpea\|11v1\|SRR054580X266798_T1 | 5572 | 9969 | 796 | LYM986 | 88.89 | glotblastn |
| eucalyptus\|11v2\|CT978659_P1 | 5573 | 9970 | 796 | LYM986 | 88.6 | globlastp |
| trigonella\|11v1\|SRR066194X434858 | 5574 | 9971 | 796 | LYM986 | 88.6 | globlastp |
| euonymus\|11v1\|SRR070038X136982_T1 | 5575 | 9972 | 796 | LYM986 | 88.56 | glotblastn |
| tomato\|11v1\|BG124074 | 5576 | 9973 | 796 | LYM986 | 88.5 | globlastp |
| cotton\|11v1\|CO069918_P1 | 5577 | 9974 | 796 | LYM986 | 88.2 | globlastp |
| pteridium\|11v1\|SRR043594X104663 | 5578 | 9975 | 796 | LYM986 | 88.2 | globlastp |
| tripterygium\|11v1\|SRR098677X10824 | 5579 | 9976 | 796 | LYM986 | 88.19 | glotblastn |
| eggplant\|10v1\|FS005609_P1 | 5580 | 9977 | 796 | LYM986 | 88.1 | globlastp |
| potato\|10v1\|BE919642_P1 | 5581 | 9978 | 796 | LYM986 | 88.1 | globlastp |
| solanum_phureja\|09v1\|SPHBG124074 | 5582 | 9979 | 796 | LYM986 | 88.1 | globlastp |
| tobacco\|gb162\|CV017120 | 5583 | 9980 | 796 | LYM986 | 88.1 | globlastp |
| amsonia\|11v1\|SRR098688X100358_P1 | 5584 | 9981 | 796 | LYM986 | 87.9 | globlastp |
| amsonia\|11v1\|SRR098688X105232_P1 | 5585 | 9982 | 796 | LYM986 | 87.9 | globlastp |
| prunus\|10v1\|BI203080 | 5586 | 9983 | 796 | LYM986 | 87.9 | globlastp |
| flaveria\|11v1\|SRR149232.102699_T1 | 5587 | 9984 | 796 | LYM986 | 87.82 | glotblastn |
| flaveria\|11v1\|SRR149229.102102_P1 | 5588 | 9985 | 796 | LYM986 | 87.8 | globlastp |
| nicotiana_benthamiana\|gb162\|CN655384_P1 | 5589 | 9986 | 796 | LYM986 | 87.8 | globlastp |
| pepper\|12v1\|BM062741_P1 | 5590 | 9987 | 796 | LYM986 | 87.8 | globlastp |
| pepper\|gb171\|BM062741 | 5591 | 9987 | 796 | LYM986 | 87.8 | globlastp |
| cleome_spinosa\|10v1\|GR933957_P1 | 5592 | 9988 | 796 | LYM986 | 87.5 | globlastp |
| flaveria\|11v1\|SRR149229.101222_P1 | 5593 | 9989 | 796 | LYM986 | 87.5 | globlastp |
| flaveria\|11v1\|SRR149229.102125_P1 | 5594 | 9989 | 796 | LYM986 | 87.5 | globlastp |
| flaveria\|11v1\|SRR149229.122735_P1 | 5595 | 9990 | 796 | LYM986 | 87.5 | globlastp |
| flaveria\|11v1\|SRR149229.150359XX2_P1 | 5596 | 9991 | 796 | LYM986 | 87.5 | globlastp |
| flaveria\|11v1\|SRR149229.237794_P1 | 5597 | 9992 | 796 | LYM986 | 87.5 | globlastp |
| melon\|10v1\|EB716009_P1 | 5598 | 9993 | 796 | LYM986 | 87.5 | globlastp |
| nicotiana_benthamiana\|gb162\|CN655115_P1 | 5599 | 9994 | 796 | LYM986 | 87.4 | globlastp |
| triphysaria\|10v1\|EX982518 | 5600 | 9995 | 796 | LYM986 | 87.4 | globlastp |
| phyla\|11v2\|SRR099035X100185_P1 | 5601 | 9996 | 796 | LYM986 | 87.2 | globlastp |
| gossypium_raimondii\|12v1\|SRR032877.152311_P1 | 5602 | 9997 | 796 | LYM986 | 87.1 | globlastp |
| sunflower\|12v1\|CD845626_P1 | 5603 | 9998 | 796 | LYM986 | 87.1 | globlastp |
| sunflower\|12v1\|DY907080_P1 | 5604 | 9998 | 796 | LYM986 | 87.1 | globlastp |
| cotton\|11v1\|DN817218_P1 | 5605 | 9997 | 796 | LYM986 | 87.1 | globlastp |
| cucurbita\|11v1\|SRR091276X103174_P1 | 5606 | 9999 | 796 | LYM986 | 87.1 | globlastp |
| flaveria\|11v1\|SRR149229.219961XX2_P1 | 5607 | 10000 | 796 | LYM986 | 87.1 | globlastp |
| lettuce\|10v1\|DW044164 | 5608 | 10001 | 796 | LYM986 | 87.1 | globlastp |
| sunflower\|10v1\|CD845626 | 5609 | 10002 | 796 | LYM986 | 87.1 | globlastp |
| lettuce\|12v1\|DW044164_P1 | 5610 | 10001 | 796 | LYM986 | 87.1 | globlastp |
| flaveria\|11v1\|SRR149229.115620_T1 | 5611 | 10003 | 796 | LYM986 | 87.08 | glotblastn |
| rose\|12v1\|EC586946_P1 | 5612 | 10004 | 796 | LYM986 | 86.8 | globlastp |
| cucumber\|09v1\|CK085406_P1 | 5613 | 10005 | 796 | LYM986 | 86.8 | globlastp |
| peanut\|10v1\|EC391306_P1 | 5614 | 10006 | 796 | LYM986 | 86.8 | globlastp |
| flaveria\|11v1\|SRR149232.291307_T1 | 5615 | 10007 | 796 | LYM986 | 86.72 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| ambrosia\|11v1\|SRR346935.242465_P1 | 5616 | 10008 | 796 | LYM986 | 86.7 | globlastp |
| flaveria\|11v1\|SRR149229.101502_P1 | 5617 | 10009 | 796 | LYM986 | 86.7 | globlastp |
| ipomoea_nil\|10v1\|BJ555578_P1 | 5618 | 10010 | 796 | LYM986 | 86.7 | globlastp |
| petunia\|gb171\|PETLCHI_P1 | 5619 | 10011 | 796 | LYM986 | 86.7 | globlastp |
| ambrosia\|11v1\|SRR346935.113081_T1 | 5620 | 10012 | 796 | LYM986 | 86.67 | glotblastn |
| flaveria\|11v1\|SRR149238.271446_T1 | 5621 | 10013 | 796 | LYM986 | 86.67 | glotblastn |
| apple\|11v1\|CN490776_P1 | 5622 | 10014 | 796 | LYM986 | 86.4 | globlastp |
| coffea\|10v1\|DV672155_P1 | 5623 | 10015 | 796 | LYM986 | 86.4 | globlastp |
| oak\|10v1\|SRR039740S0020738_P1 | 5624 | 10016 | 796 | LYM986 | 86.4 | globlastp |
| vinca\|11v1\|SRR098690X103235 | 5625 | 10017 | 796 | LYM986 | 86.4 | globlastp |
| flaveria\|11v1\|SRR149229.2612_T1 | 5626 | 10018 | 796 | LYM986 | 86.35 | glotblastn |
| arnica\|11v1\|SRR099034X100189_P1 | 5627 | 10019 | 796 | LYM986 | 86.3 | globlastp |
| chickpea\|11v1\|SRR133517.10177_T1 | 5628 | 10020 | 796 | LYM986 | 86.3 | glotblastn |
| flaveria\|11v1\|SRR149229.115662_P1 | 5629 | 10021 | 796 | LYM986 | 86.3 | globlastp |
| flaveria\|11v1\|SRR149232.103661_P1 | 5630 | 10021 | 796 | LYM986 | 86.3 | globlastp |
| flaveria\|11v1\|SRR149232.177634_P1 | 5631 | 10022 | 796 | LYM986 | 86.3 | globlastp |
| grape\|11v1\|GSVIVT01010483001_P1 | 5632 | 10023 | 796 | LYM986 | 86.3 | globlastp |
| lettuce\|10v1\|DW079308 | 5633 | 10024 | 796 | LYM986 | 86.3 | globlastp |
| oil_palm\|11v1\|SRR190698.109140_P1 | 5634 | 10025 | 796 | LYM986 | 86.3 | globlastp |
| olea\|11v1\|SRR014464.11562_P1 | 5635 | 10026 | 796 | LYM986 | 86.3 | globlastp |
| flaveria\|11v1\|SRR149229.102293_P1 | 5636 | 10027 | 796 | LYM986 | 86 | globlastp |
| monkeyflower\|10v1\|GO948641_P1 | 5637 | 10028 | 796 | LYM986 | 86 | globlastp |
| strawberry\|11v1\|CO816950 | 5638 | 10029 | 796 | LYM986 | 86 | globlastp |
| hornbeam\|12v1\|SRR364455.103157_T1 | 5639 | 10030 | 796 | LYM986 | 85.93 | glotblastn |
| ambrosia\|11v1\|SRR346935.100762_P1 | 5640 | 10031 | 796 | LYM986 | 85.9 | globlastp |
| tragopogon\|10v1\|SRR020205S0023026 | 5641 | 10032 | 796 | LYM986 | 85.9 | globlastp |
| flax\|11v1\|EH791664_P1 | 5642 | 10033 | 796 | LYM986 | 85.8 | globlastp |
| flax\|11v1\|EH792030_P1 | 5643 | 10034 | 796 | LYM986 | 85.8 | globlastp |
| apple\|11v1\|CN489722_P1 | 5644 | 10035 | 796 | LYM986 | 85.7 | globlastp |
| vinca\|11v1\|SRR098690X101097 | 5645 | 10036 | 796 | LYM986 | 85.7 | globlastp |
| blueberry\|12v1\|SRR353282X27172D1_T1 | 5646 | 10037 | 796 | LYM986 | 85.61 | glotblastn |
| aquilegia\|10v2\|DR913622_P1 | 5647 | 10038 | 796 | LYM986 | 85.6 | globlastp |
| blueberry\|12v1\|CF810436_P1 | 5648 | 10039 | 796 | LYM986 | 85.6 | globlastp |
| blueberry\|12v1\|SRR353282X100871D1_P1 | 5649 | 10039 | 796 | LYM986 | 85.6 | globlastp |
| aquilegia\|10v1\|DR913622 | 5650 | 10038 | 796 | LYM986 | 85.6 | globlastp |
| arnica\|11v1\|SRR099034X106538_P1 | 5651 | 10040 | 796 | LYM986 | 85.6 | globlastp |
| flaveria\|11v1\|SRR149229.206991_P1 | 5652 | 10041 | 796 | LYM986 | 85.6 | globlastp |
| flaveria\|11v1\|SRR149232.117305_P1 | 5653 | 10042 | 796 | LYM986 | 85.6 | globlastp |
| scabiosa\|11v1\|SRR063723X112094 | 5654 | 10043 | 796 | LYM986 | 85.3 | globlastp |
| sunflower\|12v1\|BU672060_P1 | 5655 | 10044 | 796 | LYM986 | 85.2 | globlastp |
| aristolochia\|10v1\|SRR039082S0052326_P1 | 5656 | 10045 | 796 | LYM986 | 85.2 | globlastp |
| gerbera\|09v1\|AJ750127_P1 | 5657 | 10046 | 796 | LYM986 | 85.2 | globlastp |
| olea\|11v1\|SRR014464.12355_P1 | 5658 | 10047 | 796 | LYM986 | 85.2 | globlastp |
| senecio\|gb170\|CO553339 | 5659 | 10048 | 796 | LYM986 | 85.2 | globlastp |
| sunflower\|10v1\|BU672060 | 5660 | 10044 | 796 | LYM986 | 85.2 | globlastp |
| antirrhinum\|gb166\|AJ559412_T1 | 5661 | 10049 | 796 | LYM986 | 85.19 | glotblastn |
| ambrosia\|11v1\|SRR346935.135596_P1 | 5662 | 10050 | 796 | LYM986 | 85 | globlastp |
| flaveria\|11v1\|SRR149229.100674_P1 | 5663 | 10051 | 796 | LYM986 | 84.9 | globlastp |
| scabiosa\|11v1\|SRR063723X102902 | 5664 | 10052 | 796 | LYM986 | 84.9 | globlastp |
| flaveria\|11v1\|SRR149241.103330_T1 | 5665 | 10053 | 796 | LYM986 | 84.81 | glotblastn |
| cirsium\|11v1\|SRR346952.111003_P1 | 5666 | 10054 | 796 | LYM986 | 84.8 | globlastp |
| citrus\|gb166\|CF417378 | 5667 | 10055 | 796 | LYM986 | 84.8 | globlastp |
| clementine\|11v1\|CF417378_P1 | 5668 | 10055 | 796 | LYM986 | 84.8 | globlastp |
| dandelion\|10v1\|DY820008_P1 | 5669 | 10056 | 796 | LYM986 | 84.8 | globlastp |
| euphorbia\|11v1\|DV115900_P1 | 5670 | 10057 | 796 | LYM986 | 84.8 | globlastp |
| flaveria\|11v1\|SRR149232.362023_P1 | 5671 | 10058 | 796 | LYM986 | 84.8 | globlastp |
| orange\|11v1\|CF417378_P1 | 5672 | 10055 | 796 | LYM986 | 84.8 | globlastp |
| flaveria\|11v1\|SRR149229.130001_T1 | 5673 | 10059 | 796 | LYM986 | 84.5 | glotblastn |
| flaveria\|11v1\|SRR149241.120888_T1 | 5674 | 10060 | 796 | LYM986 | 84.5 | glotblastn |
| kiwi\|gb166\|FG399599_P1 | 5675 | 10061 | 796 | LYM986 | 84.5 | globlastp |
| kiwi\|gb166\|FG403942_P1 | 5676 | 10062 | 796 | LYM986 | 84.5 | globlastp |
| tripterygium\|11v1\|SRR098677X102472 | 5677 | 10063 | 796 | LYM986 | 84.3 | globlastp |
| banana\|12v1\|DN238511_P1 | 5678 | 10064 | 796 | LYM986 | 84.2 | globlastp |
| banana\|10v1\|DN238511 | 5679 | 10064 | 796 | LYM986 | 84.2 | globlastp |
| phyla\|11v2\|SRR099037X124396_P1 | 5680 | 10065 | 796 | LYM986 | 84.1 | globlastp |
| amborella\|12v3\|CK748898_T1 | 5681 | 10066 | 796 | LYM986 | 83.82 | glotblastn |
| epimedium\|11v1\|SRR013502.13764_P1 | 5682 | 10067 | 796 | LYM986 | 83.8 | globlastp |
| sunflower\|12v1\|DY912454_P1 | 5683 | 10068 | 796 | LYM986 | 83.8 | globlastp |
| amborella\|gb166\|CK748898 | 5684 | 10069 | 796 | LYM986 | 83.8 | globlastp |
| flaveria\|11v1\|SRR149229.101146_P1 | 5685 | 10070 | 796 | LYM986 | 83.8 | globlastp |
| phalaenopsis\|11v1\|SRR125771.1082232XX2_P1 | 5686 | 10071 | 796 | LYM986 | 83.8 | globlastp |
| sarracenia\|11v1\|SRR192669.103721 | 5687 | 10072 | 796 | LYM986 | 83.75 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| antirrhinum\|gb166\|AJ558703_P1 | 5688 | 10073 | 796 | LYM986 | 83.7 | globlastp |
| flaveria\|11v1\|SRR149241.22727_P1 | 5689 | 10074 | 796 | LYM986 | 83.7 | globlastp |
| poppy\|11v1\|SRR096789.11357_P1 | 5690 | 10075 | 796 | LYM986 | 83.6 | globlastp |
| primula\|11v1\|SRR098679X100950_P1 | 5691 | 10076 | 796 | LYM986 | 83.5 | globlastp |
| phalaenopsis\|11v1\|SRR125771.1003281_T1 | 5692 | 10077 | 796 | LYM986 | 83.39 | glotblastn |
| beet\|12v1\|BQ487989_P1 | 5693 | 10078 | 796 | LYM986 | 83.3 | globlastp |
| beet\|gb162\|BQ487989 | 5694 | 10078 | 796 | LYM986 | 83.3 | globlastp |
| cotton\|11v1\|CO080809_T1 | 5695 | 10079 | 796 | LYM986 | 83.03 | glotblastn |
| eschscholzia\|11v1\|CD480012_P1 | 5696 | 10080 | 796 | LYM986 | 83 | globlastp |
| iceplant\|gb164\|BE035421_P1 | 5697 | 10081 | 796 | LYM986 | 83 | globlastp |
| phalaenopsis\|11v1\|CK857821_P1 | 5698 | 10082 | 796 | LYM986 | 83 | globlastp |
| euphorbia\|11v1\|SRR098678X100723_T1 | 5699 | — | 796 | LYM986 | 82.96 | glotblastn |
| tamarix\|gb166\|CN605499 | 5700 | 10083 | 796 | LYM986 | 82.9 | globlastp |
| flaveria\|11v1\|SRR149229.112960_P1 | 5701 | 10084 | 796 | LYM986 | 82.6 | globlastp |
| acacia\|10v1\|FS584902_P1 | 5702 | 10085 | 796 | LYM986 | 82.4 | globlastp |
| utricularia\|11v1\|SRR094438.100639 | 5703 | 10086 | 796 | LYM986 | 82.3 | globlastp |
| onion\|12v1\|SRR073446X652800D1_P1 | 5704 | 10087 | 796 | LYM986 | 82.1 | globlastp |
| fagopyrum\|11v1\|SRR063689X107367_P1 | 5705 | 10088 | 796 | LYM986 | 82.1 | globlastp |
| b_juncea\|12v1\|E6ANDIZ01AD57E_P1 | 5706 | 10089 | 796 | LYM986 | 82 | globlastp |
| b_juncea\|10v2\|E6ANDIZ01A7Q5Y | 5707 | 10090 | 796 | LYM986 | 82 | globlastp |
| b_juncea\|12v1\|E6ANDIZ01APMW81_P1 | 5708 | 10090 | 796 | LYM986 | 82 | globlastp |
| b_oleracea\|gb161\|EH419429_P1 | 5709 | 10091 | 796 | LYM986 | 82 | globlastp |
| b_rapa\|11v1\|H07692_P1 | 5710 | 10089 | 796 | LYM986 | 82 | globlastp |
| canola\|11v1\|CN728740_P1 | 5711 | 10089 | 796 | LYM986 | 82 | globlastp |
| b_juncea\|12v1\|E6ANDIZ01A6ODR_P1 | 5712 | 10090 | 796 | LYM986 | 82 | globlastp |
| flaveria\|11v1\|SRR149240.123360_T1 | 5713 | 10092 | 796 | LYM986 | 81.85 | glotblastn |
| b_juncea\|12v1\|E6ANDIZ01A422K_P1 | 5714 | 10093 | 796 | LYM986 | 81.6 | globlastp |
| b_juncea\|12v1\|E6ANDIZ01AJSC0_P1 | 5715 | 10094 | 796 | LYM986 | 81.6 | globlastp |
| wheat\|12v3\|ERR125556X19518D1_P1 | 5716 | 10095 | 796 | LYM986 | 81.6 | globlastp |
| b_juncea\|10v2\|E6ANDIZ01A422K | 5717 | 10094 | 796 | LYM986 | 81.6 | globlastp |
| canola\|11v1\|DT469167_P1 | 5718 | 10095 | 796 | LYM986 | 81.6 | globlastp |
| thellungiella_halophilum\|11v1\|DN773895 | 5719 | 10096 | 796 | LYM986 | 81.6 | globlastp |
| thellungiella_parvulum\|11v1\|DN773895 | 5720 | 10097 | 796 | LYM986 | 81.6 | globlastp |
| thellungiella\|gb167\|DN773895 | 5721 | 10096 | 796 | LYM986 | 81.6 | globlastp |
| flaveria\|11v1\|SRR149229.166158_P1 | 5722 | 10098 | 796 | LYM986 | 81.5 | globlastp |
| flaveria\|11v1\|SRR149238.108458_P1 | 5723 | 10099 | 796 | LYM986 | 81.5 | globlastp |
| ambrosia\|11v1\|SRR346943.106762_T1 | 5724 | 10100 | 796 | LYM986 | 81.48 | glotblastn |
| flaveria\|11v1\|SRR149238.207847_T1 | 5725 | 10101 | 796 | LYM986 | 81.48 | glotblastn |
| guizotia\|10v1\|GE556522_P1 | 5726 | 10102 | 796 | LYM986 | 81.4 | globlastp |
| arabidopsis_lyrata\|09v1\|JGIAL019459_P1 | 5727 | 10103 | 796 | LYM986 | 81.3 | globlastp |
| onion\|12v1\|CF441833_P1 | 5728 | 10104 | 796 | LYM986 | 81.3 | globlastp |
| onion\|12v1\|CF440062_T1 | 5729 | 10105 | 796 | LYM986 | 81.25 | glotblastn |
| canola\|11v1\|EV215125_T1 | 5730 | 10106 | 796 | LYM986 | 81.25 | glotblastn |
| b_oleracea\|gb161\|AM394731_P1 | 5731 | 10107 | 796 | LYM986 | 81.2 | globlastp |
| canola\|11v1\|CN729972_P1 | 5732 | 10107 | 796 | LYM986 | 81.2 | globlastp |
| radish\|gb164\|EV538856 | 5733 | 10107 | 796 | LYM986 | 81.2 | globlastp |
| valeriana\|11v1\|SRR099039X229840 | 5734 | 10108 | 796 | LYM986 | 81.2 | globlastp |
| flaveria\|11v1\|SRR149229.120133_T1 | 5735 | 10109 | 796 | LYM986 | 81.18 | glotblastn |
| ambrosia\|11v1\|SRR346943.112875_T1 | 5736 | 10110 | 796 | LYM986 | 81.11 | glotblastn |
| cirsium\|11v1\|SRR346952.1001145_P1 | 5737 | 10111 | 796 | LYM986 | 81.1 | globlastp |
| flaveria\|11v1\|SRR149232.163934_P1 | 5738 | 10112 | 796 | LYM986 | 81.1 | globlastp |
| rice\|11v1\|AF010321 | 5739 | 10113 | 796 | LYM986 | 81.1 | globlastp |
| arabidopsis\|10v1\|AT3G61470_P1 | 5740 | 10114 | 796 | LYM986 | 81 | globlastp |
| onion\|gb162\|BE205584 | 5741 | 10115 | 796 | LYM986 | 80.95 | glotblastn |
| b_juncea\|12v1\|E6ANDIZ01A2DA6_P1 | 5742 | 10116 | 796 | LYM986 | 80.9 | globlastp |
| b_juncea\|10v2\|DT317678 | 5743 | 10116 | 796 | LYM986 | 80.9 | globlastp |
| b_juncea\|12v1\|DT317678_P1 | 5744 | 10116 | 796 | LYM986 | 80.9 | globlastp |
| b_juncea\|10v2\|E6ANDIZ01A180I | 5745 | 10117 | 796 | LYM986 | 80.9 | globlastp |
| b_juncea\|12v1\|E6ANDIZ01A180I_P1 | 5746 | 10117 | 796 | LYM986 | 80.9 | globlastp |
| b_juncea\|10v2\|E6ANDIZ01A6ODR | 5747 | 10118 | 796 | LYM986 | 80.9 | globlastp |
| b_rapa\|11v1\|H07548_P1 | 5748 | 10116 | 796 | LYM986 | 80.9 | globlastp |
| canola\|11v1\|CN729020_P1 | 5749 | 10116 | 796 | LYM986 | 80.9 | globlastp |
| poppy\|11v1\|SRR030259.100492_P1 | 5750 | 10119 | 796 | LYM986 | 80.9 | globlastp |
| radish\|gb164\|EV544315 | 5751 | 10120 | 796 | LYM986 | 80.9 | globlastp |
| onion\|12v1\|SRR073446X112884D1_T1 | 5752 | 10121 | 796 | LYM986 | 80.88 | glotblastn |
| centaurea\|gb166\|EL930730_T1 | 5753 | 10122 | 796 | LYM986 | 80.88 | glotblastn |
| b_juncea\|10v2\|E6ANDIZ01A01CP | 5754 | 10123 | 796 | LYM986 | 80.8 | globlastp |
| flaveria\|11v1\|SRR149232.185989_T1 | 5755 | 10124 | 796 | LYM986 | 80.74 | glotblastn |
| flaveria\|11v1\|SRR149232.294659_P1 | 5756 | 10125 | 796 | LYM986 | 80.7 | globlastp |
| switchgrass\|gb167\|DN143635 | 5757 | 10126 | 796 | LYM986 | 80.7 | globlastp |
| canola\|11v1\|EV094923_P1 | 5758 | 10127 | 796 | LYM986 | 80.5 | globlastp |
| poppy\|11v1\|SRR030259.103075_P1 | 5759 | 10128 | 796 | LYM986 | 80.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| b_juncea\|12v1\|E6ANDIZ01AWSMV_P1 | 5760 | 10129 | 796 | LYM986 | 80.4 | globlastp |
| cichorium\|gb171\|EH702154_P1 | 5761 | 10130 | 796 | LYM986 | 80.4 | globlastp |
| sorghum\|11v1\|SB02G037410 | 5762 | 10131 | 796 | LYM986 | 80.4 | globlastp |
| sorghum\|12v1\|SB02G037410_P1 | 5763 | 10131 | 796 | LYM986 | 80.4 | globlastp |
| wheat\|10v2\|BE401036 | 5764 | 10132 | 796 | LYM986 | 80.4 | globlastp |
| banana\|12v1\|DN238452_T1 | 5765 | 10133 | 796 | LYM986 | 80.22 | glotblastn |
| ipomoea_batatas\|10v1\|CB330233_P1 | 5766 | 10134 | 796 | LYM986 | 80.1 | globlastp |
| ambrosia\|11v1\|SRR346947.103999_T1 | 5767 | 10135 | 796 | LYM986 | 80 | glotblastn |
| flaveria\|11v1\|SRR149229.229609_T1 | 5768 | 10136 | 796 | LYM986 | 80 | glotblastn |
| wheat\|10v2\|BE213281 | 5769 | 10137 | 796 | LYM986 | 80 | globlastp |
| wheat\|12v3\|BE401036_P1 | 5770 | 10137 | 796 | LYM986 | 80 | globlastp |
| soybean\|11v1\|GLYMA05G03340 | 5771 | 10138 | 797 | LYM987 | 91.3 | globlastp |
| pigeonpea\|11v1\|GW353382_P1 | 5772 | 10139 | 797 | LYM987 | 87.5 | globlastp |
| bean\|12v1\|CB280581_P1 | 5773 | 10140 | 797 | LYM987 | 82.7 | globlastp |
| bean\|gb167\|CB280581 | 5774 | 10140 | 797 | LYM987 | 82.7 | globlastp |
| cowpea\|12v1\|FF538002_P1 | 5775 | 10141 | 797 | LYM987 | 82 | globlastp |
| cowpea\|gb166\|FF538002 | 5776 | 10141 | 797 | LYM987 | 82 | globlastp |
| soybean\|11v1\|GLYMA07G34370 | 5777 | 10142 | 798 | LYM988 | 95.1 | globlastp |
| pigeonpea\|11v1\|SRR054580X114298_P1 | 5778 | 10143 | 798 | LYM988 | 92.1 | globlastp |
| cowpea\|gb166\|FF543624 | 5779 | 10144 | 798 | LYM988 | 90.6 | globlastp |
| cowpea\|12v1\|FF543624_P1 | 5780 | 10145 | 798 | LYM988 | 89.5 | globlastp |
| bean\|12v1\|CA907562_P1 | 5781 | 10146 | 798 | LYM988 | 88.4 | globlastp |
| oak\|10v1\|CU640565_T1 | 5782 | 10147 | 798 | LYM988 | 80.6 | glotblastn |
| solanum_phureja\|09v1\|SPHBG127600 | 5783 | 10148 | 799 | LYM989 | 92.8 | globlastp |
| pepper\|gb171\|GD074033 | 5784 | 10149 | 799 | LYM989 | 91.2 | globlastp |
| pepper\|12v1\|GD074033_T1 | 5785 | 10150 | 799 | LYM989 | 90.21 | glotblastn |
| nicotiana_benthamiana\|gb162\|CK288532_P1 | 5786 | 10151 | 799 | LYM989 | 81.4 | globlastp |
| solanum_phureja\|09v1\|SPHBG626650 | 5787 | 10152 | 800 | LYM990 | 97.4 | globlastp |
| pepper\|12v1\|BM063436_P1 | 5788 | 10153 | 800 | LYM990 | 91.2 | globlastp |
| pepper\|gb171\|BM063436 | 5789 | 10153 | 800 | LYM990 | 91.2 | globlastp |
| petunia\|gb171\|FN005354_T1 | 5790 | 10154 | 800 | LYM990 | 86.32 | glotblastn |
| rye\|12v1\|DRR001012.109828_P1 | 5791 | 10155 | 801 | LYM991 | 97.9 | globlastp |
| brachypodium\|12v1\|BRADI3G50010_P1 | 5792 | 10156 | 801 | LYM991 | 90.6 | globlastp |
| brachypodium\|09v1\|GT774416 | 5793 | 10156 | 801 | LYM991 | 90.6 | globlastp |
| rice\|11v1\|CA754649 | 5794 | 10157 | 801 | LYM991 | 87.6 | globlastp |
| switchgrass\|gb167\|FL761683 | 5795 | 10158 | 801 | LYM991 | 86.8 | globlastp |
| foxtail_millet\|11v3\|PHY7SI018244M_P1 | 5796 | 10159 | 801 | LYM991 | 85 | globlastp |
| sorghum\|11v1\|SB06G023650 | 5797 | 10160 | 801 | LYM991 | 81.6 | globlastp |
| sorghum\|12v1\|SB06G023650_P1 | 5798 | 10160 | 801 | LYM991 | 81.6 | globlastp |
| sugarcane\|10v1\|CA075338 | 5799 | 10161 | 801 | LYM991 | 81.2 | globlastp |
| switchgrass\|gb167\|FE603766 | 5800 | 10162 | 801 | LYM991 | 80.77 | glotblastn |
| foxtail_millet\|11v3\|PHY7SI010957M_P1 | 5801 | 10163 | 801 | LYM991 | 80.6 | globlastp |
| switchgrass\|gb167\|DN150604 | 5802 | 10164 | 801 | LYM991 | 80.34 | glotblastn |
| millet\|10v1\|EVO454PM106615_P1 | 5803 | 10165 | 801 | LYM991 | 80.3 | globlastp |
| leymus\|gb166\|EG388476_P1 | 5804 | 10166 | 803 | LYM993 | 89 | globlastp |
| barley\|10v2\|BE216540 | 5805 | 10167 | 803 | LYM993 | 88.2 | globlastp |
| oat\|11v1\|GR315877_P1 | 5806 | 10168 | 803 | LYM993 | 81.4 | globlastp |
| barley\|12v1\|BG300500_P1 | 5807 | 10169 | 804 | LYM994 | 95.2 | globlastp |
| rye\|12v1\|DRR001012.164842_T1 | 5808 | 10170 | 804 | LYM994 | 94.11 | glotblastn |
| wheat\|12v3\|CA638316_P1 | 5809 | 10171 | 804 | LYM994 | 93.7 | globlastp |
| brachypodium\|12v1\|BRADI3G40520_P1 | 5810 | 10172 | 804 | LYM994 | 82.9 | globlastp |
| brachypodium\|09v1\|DV469112 | 5811 | 10172 | 804 | LYM994 | 82.9 | globlastp |
| rye\|12v1\|DRR001016.139723_P1 | 5812 | 10173 | 805 | LYM995 | 97.4 | globlastp |
| rye\|12v1\|DRR001012.11430_P1 | 5813 | 10174 | 805 | LYM995 | 95.3 | globlastp |
| rye\|12v1\|DRR001012.11789_T1 | 5814 | 10175 | 805 | LYM995 | 95.26 | glotblastn |
| barley\|10v2\|BE420909 | 5815 | 10176 | 805 | LYM995 | 94.2 | globlastp |
| barley\|12v1\|BE420909_P1 | 5816 | 10176 | 805 | LYM995 | 94.2 | globlastp |
| rye\|12v1\|DRR001012.227664_P1 | 5817 | 10177 | 805 | LYM995 | 93.7 | globlastp |
| brachypodium\|12v1\|BRADI4G34970_P1 | 5818 | 10178 | 805 | LYM995 | 82.1 | globlastp |
| brachypodium\|09v1\|DV477144 | 5819 | 10178 | 805 | LYM995 | 82.1 | globlastp |
| barley\|10v2\|BE421677 | 5820 | 10179 | 806 | LYM996 | 98.6 | globlastp |
| barley\|12v1\|BE421677_P1 | 5821 | 10179 | 806 | LYM996 | 98.6 | globlastp |
| leymus\|gb166\|EG379192_P1 | 5822 | 10179 | 806 | LYM996 | 98.6 | globlastp |
| pseudoroegneria\|gb167\|FF348669 | 5823 | 10179 | 806 | LYM996 | 98.6 | globlastp |
| wheat\|10v2\|BE399428 | 5824 | 10179 | 806 | LYM996 | 98.6 | globlastp |
| wheat\|12v3\|BE419721_P1 | 5825 | 10179 | 806 | LYM996 | 98.6 | globlastp |
| wheat\|10v2\|BE402101 | 5826 | 10180 | 806 | LYM996 | 98.6 | globlastp |
| rye\|12v1\|BE494676_P1 | 5827 | 10181 | 806 | LYM996 | 97.9 | globlastp |
| rye\|12v1\|BF145823_P1 | 5828 | 10181 | 806 | LYM996 | 97.9 | globlastp |
| rye\|12v1\|DRR001012.110454_P1 | 5829 | 10181 | 806 | LYM996 | 97.9 | globlastp |
| rye\|12v1\|DRR001012.111470_P1 | 5830 | 10181 | 806 | LYM996 | 97.9 | globlastp |
| rye\|gb164\|BE494676 | 5831 | 10181 | 806 | LYM996 | 97.9 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| brachypodium|12v1|BRADI1G06820_P1 | 5832 | 10182 | 806 | LYM996 | 95.2 | globlastp |
| fescue|gb161|DT714355_P1 | 5833 | 10183 | 806 | LYM996 | 93.8 | globlastp |
| oat|11v1|CN821086_P1 | 5834 | 10183 | 806 | LYM996 | 93.8 | globlastp |
| oat|11v1|GR329044_P1 | 5835 | 10183 | 806 | LYM996 | 93.8 | globlastp |
| rice|11v1|BI306079 | 5836 | 10184 | 806 | LYM996 | 93.8 | globlastp |
| cenchrus|gb166|EB655851_P1 | 5837 | 10185 | 806 | LYM996 | 91.7 | globlastp |
| millet|10v1|EB410993_P1 | 5838 | 10186 | 806 | LYM996 | 91.7 | globlastp |
| maize|10v1|AI920776_P1 | 5839 | 10187 | 806 | LYM996 | 91 | globlastp |
| sorghum|11v1|SB01G006330 | 5840 | 10188 | 806 | LYM996 | 91 | globlastp |
| sorghum|12v1|SB01G006330_P1 | 5841 | 10188 | 806 | LYM996 | 91 | globlastp |
| sugarcane|10v1|BQ534157 | 5842 | 10189 | 806 | LYM996 | 91 | globlastp |
| switchgrass|gb167|DN145128 | 5843 | 10189 | 806 | LYM996 | 91 | globlastp |
| switchgrass|gb167|DN152377 | 5844 | 10189 | 806 | LYM996 | 91 | globlastp |
| brachypodium|12v1|SOLX00004458_P1 | 5845 | 10190 | 806 | LYM996 | 90.3 | globlastp |
| wheat|10v2|CA486376 | 5846 | 10191 | 806 | LYM996 | 90.3 | globlastp |
| foxtail_millet|11v3|PHY7SI037933M_P1 | 5847 | 10192 | 806 | LYM996 | 89.7 | globlastp |
| maize|10v1|BE519241_P1 | 5848 | 10193 | 806 | LYM996 | 89.7 | globlastp |
| lovegrass|gb167|DN483289_P1 | 5849 | 10194 | 806 | LYM996 | 88.3 | globlastp |
| maize|10v1|BE519240_P1 | 5850 | 10195 | 806 | LYM996 | 82.8 | globlastp |
| barley|10v2|CV054172 | 5851 | 10196 | 806 | LYM996 | 81.38 | glotblastn |
| maize|10v1|FL050858_T1 | 5852 | 10197 | 806 | LYM996 | 80.95 | glotblastn |
| rye|12v1|DRR001012.144653_P1 | 5853 | 10198 | 808 | LYM998 | 96 | globlastp |
| barley|10v2|AV925440 | 5854 | 10199 | 808 | LYM998 | 95 | globlastp |
| pseudoroegneria|gb167|FF362506 | 5855 | 10200 | 808 | LYM998 | 85.6 | globlastp |
| fescue|gb161|DT681050_P1 | 5856 | 10201 | 808 | LYM998 | 82.4 | globlastp |
| oat|11v1|SRR020741.12677_P1 | 5857 | 10202 | 808 | LYM998 | 80 | globlastp |
| barley|12v1|BI948363_P1 | 5858 | 10203 | 809 | LYM999 | 95.7 | globlastp |
| barley|10v2|BI948363 | 5859 | 10204 | 809 | LYM999 | 92.4 | globlastp |
| rice|11v1|AU082959 | 5860 | 10205 | 809 | LYM999 | 85.8 | globlastp |
| foxtail_millet|11v3|PHY7SI000764M_P1 | 5861 | 10206 | 809 | LYM999 | 85.3 | globlastp |
| switchgrass|gb167|FE615308 | 5862 | 10207 | 809 | LYM999 | 84.7 | globlastp |
| maize|10v1|AW060106_P1 | 5863 | 10208 | 809 | LYM999 | 82.5 | globlastp |
| brachypodium|12v1|BRADI2G27350_P1 | 5864 | 10209 | 809 | LYM999 | 80.2 | globlastp |
| brachypodium|09v1|DV469712 | 5865 | 10209 | 809 | LYM999 | 80.2 | globlastp |
| wheat|12v3|BE497603_P1 | 5866 | 10210 | 809 | LYM999 | 80.1 | globlastp |
| wheat|12v3|BF202787_P1 | 5867 | 10211 | 809 | LYM999 | 80.1 | globlastp |
| rye|12v1|DRR001012.108815_P1 | 5868 | 10212 | 811 | LYM1001 | 98.6 | globlastp |
| rye|12v1|DRR001012.357697_P1 | 5869 | 10213 | 811 | LYM1001 | 92 | globlastp |
| brachypodium|12v1|BRADI3G54550_P1 | 5870 | 10214 | 811 | LYM1001 | 86.2 | globlastp |
| brachypodium|09v1|GT771891 | 5871 | 10214 | 811 | LYM1001 | 86.2 | globlastp |
| rice|11v1|CA766473_P1 | 5872 | 10215 | 811 | LYM1001 | 84.3 | globlastp |
| oat|11v1|SRR020741.102157_P1 | 5873 | 10216 | 811 | LYM1001 | 81.1 | globlastp |
| foxtail_millet|11v3|PHY7SI017013M_P1 | 5874 | 10217 | 811 | LYM1001 | 81 | globlastp |
| sorghum|12v1|SB04G036400_P1 | 5875 | 10218 | 811 | LYM1001 | 80.7 | globlastp |
| maize|10v1|AW065578_P1 | 5876 | 10219 | 811 | LYM1001 | 80.4 | globlastp |
| switchgrass|gb167|FE642609_P1 | 5877 | 10220 | 811 | LYM1001 | 80 | globlastp |
| wheat|12v3|BE518363_P1 | 5878 | 10221 | 812 | LYM1002 | 99.8 | globlastp |
| barley|12v1|BF629158_P1 | 5879 | 10222 | 812 | LYM1002 | 98.5 | globlastp |
| rye|12v1|DRR001012.100830_P1 | 5880 | 10223 | 812 | LYM1002 | 94 | globlastp |
| brachypodium|12v1|BRADI5G10930_P1 | 5881 | 10224 | 812 | LYM1002 | 91.3 | globlastp |
| brachypodium|09v1|DV473485 | 5882 | 10224 | 812 | LYM1002 | 91.3 | globlastp |
| sugarcane|10v1|BQ534105 | 5883 | 10225 | 812 | LYM1002 | 87.9 | globlastp |
| rice|11v1|AA751936 | 5884 | 10226 | 812 | LYM1002 | 87.8 | globlastp |
| maize|10v1|T18382_P1 | 5885 | 10227 | 812 | LYM1002 | 87.7 | globlastp |
| switchgrass|gb167|FE603547 | 5886 | 10228 | 812 | LYM1002 | 87.6 | globlastp |
| sorghum|11v1|SB06G017480 | 5887 | 10229 | 812 | LYM1002 | 87.3 | globlastp |
| sorghum|12v1|SB06G017480_P1 | 5888 | 10229 | 812 | LYM1002 | 87.3 | globlastp |
| foxtail_millet|11v3|EC613013_P1 | 5889 | 10230 | 812 | LYM1002 | 87.1 | globlastp |
| millet|10v1|EVO454PM002551_P1 | 5890 | 10231 | 812 | LYM1002 | 86.3 | globlastp |
| maize|10v1|AI901730_P1 | 5891 | 10232 | 812 | LYM1002 | 86.2 | globlastp |
| barley|12v1|BM100684_P1 | 5892 | 10233 | 813 | LYM1003 | 85.9 | globlastp |
| barley|10v2|BF630799 | 5893 | 10234 | 814 | LYM1004 | 96.9 | globlastp |
| barley|12v1|BF630799_P1 | 5894 | 10234 | 814 | LYM1004 | 96.9 | globlastp |
| leymus|gb166|EG396269_P1 | 5895 | 10235 | 814 | LYM1004 | 85.1 | globlastp |
| rye|12v1|DRR001012.156862_P1 | 5896 | 816 | 816 | LYM1006 | 100 | globlastp |
| rye|12v1|DRR001012.183489_P1 | 5897 | 816 | 816 | LYM1006 | 100 | globlastp |
| rye|12v1|DRR001012.270019_P1 | 5898 | 816 | 816 | LYM1006 | 100 | globlastp |
| barley|10v2|BF623293 | 5899 | 816 | 816 | LYM1006 | 100 | globlastp |
| barley|12v1|BF623293_P1 | 5900 | 816 | 816 | LYM1006 | 100 | globlastp |
| pseudoroegneria|gb167|FF342532 | 5901 | 10236 | 816 | LYM1006 | 99.2 | globlastp |
| oat|11v1|GR359086_P1 | 5902 | 10237 | 816 | LYM1006 | 96 | globlastp |
| oat|11v1|SRR020741.10227_P1 | 5903 | 10237 | 816 | LYM1006 | 96 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| brachypodium|12v1|BRADI2G61820_P1 | 5904 | 10238 | 816 | LYM1006 | 92.9 | globlastp |
| brachypodium|09v1|GT766998 | 5905 | 10238 | 816 | LYM1006 | 92.9 | globlastp |
| sorghum|11v1|SB03G047050 | 5906 | 10239 | 816 | LYM1006 | 90.5 | globlastp |
| sugarcane|10v1|CA115643 | 5907 | 10239 | 816 | LYM1006 | 90.5 | globlastp |
| millet|10v1|EVO454PM001535_P1 | 5908 | 10240 | 816 | LYM1006 | 89.7 | globlastp |
| switchgrass|gb167|FE650652 | 5909 | 10240 | 816 | LYM1006 | 89.7 | globlastp |
| cynodon|10v1|ES305630_P1 | 5910 | 10241 | 816 | LYM1006 | 88.9 | globlastp |
| maize|10v1|AI902092_P1 | 5911 | 10242 | 816 | LYM1006 | 88.9 | globlastp |
| switchgrass|gb167|FE626880 | 5912 | 10243 | 816 | LYM1006 | 88.9 | globlastp |
| rice|11v1|AF074803 | 5913 | 10244 | 816 | LYM1006 | 87.3 | globlastp |
| foxtail_millet|11v3|PHY7SI003394M_T1 | 5914 | 10245 | 816 | LYM1006 | 84.92 | glotblastn |
| banana|10v1|FF557927 | 5915 | 10246 | 816 | LYM1006 | 83.3 | globlastp |
| banana|12v1|FF557927_T1 | 5916 | 10247 | 816 | LYM1006 | 82.54 | glotblastn |
| onion|12v1|SRR073446X186938D1_P1 | 5917 | 10248 | 816 | LYM1006 | 82.5 | globlastp |
| sesame|12v1|JK065878_P1 | 5918 | 10249 | 816 | LYM1006 | 81.7 | globlastp |
| oil_palm|11v1|EY398737_P1 | 5919 | 10250 | 816 | LYM1006 | 81.7 | globlastp |
| wheat|10v2|GH728231 | 5920 | 10251 | 816 | LYM1006 | 81 | globlastp |
| poppy|11v1|SRR030259.109724_T1 | 5921 | — | 816 | LYM1006 | 80.95 | glotblastn |
| basilicum|10v1|DY326508_P1 | 5922 | 10252 | 816 | LYM1006 | 80.2 | globlastp |
| eggplant|10v1|FS007363_P1 | 5923 | 10253 | 816 | LYM1006 | 80.2 | globlastp |
| plantago|11v2|SRR066373X115051_P1 | 5924 | 10254 | 816 | LYM1006 | 80.2 | globlastp |
| triphysaria|10v1|DR175273 | 5925 | 10255 | 816 | LYM1006 | 80.2 | globlastp |
| vinca|11v1|SRR098690X233563 | 5926 | 10256 | 816 | LYM1006 | 80.2 | globlastp |
| avocado|10v1|CK754595_T1 | 5927 | 10257 | 816 | LYM1006 | 80.16 | glotblastn |
| barley|12v1|BU990043_P1 | 5928 | 10258 | 817 | LYM1007 | 98 | globlastp |
| rice|11v1|CA767520 | 5929 | 10259 | 817 | LYM1007 | 90.3 | globlastp |
| sorghum|12v1|SB01G047810_P1 | 5930 | 10260 | 817 | LYM1007 | 88.6 | globlastp |
| foxtail_millet|11v3|PHY7SI034318M_P1 | 5931 | 10261 | 817 | LYM1007 | 88.4 | globlastp |
| wheat|12v3|ES466791_P1 | 5932 | 10262 | 817 | LYM1007 | 87.3 | globlastp |
| brachypodium|12v1|BRADI1G75910_T1 | 5933 | 10263 | 817 | LYM1007 | 82.78 | glotblastn |
| foxtail_millet|11v3|PHY7SI011261M_P1 | 5934 | 10264 | 818 | LYM1008 | 82.6 | globlastp |
| foxtail_millet|11v3|PHY7SI011261M_P1 | 5934 | 10264 | 819 | LYM1009 | 85.4 | globlastp |
| millet|10v1|EVO454PM028873_P1 | 5935 | 10265 | 818 | LYM1008 | 82.6 | globlastp |
| millet|10v1|EVO454PM028873_P1 | 5935 | 10265 | 819 | LYM1009 | 86.1 | globlastp |
| brachypodium|12v1|BRADI1G25822_P1 | 5936 | 10266 | 818 | LYM1008 | 81.9 | globlastp |
| brachypodium|12v1|BRADI1G25822_P1 | 5936 | 10266 | 819 | LYM1009 | 81.9 | globlastp |
| foxtail_millet|11v3|PHY7SI031431M_P1 | 5937 | 10267 | 818 | LYM1008 | 81.9 | globlastp |
| foxtail_millet|11v3|PHY7SI031431M_P1 | 5937 | 10267 | 819 | LYM1009 | 84.7 | globlastp |
| sugarcane|10v1|CA104157 | 5938 | 10268 | 818 | LYM1008 | 81.2 | globlastp |
| sugarcane|10v1|CA104157 | 5938 | 10268 | 819 | LYM1009 | 95.8 | globlastp |
| maize|10v1|BQ172615_P1 | 5939 | 10269 | 818 | LYM1008 | 80.6 | globlastp |
| maize|10v1|BQ172615_P1 | 5939 | 10269 | 819 | LYM1009 | 92.4 | globlastp |
| maize|10v1|CO532667_P1 | 5940 | 10270 | 819 | LYM1009 | 91.7 | globlastp |
| maize|10v1|DQ245074_P1 | 5941 | 10271 | 819 | LYM1009 | 90.3 | globlastp |
| maize|10v1|EE030556_P1 | 5942 | 10272 | 819 | LYM1009 | 90.3 | globlastp |
| maize|10v1|ZMCRP2V006979_T1 | 5943 | 10273 | 819 | LYM1009 | 88.89 | glotblastn |
| maize|10v1|DV505656_P1 | 5944 | 10274 | 819 | LYM1009 | 85.4 | globlastp |
| switchgrass|gb167|FL759639 | 5945 | 10275 | 819 | LYM1009 | 84.03 | glotblastn |
| wheat|12v3|AW448782_P1 | 5946 | 10276 | 826 | LYM756 | 93.1 | globlastp |
| wheat|10v2|AW448782 | 5947 | 10277 | 826 | LYM756 | 88.7 | globlastp |
| millet|10v1|EVO454PM029943_T1 | 5948 | 10278 | 826 | LYM756 | 83.25 | glotblastn |
| maize|10v1|AW158003_T1 | 5949 | 10279 | 826 | LYM756 | 80.51 | glotblastn |
| wheat|12v3|BE445765_P1 | 5950 | 10280 | 828 | LYM778 | 84.4 | globlastp |
| millet|10v1|EVO454PM046137_P1 | 5951 | 10281 | 830 | LYM787 | 90.9 | globlastp |
| switchgrass|gb167|FE612331 | 5952 | 10282 | 830 | LYM787 | 87.1 | globlastp |
| switchgrass|gb167|FL740676 | 5953 | 10283 | 830 | LYM787 | 83.2 | globlastp |
| sugarcane|10v1|BU103177 | 5954 | 10284 | 832 | LYM813 | 82.39 | glotblastn |
| millet|10v1|EVO454PM014323_T1 | 5955 | 10285 | 834 | LYM831 | 81.1 | glotblastn |
| sugarcane|10v1|CA077018 | 5956 | 10286 | 835 | LYM833 | 86.49 | glotblastn |
| sorghum|11v1|SOLX00029290 | 5957 | 10287 | 835 | LYM833 | 83.54 | glotblastn |
| sorghum|12v1|EVOER4285_T1 | 5958 | 10287 | 835 | LYM833 | 83.54 | glotblastn |
| switchgrass|gb167|FL713850 | 5959 | 10288 | 836 | LYM838 | 86.51 | glotblastn |
| millet|10v1|EVO454PM022230_T1 | 5960 | 10289 | 836 | LYM838 | 81.52 | glotblastn |
| brachypodium|12v1|BRADI2G60670_T1 | 5961 | 10290 | 839 | LYM872 | 80.07 | glotblastn |
| sorghum|12v1|EVOER2614_T1 | 5962 | 10291 | 843 | LYM899 | 94.67 | glotblastn |
| sugarcane|10v1|CA082515 | 5963 | 10292 | 848 | LYM934 | 96.5 | globlastp |
| maize|10v1|AI372220_P1 | 5964 | 10293 | 848 | LYM934 | 96.1 | globlastp |
| switchgrass|gb167|FE653041 | 5965 | 10294 | 848 | LYM934 | 89.6 | globlastp |
| foxtail_millet|11v3|PHY7SI017137M_P1 | 5966 | 10295 | 848 | LYM934 | 87.7 | globlastp |
| barley|10v2|AV908881 | 5967 | 10296 | 848 | LYM934 | 84.6 | globlastp |
| fescue|gb161|DT679365_P1 | 5968 | 10297 | 848 | LYM934 | 84.6 | globlastp |
| rye|12v1|BE704471_T1 | 5969 | 10298 | 848 | LYM934 | 84.43 | glotblastn |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| wheat\|12v3\|CA691907_P1 | 5970 | 10299 | 848 | LYM934 | 84.2 | globlastp |
| wheat\|10v2\|CA691907 | 5971 | 10300 | 848 | LYM934 | 84.1 | globlastp |
| rice\|11v1\|BI812337 | 5972 | 10301 | 848 | LYM934 | 83.9 | globlastp |
| brachypodium\|12v1\|BRADI4G25680_P1 | 5973 | 10302 | 848 | LYM934 | 83.6 | globlastp |
| brachypodium\|09v1\|GT762475 | 5974 | 10302 | 848 | LYM934 | 83.6 | globlastp |
| soybean\|11v1\|GLYMA15G40170 | 5975 | 10303 | 854 | LYM983 | 92 | globlastp |
| pigeonpea\|11v1\|SRR054580X104057_P1 | 5976 | 10304 | 854 | LYM983 | 84.3 | globlastp |
| bean\|12v1\|SRR001334.253613_P1 | 5977 | 10305 | 854 | LYM983 | 84.2 | globlastp |
| barley\|10v2\|BG300500 | 5978 | 10306 | 856 | LYM994 | 99.72 | glotblastn |
| rye\|12v1\|DRR001012.104489_T1 | 5979 | 10307 | 856 | LYM994 | 98.89 | glotblastn |
| rice\|11v1\|BI796249 | 5980 | 10308 | 856 | LYM994 | 91.41 | glotblastn |
| sorghum\|11v1\|SB07G026995 | 5981 | 10309 | 856 | LYM994 | 90.58 | glotblastn |
| sorghum\|12v1\|SB07G026995_T1 | 5982 | 10309 | 856 | LYM994 | 90.58 | glotblastn |
| switchgrass\|gb167\|FE611913 | 5983 | 10310 | 856 | LYM994 | 90.58 | glotblastn |
| foxtail_millet\|11v3\|EC613201_T1 | 5984 | 10311 | 856 | LYM994 | 90.3 | glotblastn |
| sugarcane\|10v1\|AA269158 | 5985 | 10312 | 856 | LYM994 | 90.3 | glotblastn |
| millet\|10v1\|EVO454PM017751_T1 | 5986 | 10313 | 856 | LYM994 | 89.75 | glotblastn |
| maize\|10v1\|AW288537_T1 | 5987 | 10314 | 856 | LYM994 | 88.64 | glotblastn |
| wheat\|12v3\|BF474691_P1 | 5988 | 10315 | 857 | LYM999 | 98.9 | globlastp |
| wheat\|12v3\|BE444675_P1 | 5989 | 10316 | 857 | LYM999 | 96.2 | globlastp |
| sugarcane\|10v1\|BQ804006 | 5990 | 10317 | 857 | LYM999 | 85.56 | glotblastn |
| rye\|12v1\|DRR001012.195513_T1 | 5991 | 10318 | 857 | LYM999 | 83.01 | glotblastn |
| rice\|11v1\|AU092674 | 5992 | 10319 | 857 | LYM999 | 82.65 | glotblastn |
| sorghum\|11v1\|SB09G018490 | 5993 | 10320 | 857 | LYM999 | 82.53 | glotblastn |
| sorghum\|12v1\|SB09G018490_T1 | 5994 | 10320 | 857 | LYM999 | 82.53 | glotblastn |
| switchgrass\|gb167\|FE641001 | 5995 | 10321 | 857 | LYM999 | 82.35 | glotblastn |
| sorghum\|12v1\|SB09G018500_T1 | 5996 | 10322 | 857 | LYM999 | 81.88 | glotblastn |
| sorghum\|11v1\|SB09G018500 | 5997 | 10322 | 857 | LYM999 | 81.66 | glotblastn |
| foxtail_millet\|11v3\|PHY7SI021932M_T1 | 5998 | 10323 | 857 | LYM999 | 81.52 | glotblastn |
| rye\|12v1\|DRR001012.84848_T1 | 5999 | 10324 | 857 | LYM999 | 80.71 | glotblastn |
| maize\|10v1\|AW225127_T1 | 6000 | 10325 | 857 | LYM999 | 80.43 | glotblastn |
| wheat\|12v3\|CA604152_P1 | 6001 | 10326 | 858 | LYM1000 | 89.9 | globlastp |
| lolium\|10v1\|AU245740_P1 | 6002 | 10327 | 858 | LYM1000 | 86.6 | globlastp |
| wheat\|12v3\|CD883500_P1 | 6003 | 10328 | 858 | LYM1000 | 85.7 | globlastp |
| wheat\|12v3\|BE415032_T1 | 6004 | 10329 | 862 | LYM1007 | 99.59 | glotblastn |
| rye\|12v1\|DRR001012.107517_T1 | 6005 | 10330 | 862 | LYM1007 | 98.37 | glotblastn |
| rye\|12v1\|DRR001012.167974_T1 | 6006 | 10331 | 862 | LYM1007 | 97.96 | glotblastn |
| millet\|10v1\|EVO454PM012693_T1 | 6007 | 10332 | 862 | LYM1007 | 90.2 | glotblastn |
| pseudoroegneria\|gb167\|FF361545 | 6008 | 10333 | 862 | LYM1007 | 88.2 | globlastp |
| leymus\|gb166\|EG375866_P1 | 6009 | 10334 | 862 | LYM1007 | 84.9 | globlastp |
| wheat\|10v2\|BE499509 | 6010 | 10335 | 864 | LYM756 | 96.5 | globlastp |
| wheat\|12v3\|BE499509_P1 | 6011 | 10336 | 864 | LYM756 | 96.3 | globlastp |
| brachypodium\|12v1\|BRADI1G65700_P1 | 6012 | 10337 | 864 | LYM756 | 88.6 | globlastp |
| brachypodium\|09v1\|GT783614 | 6013 | 10337 | 864 | LYM756 | 88.6 | globlastp |
| switchgrass\|gb167\|FL821992 | 6014 | 10338 | 864 | LYM756 | 82.9 | globlastp |
| rice\|11v1\|BI803871 | 6015 | 10339 | 864 | LYM756 | 82.8 | globlastp |
| foxtail_millet\|11v3\|PHY7SI035109M_P1 | 6016 | 10340 | 864 | LYM756 | 81.9 | globlastp |
| sorghum\|11v1\|SB01G038620 | 6017 | 10341 | 864 | LYM756 | 81.6 | globlastp |
| sorghum\|12v1\|SB01G038620_P1 | 6018 | 10341 | 864 | LYM756 | 81.6 | globlastp |
| wheat\|12v3\|BG604437_P1 | 6019 | 10342 | 865 | LYM767 | 91.2 | globlastp |
| barley\|10v2\|BG299568 | 6020 | 10343 | 865 | LYM767 | 90.8 | globlastp |
| wheat\|10v2\|BE425922 | 6021 | 10344 | 865 | LYM767 | 90.6 | globlastp |
| wheat\|12v3\|CA735279_T1 | 6022 | 10345 | 865 | LYM767 | 90.4 | glotblastn |
| barley\|12v1\|BG299568_P1 | 6023 | 10346 | 865 | LYM767 | 88.2 | globlastp |
| rye\|12v1\|DRR001012.179846_P1 | 6024 | 10347 | 866 | LYM768 | 84.9 | globlastp |
| wheat\|12v3\|BE401688_P1 | 6025 | 10348 | 868 | LYM771 | 86.1 | globlastp |
| barley\|12v1\|BE420717_P1 | 6026 | 10349 | 868 | LYM771 | 86 | globlastp |
| rye\|12v1\|DRR001012.120065_P1 | 6027 | 10350 | 868 | LYM771 | 85.7 | globlastp |
| wheat\|10v2\|BE213584 | 6028 | 10351 | 868 | LYM771 | 85.5 | globlastp |
| rice\|11v1\|AA751787 | 6029 | 10352 | 868 | LYM771 | 81.5 | globlastp |
| sorghum\|11v1\|SB07G016320 | 6030 | 10353 | 868 | LYM771 | 81.4 | globlastp |
| sorghum\|12v1\|SB07G016320Pl_P1 | 6031 | 10353 | 868 | LYM771 | 81.4 | globlastp |
| maize\|10v1\|AI622788_P1 | 6032 | 10354 | 868 | LYM771 | 81.3 | globlastp |
| maize\|10v1\|BG320794_P1 | 6033 | 10355 | 868 | LYM771 | 80.3 | globlastp |
| switchgrass\|gb167\|FL901762 | 6034 | 10356 | 871 | LYM794 | 84.8 | globlastp |
| maize\|10v1\|BE512220_P1 | 6035 | 10357 | 871 | LYM794 | 80.7 | globlastp |
| sorghum\|12v1\|SB01G000870_T1 | 6036 | 10358 | 871 | LYM794 | 80.57 | glotblastn |
| foxtail_millet\|11v3\|PHY7SI030876M_P1 | 6037 | 10359 | 874 | LYM805 | 86.6 | globlastp |
| switchgrass\|gb167\|FE653129 | 6038 | 10360 | 874 | LYM805 | 86 | globlastp |
| wheat\|12v3\|BJ256203_T1 | 6039 | 10361 | 874 | LYM805 | 81.74 | glotblastn |
| rye\|12v1\|DRR001012.132582_T1 | 6040 | 10362 | 874 | LYM805 | 81.46 | glotblastn |
| leymus\|gb166\|EG389865_P1 | 6041 | 10363 | 874 | LYM805 | 80.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sorghum\|11v1\|SB07G004540 | 6042 | 10364 | 875 | LYM806 | 89.7 | globlastp |
| foxtail_millet\|11v3\|PHY7SI014572M_P1 | 6043 | 10365 | 875 | LYM806 | 83.3 | globlastp |
| sorghum\|11v1\|SB10G028840 | 6044 | 10366 | 876 | LYM808 | 85.7 | globlastp |
| sorghum\|12v1\|SB10G028840_P1 | 6045 | 10366 | 876 | LYM808 | 85.7 | globlastp |
| maize\|10v1\|CA404302_P1 | 6046 | 10367 | 876 | LYM808 | 83.7 | globlastp |
| sorghum\|11v1\|SB01G012820 | 6047 | 10368 | 879 | LYM812 | 88 | globlastp |
| sorghum\|12v1\|SB01G012820_P1 | 6048 | 10368 | 879 | LYM812 | 88 | globlastp |
| sorghum\|11v1\|SB02G034230 | 6049 | 10369 | 883 | LYM819 | 89.1 | globlastp |
| sorghum\|12v1\|SB02G034230_P1 | 6050 | 10369 | 883 | LYM819 | 89.1 | globlastp |
| maize\|10v1\|BU197491_P1 | 6051 | 10370 | 883 | LYM819 | 84.8 | globlastp |
| sugarcane\|10v1\|CA082234 | 6052 | 10371 | 883 | LYM819 | 82.5 | globlastp |
| sorghum\|11v1\|SB02G000550 | 6053 | 10372 | 885 | LYM824 | 88.8 | globlastp |
| sorghum\|12v1\|SB02G000550_P1 | 6054 | 10372 | 885 | LYM824 | 88.8 | globlastp |
| sorghum\|11v1\|SB06G032970 | 6055 | 10373 | 887 | LYM831 | 92 | globlastp |
| sorghum\|12v1\|SB06G032970_P1 | 6056 | 10373 | 887 | LYM831 | 92 | globlastp |
| foxtail_millet\|11v3\|PHY7SI021140M_P1 | 6057 | 10374 | 887 | LYM831 | 87.5 | globlastp |
| maize\|10v1\|AI944105_P1 | 6058 | 10375 | 887 | LYM831 | 86 | globlastp |
| switchgrass\|gb167\|DN146377_T1 | 6059 | 10376 | 887 | LYM831 | 80.84 | glotblastn |
| sorghum\|11v1\|SB01G042630 | 6060 | 10377 | 889 | LYM834 | 90.2 | globlastp |
| sorghum\|12v1\|SB01G042630_P1 | 6061 | 10377 | 889 | LYM834 | 90.2 | globlastp |
| sorghum\|11v1\|SB06G028210 | 6062 | 10378 | 891 | LYM836 | 86.1 | globlastp |
| sorghum\|12v1\|SB06G028220_P1 | 6063 | 10378 | 891 | LYM836 | 86.1 | globlastp |
| foxtail_millet\|11v3\|PHY7SI009385M_P1 | 6064 | 10379 | 891 | LYM836 | 82.4 | globlastp |
| sorghum\|11v1\|SB01G001990 | 6065 | 10380 | 892 | LYM838 | 91.2 | globlastp |
| sorghum\|12v1\|SB01G001990_P1 | 6066 | 10380 | 892 | LYM838 | 91.2 | globlastp |
| foxtail_millet\|11v3\|PHY7SI034452M_P1 | 6067 | 10381 | 892 | LYM838 | 85.6 | globlastp |
| sorghum\|11v1\|SB03G041970 | 6068 | 10382 | 894 | LYM843 | 88 | globlastp |
| sorghum\|12v1\|SB03G041970_P1 | 6069 | 10382 | 894 | LYM843 | 88 | globlastp |
| switchgrass\|gb167\|FE608615 | 6070 | 10383 | 894 | LYM843 | 86 | globlastp |
| sugarcane\|10v1\|CA094157 | 6071 | 10384 | 894 | LYM843 | 85.32 | glotblastn |
| foxtail_millet\|11v3\|SOLX00013063_P1 | 6072 | 10385 | 894 | LYM843 | 83.6 | globlastp |
| cenchrus\|gb166\|EB660111_T1 | 6073 | 10386 | 894 | LYM843 | 81.15 | glotblastn |
| sorghum\|11v1\|SB01G006030 | 6074 | 10387 | 895 | LYM844 | 93.6 | globlastp |
| foxtail_millet\|11v3\|PHY7SI036438M_P1 | 6075 | 10388 | 895 | LYM844 | 87.5 | globlastp |
| millet\|10v1\|EVO454PM005835_P1 | 6076 | 10389 | 895 | LYM844 | 87.5 | globlastp |
| sugarcane\|10v1\|CA131414 | 6077 | 10390 | 896 | LYM845 | 82.5 | globlastp |
| sorghum\|12v1\|SB04G028730_T1 | 6078 | 10391 | 896 | LYM845 | 81.74 | glotblastn |
| foxtail_millet\|11v3\|EC613406_T1 | 6079 | 10392 | 896 | LYM845 | 80.28 | glotblastn |
| sorghum\|11v1\|SB01G050295 | 6080 | 10393 | 898 | LYM847 | 85.4 | globlastp |
| sorghum\|12v1\|SB01G050295_P1 | 6081 | 10393 | 898 | LYM847 | 85.4 | globlastp |
| sorghum\|12v1\|SB12V2PRD013666_T1 | 6082 | 10394 | 898 | LYM847 | 84.62 | glotblastn |
| sorghum\|12v1\|SB10G030130_P1 | 6083 | 10395 | 899 | LYM849 | 82.4 | globlastp |
| sorghum\|11v1\|SB10G030130 | 6084 | 10395 | 899 | LYM849 | 82.4 | globlastp |
| sugarcane\|10v1\|CA111818 | 6085 | 10396 | 899 | LYM849 | 81.1 | globlastp |
| sorghum\|12v1\|SB10G000670_P1 | 6086 | 10397 | 900 | LYM852 | 92.2 | globlastp |
| sorghum\|11v1\|SB10G000670 | 6087 | 10397 | 900 | LYM852 | 92.2 | globlastp |
| foxtail_millet\|11v3\|PHY7SI007113M_P1 | 6088 | 10398 | 900 | LYM852 | 85.1 | globlastp |
| sorghum\|12v1\|SB04G025070_T1 | 6089 | 849 | 901 | LYM857 | 90.51 | glotblastn |
| maize\|10v1\|W21713_P1 | 6090 | 10399 | 902 | LYM859 | 84.3 | globlastp |
| maize\|10v1\|BM080363_P1 | 6091 | 10400 | 905 | LYM895 | 96.4 | globlastp |
| sugarcane\|10v1\|CA075718 | 6092 | 10401 | 905 | LYM895 | 93.9 | globlastp |
| solanum_phureja\|09v1\|SPHBG643174 | 6093 | 10402 | 905 | LYM895 | 80.8 | globlastp |
| tomato\|11v1\|BG643174 | 6094 | 10403 | 905 | LYM895 | 80.6 | globlastp |
| banana\|12v1\|MAGEN2012012452_P1 | 6095 | 10404 | 905 | LYM895 | 80.4 | globlastp |
| potato\|10v1\|BG597899_P1 | 6096 | 10405 | 905 | LYM895 | 80.4 | globlastp |
| sugarcane\|10v1\|CA066710 | 6097 | 10406 | 906 | LYM914 | 93.81 | glotblastn |
| rice\|11v1\|AU095429_P1 | 6098 | 10407 | 906 | LYM914 | 80.5 | globlastp |
| sugarcane\|10v1\|CA079164 | 6099 | 10408 | 907 | LYM916 | 96.5 | globlastp |
| foxtail_millet\|11v3\|PHY7SI030946M_P1 | 6100 | 10409 | 907 | LYM916 | 95.3 | globlastp |
| switchgrass\|gb167\|FL742062 | 6101 | 10410 | 907 | LYM916 | 92.9 | globlastp |
| cenchrus\|gb166\|EB660422_P1 | 6102 | 10411 | 907 | LYM916 | 92.4 | globlastp |
| millet\|10v1\|PMSLX0060689_P1 | 6103 | 10412 | 907 | LYM916 | 92.4 | globlastp |
| wheat\|10v2\|BE399047 | 6104 | 10413 | 907 | LYM916 | 91.2 | globlastp |
| wheat\|12v3\|BE516516_P1 | 6105 | 10413 | 907 | LYM916 | 91.2 | globlastp |
| rye\|12v1\|BE586359_P1 | 6106 | 10414 | 907 | LYM916 | 90.6 | globlastp |
| rye\|12v1\|DRR001012.205517_P1 | 6107 | 10414 | 907 | LYM916 | 90.6 | globlastp |
| rye\|12v1\|DRR001012.214181_P1 | 6108 | 10414 | 907 | LYM916 | 90.6 | globlastp |
| barley\|10v2\|BE437878 | 6109 | 10415 | 907 | LYM916 | 90.6 | globlastp |
| barley\|12v1\|BE437878_P1 | 6110 | 10415 | 907 | LYM916 | 90.6 | globlastp |
| pseudoroegneria\|gb167\|FF364126 | 6111 | 10416 | 907 | LYM916 | 90.6 | globlastp |
| wheat\|10v2\|BE420408 | 6112 | 10417 | 907 | LYM916 | 90.6 | globlastp |
| sorghum\|11v1\|SB07G023320 | 6113 | 10418 | 907 | LYM916 | 90.6 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sorghum\|12v1\|SB07G023320_P1 | 6114 | 10418 | 907 | LYM916 | 90.6 | globlastp |
| sugarcane\|10v1\|CAOV1877 | 6115 | 10419 | 907 | LYM916 | 90.6 | globlastp |
| foxtail_millet\|11v3\|PHY7SI014548M_P1 | 6116 | 10420 | 907 | LYM916 | 90 | globlastp |
| millet\|10v1\|EVO454P018008_P1 | 6117 | 10421 | 907 | LYM916 | 90 | globlastp |
| cynodon\|10v1\|ES298745_P1 | 6118 | 10422 | 907 | LYM916 | 89.4 | globlastp |
| leymus\|gb166\|CN466202_P1 | 6119 | 10423 | 907 | LYM916 | 88.8 | globlastp |
| rice\|11v1\|BE040917 | 6120 | 10424 | 907 | LYM916 | 88.8 | globlastp |
| switchgrass\|gb167\|DN146109 | 6121 | 10425 | 907 | LYM916 | 88.8 | globlastp |
| switchgrass\|gb167\|FE598705 | 6122 | 10426 | 907 | LYM916 | 88.2 | globlastp |
| brachypodium\|12v1\|BRADI3G38390_P1 | 6123 | 10427 | 907 | LYM916 | 87.1 | globlastp |
| brachypodium\|09v1\|DV471336 | 6124 | 10427 | 907 | LYM916 | 87.1 | globlastp |
| oat\|11v1\|CN814829_P1 | 6125 | 10428 | 907 | LYM916 | 87.1 | globlastp |
| oat\|11v1\|CN820057_P1 | 6126 | 10429 | 907 | LYM916 | 87.1 | globlastp |
| brachypodium\|12v1\|BRADI1G28770_P1 | 6127 | 10430 | 907 | LYM916 | 86.5 | globlastp |
| brachypodium\|09v1\|DV476267 | 6128 | 10430 | 907 | LYM916 | 86.5 | globlastp |
| cenchrus\|gb166\|EB652394_P1 | 6129 | 10431 | 907 | LYM916 | 86.5 | globlastp |
| cynodon\|10v1\|ES295821_P1 | 6130 | 10432 | 907 | LYM916 | 86.5 | globlastp |
| rye\|gb164\|BE586359 | 6131 | 10433 | 907 | LYM916 | 85.9 | globlastp |
| fescue\|gb161\|DT699971_P1 | 6132 | 10434 | 907 | LYM916 | 85.3 | globlastp |
| lovegrass\|gb167\|DN481153_P1 | 6133 | 10435 | 907 | LYM916 | 85.3 | globlastp |
| banana\|12v1\|BBS3657T3_P1 | 6134 | 10436 | 907 | LYM916 | 83.5 | globlastp |
| banana\|10v1\|BBS3657T3 | 6135 | 10437 | 907 | LYM916 | 82.9 | globlastp |
| banana\|10v1\|FL664370 | 6136 | 10438 | 907 | LYM916 | 82.9 | globlastp |
| oat\|11v1\|CN815787_P1 | 6137 | 10439 | 907 | LYM916 | 82.9 | globlastp |
| banana\|12v1\|FL664370_P1 | 6138 | 10440 | 907 | LYM916 | 81.8 | globlastp |
| oil_palm\|11v1\|EL687322_P1 | 6139 | 10441 | 907 | LYM916 | 81.8 | globlastp |
| maize\|10v1\|AI600814_P1 | 6140 | 10442 | 907 | LYM916 | 81.3 | globlastp |
| oil_palm\|11v1\|CN601014_P1 | 6141 | 10443 | 907 | LYM916 | 81.2 | globlastp |
| lovegrass\|gb167\|EH190485_T1 | 6142 | 10444 | 907 | LYM916 | 81.18 | glotblastn |
| phalaenopsis\|11v1\|CB032197_T1 | 6143 | 10445 | 907 | LYM916 | 81.18 | glotblastn |
| eucalyptus\|11v2\|CB967770_P1 | 6144 | 10446 | 907 | LYM916 | 80.6 | globlastp |
| coffea\|10v1\|DV664224_P1 | 6145 | 10447 | 907 | LYM916 | 80 | globlastp |
| cotton\|11v1\|AI729921_P1 | 6146 | 10448 | 907 | LYM916 | 80 | globlastp |
| gossypium_raimondii\|12v1\|DN803906_P1 | 6147 | 10449 | 907 | LYM916 | 80 | globlastp |
| platanus\|11v1\|SRR096786X104533_P1 | 6148 | 10450 | 907 | LYM916 | 80 | globlastp |
| tabernaemontana\|11v1\|SRR098689X103329_P1 | 6149 | 10451 | 907 | LYM916 | 80 | globlastp |
| maize\|10v1\|AI649917_P1 | 6150 | 10452 | 908 | LYM917 | 93.7 | globlastp |
| maize\|10v1\|BM500498_P1 | 6151 | 10453 | 909 | LYM921 | 94.7 | globlastp |
| maize\|10v1\|AI901621_P1 | 6152 | 10454 | 909 | LYM921 | 93.7 | globlastp |
| foxtail_millet\|11v3\|PHY7SI028907M_P1 | 6153 | 10455 | 909 | LYM921 | 92.1 | globlastp |
| rice\|11v1\|BE040461 | 6154 | 10456 | 909 | LYM921 | 85.8 | globlastp |
| brachypodium\|12v1\|BRADI4G36800_P1 | 6155 | 10457 | 909 | LYM921 | 84.1 | globlastp |
| brachypodium\|09v1\|DV468969 | 6156 | 10458 | 909 | LYM921 | 83.99 | glotblastn |
| wheat\|12v3\|BF475047_P1 | 6157 | 10459 | 909 | LYM921 | 83.8 | globlastp |
| wheat\|12v3\|BE488368_P1 | 6158 | 10460 | 909 | LYM921 | 83.6 | globlastp |
| wheat\|10v2\|BE428882 | 6159 | 10461 | 909 | LYM921 | 83.6 | globlastp |
| rye\|12v1\|DRR001012.111906_T1 | 6160 | 10462 | 909 | LYM921 | 83.45 | glotblastn |
| barley\|12v1\|BF623176_P1 | 6161 | 10463 | 909 | LYM921 | 83.1 | globlastp |
| maize\|10v1\|DR787343_P1 | 6162 | 10464 | 910 | LYM942 | 88.6 | globlastp |
| foxtail_millet\|11v3\|PHY7SI017767M_T1 | 6163 | 10465 | 910 | LYM942 | 80.97 | glotblastn |
| sugarcane\|10v1\|BQ534122 | 6164 | 10466 | 911 | LYM943 | 96.6 | globlastp |
| foxtail_millet\|11v3\|PHY7SI023008M_P1 | 6165 | 10467 | 911 | LYM943 | 94.7 | globlastp |
| maize\|10v1\|AW225188_P1 | 6166 | 10468 | 911 | LYM943 | 93.5 | globlastp |
| switchgrass\|gb167\|DN142967 | 6167 | 10469 | 911 | LYM943 | 92 | globlastp |
| millet\|10v1\|EVO454PM020612_P1 | 6168 | 10470 | 911 | LYM943 | 90.8 | globlastp |
| rice\|11v1\|AU085899 | 6169 | 10471 | 911 | LYM943 | 85.8 | globlastp |
| maize\|10v1\|W59823_P1 | 6170 | 10472 | 912 | LYM946 | 87.6 | globlastp |
| sugarcane\|10v1\|CA081762 | 6171 | 10473 | 913 | LYM956 | 94.3 | globlastp |
| maize\|10v1\|CF650087_P1 | 6172 | 10474 | 913 | LYM956 | 93.6 | globlastp |
| maize\|10v1\|BE454052_P1 | 6173 | 10475 | 913 | LYM956 | 93 | globlastp |
| foxtail_millet\|11v3\|PHY7SI022795M_P1 | 6174 | 10476 | 913 | LYM956 | 92.1 | globlastp |
| switchgrass\|gb167\|FE601399 | 6175 | 10477 | 913 | LYM956 | 89.7 | globlastp |
| foxtail_millet\|11v3\|PHY7SI022596M_P1 | 6176 | 10478 | 914 | LYM957 | 81.9 | globlastp |
| millet\|10v1\|EVO454PM036318_P1 | 6177 | 10479 | 914 | LYM957 | 80.7 | globlastp |
| sorghum\|11v1\|SB03G028320 | 6178 | 10480 | 916 | LYM974 | 96.2 | globlastp |
| sorghum\|12v1\|SB03G028320_P1 | 6179 | 10480 | 916 | LYM974 | 96.2 | globlastp |
| barley\|10v2\|AV922801 | 6180 | 10481 | 919 | LYM991 | 99.6 | globlastp |
| barley\|12v1\|AV922801_P1 | 6181 | 10481 | 919 | LYM991 | 99.6 | globlastp |
| wheat\|10v2\|BM136423 | 6182 | 10482 | 919 | LYM991 | 97.9 | globlastp |
| switchgrass\|gb167\|FE628163 | 6183 | 10483 | 919 | LYM991 | 86.3 | globlastp |
| sugarcane\|10v1\|CA132437 | 6184 | 10484 | 919 | LYM991 | 85.04 | glotblastn |
| sorghum\|11v1\|SB04G033650 | 6185 | 10485 | 919 | LYM991 | 84.4 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| sorghum\|12v1\|SB04G033650_P1 | 6186 | 10485 | 919 | LYM991 | 84.4 | globlastp |
| maize\|10v1\|W59826_P1 | 6187 | 10486 | 919 | LYM991 | 83.9 | globlastp |
| maize\|10v1\|BE552647_P1 | 6188 | 10487 | 919 | LYM991 | 83.9 | globlastp |
| rice\|11v1\|BI806936 | 6189 | 10488 | 919 | LYM991 | 83.5 | globlastp |
| barley\|12v1\|BI948990_P1 | 6190 | 10489 | 919 | LYM991 | 81.9 | globlastp |
| barley\|10v2\|BI948990 | 6191 | 10490 | 919 | LYM991 | 81.9 | globlastp |
| wheat\|10v2\|AL829818 | 6192 | 10491 | 919 | LYM991 | 81.9 | globlastp |
| pseudoroegneria\|gb167\|FF356522 | 6193 | 10492 | 919 | LYM991 | 81.7 | glotblastn |
| lolium\|10v1\|ES699274_T1 | 6194 | 10493 | 919 | LYM991 | 81.7 | glotblastn |
| oat\|11v1\|GR353001_T1 | 6195 | 10494 | 919 | LYM991 | 81.28 | glotblastn |
| brachypodium\|12v1\|BRADI5G16740_P1 | 6196 | 10495 | 919 | LYM991 | 81.1 | globlastp |
| brachypodium\|09v1\|DV472854 | 6197 | 10495 | 919 | LYM991 | 81.1 | globlastp |
| wheat\|10v2\|AL821205 | 6198 | 10496 | 919 | LYM991 | 81.1 | globlastp |
| wheat\|12v3\|AL821205_P1 | 6199 | 10497 | 919 | LYM991 | 81.1 | globlastp |
| rye\|12v1\|DRR001012.124772_T1 | 6200 | 10498 | 919 | LYM991 | 80.85 | glotblastn |
| rye\|12v1\|DRR001012.125435_T1 | 6201 | 10498 | 919 | LYM991 | 80.85 | glotblastn |
| rye\|12v1\|DRR001012.382078_T1 | 6202 | 10498 | 919 | LYM991 | 80.85 | glotblastn |
| cynodon\|10v1\|ES299135_T1 | 6203 | 10499 | 919 | LYM991 | 80.51 | glotblastn |
| wheat\|10v2\|BE425470 | 6204 | 10500 | 920 | LYM992 | 99.7 | globlastp |
| pseudoroegneria\|gb167\|FF340299 | 6205 | 10501 | 920 | LYM992 | 99 | globlastp |
| rye\|12v1\|BE637269_T1 | 6206 | 10502 | 920 | LYM992 | 98.68 | glotblastn |
| rye\|12v1\|DRR001012.394026_T1 | 6207 | 10503 | 920 | LYM992 | 98.68 | glotblastn |
| rye\|12v1\|DRR001012.13785_T1 | 6208 | 10504 | 920 | LYM992 | 96.71 | glotblastn |
| barley\|10v2\|BI953999 | 6209 | 10505 | 920 | LYM992 | 96.4 | globlastp |
| leymus\|gb166\|EG377451_P1 | 6210 | 10506 | 920 | LYM992 | 93.4 | globlastp |
| oat\|11v1\|GR320061_P1 | 6211 | 10507 | 920 | LYM992 | 85.3 | globlastp |
| barley\|12v1\|BI953999_P1 | 6212 | 10508 | 920 | LYM992 | 82.6 | globlastp |
| fescue\|gb161\|DT674800_P1 | 6213 | 10509 | 920 | LYM992 | 81.7 | globlastp |
| wheat\|12v3\|CD922788_P1 | 6214 | 10510 | 921 | LYM994 | 99.1 | globlastp |
| rye\|12v1\|DRR001012.118236_P1 | 6215 | 10511 | 921 | LYM994 | 97.4 | globlastp |
| pseudoroegneria\|gb167\|FF357622 | 6216 | 10512 | 923 | LYM997 | 98.2 | globlastp |
| rye\|12v1\|BE586629_P1 | 6217 | 10513 | 923 | LYM997 | 97.3 | globlastp |
| rye\|12v1\|DRR001012.165528_P1 | 6218 | 10513 | 923 | LYM997 | 97.3 | globlastp |
| rye\|12v1\|DRR001012.234318_P1 | 6219 | 10513 | 923 | LYM997 | 97.3 | globlastp |
| barley\|10v2\|BE060803 | 6220 | 10514 | 923 | LYM997 | 97.3 | globlastp |
| barley\|12v1\|BE060803_P1 | 6221 | 10514 | 923 | LYM997 | 97.3 | globlastp |
| rye\|12v1\|BE494079_P1 | 6222 | 10515 | 923 | LYM997 | 96.4 | globlastp |
| oat\|11v1\|GR343908_P1 | 6223 | 10516 | 923 | LYM997 | 92.9 | globlastp |
| brachypodium\|12v1\|BRADI1G08190_P1 | 6224 | 10517 | 923 | LYM997 | 90.2 | globlastp |
| brachypodium\|09v1\|DV469871 | 6225 | 10517 | 923 | LYM997 | 90.2 | globlastp |
| sorghum\|11v1\|SB01G007650 | 6226 | 10518 | 923 | LYM997 | 88.4 | globlastp |
| sorghum\|12v1\|SB01G007650_P1 | 6227 | 10518 | 923 | LYM997 | 88.4 | globlastp |
| sugarcane\|10v1\|CA115883 | 6228 | 10518 | 923 | LYM997 | 88.4 | globlastp |
| rye\|gb164\|BE494079 | 6229 | 10519 | 923 | LYM997 | 87.8 | globlastp |
| oat\|11v1\|SRR020741.153922_P1 | 6230 | 10520 | 923 | LYM997 | 87.5 | globlastp |
| cenchrus\|gb166\|EB656892_P1 | 6231 | 10521 | 923 | LYM997 | 86.6 | globlastp |
| millet\|10v1\|EVO454PM035634_P1 | 6232 | 10522 | 923 | LYM997 | 86.6 | globlastp |
| maize\|10v1\|AI396536_P1 | 6233 | 10523 | 923 | LYM997 | 85.7 | globlastp |
| rice\|11v1\|AU065926 | 6234 | 10524 | 923 | LYM997 | 85.1 | globlastp |
| wheat\|10v2\|CA617046 | 6235 | 10525 | 923 | LYM997 | 83.04 | glotblastn |
| rye\|12v1\|DRR001012.122610_P1 | 6236 | 10526 | 925 | LYM999 | 96.5 | globlastp |
| brachypodium\|12v1\|BRADI2G60120_P1 | 6237 | 10527 | 925 | LYM999 | 86.4 | globlastp |
| brachypodium\|09v1\|DV483911 | 6238 | 10527 | 925 | LYM999 | 86.4 | globlastp |
| maize\|10v1\|AI782894_P1 | 6239 | 10528 | 925 | LYM999 | 84 | globlastp |
| barley\|12v1\|BF624794_P1 | 6240 | 10529 | 926 | LYM1000 | 96.2 | globlastp |
| barley\|10v2\|BF624794 | 6241 | 10529 | 926 | LYM1000 | 96.2 | globlastp |
| wheat\|12v3\|BE402192_P1 | 6242 | 10530 | 926 | LYM1000 | 95.6 | globlastp |
| rye\|12v1\|DRR001012.193898_P1 | 6243 | 10531 | 926 | LYM1000 | 92.4 | globlastp |
| wheat\|12v3\|SRR400826X327894D1_P1 | 6244 | 10532 | 926 | LYM1000 | 91.6 | globlastp |
| brachypodium\|12v1\|BRADI1G06470_P1 | 6245 | 10533 | 926 | LYM1000 | 87.3 | globlastp |
| brachypodium\|09v1\|GT763929 | 6246 | 10533 | 926 | LYM1000 | 87.3 | globlastp |
| wheat\|12v3\|BF202353_P1 | 6247 | 10534 | 926 | LYM1000 | 86.6 | globlastp |
| rice\|11v1\|CA762040 | 6248 | 10535 | 926 | LYM1000 | 81.4 | globlastp |
| pseudoroegneria\|gb167\|FF356806 | 6249 | 10536 | 928 | LYM1004 | 90.3 | globlastp |
| oat\|11v1\|GR320205_P1 | 6250 | 10537 | 928 | LYM1004 | 80.4 | globlastp |
| wheat\|10v2\|BE403550 | 6251 | 10538 | 929 | LYM1005 | 96.1 | globlastp |
| rye\|12v1\|DRR001012.297113_P1 | 6252 | 10539 | 929 | LYM1005 | 96 | globlastp |
| barley\|12v1\|BF617519_P1 | 6253 | 10540 | 929 | LYM1005 | 95.8 | globlastp |
| rye\|12v1\|DRR001012.154003_T1 | 6254 | 10541 | 929 | LYM1005 | 91.83 | glotblastn |
| rye\|12v1\|DRR001012.426958_P1 | 6255 | 10542 | 929 | LYM1005 | 91.8 | globlastp |
| rye\|12v1\|DRR001012.100233_P1 | 6256 | 10543 | 929 | LYM1005 | 91.1 | globlastp |
| wheat\|12v3\|BE403550_P1 | 6257 | 10544 | 929 | LYM1005 | 87.5 | globlastp |

TABLE 2-continued

Homologues of the identified genes/polypeptides for increasing yield, seed yield, oil yield, oil content, fiber yield, fiber quality, growth rate, vigor, biomass, growth rate, abiotic stress tolerance, nitrogen use efficiency, water use efficiency and fertilizer use efficiency of a plant

| Cluster name | P.N. SEQ ID NO: | P.P. SEQ ID NO: | Hom. to SEQ ID NO: | Hom. to Gene Name | % global iden. | Algor. |
|---|---|---|---|---|---|---|
| rye\|12v1\|BE587745_T1 | 6258 | 10545 | 929 | LYM1005 | 86.28 | glotblastn |
| wheat\|12v3\|CA646502_P1 | 6259 | 10546 | 929 | LYM1005 | 85.5 | globlastp |
| rye\|12v1\|DRR001012.251911_T1 | 6260 | 10547 | 929 | LYM1005 | 84.49 | glotblastn |
| rice\|11v1\|AA750350 | 6261 | 10548 | 929 | LYM1005 | 80.42 | glotblastn |
| brachypodium\|12v1\|BRADI2G61690_P1 | 6262 | 10549 | 930 | LYM1006 | 82.5 | globlastp |
| brachypodium\|09v1\|SRR031797S0024491 | 6263 | 10549 | 930 | LYM1006 | 82.5 | globlastp |
| sorghum\|12v1\|SB03G047050_P1 | 6264 | 10550 | 930 | LYM1006 | 81 | globlastp |
| wheat\|10v2\|CA486825 | 6265 | 10550 | 930 | LYM1006 | 81 | globlastp |

Table 2:
Provided are the homologous polypeptides and polynucleotides of the genes for increasing yield (e.g., oil yield, seed yield, fiber yield and/or quality), oil content, growth rate, vigor, biomass, abiotic stress tolerance, nitrogen use efficiency, water use efficiency and fertilizer use efficiency genes of a plant which are listed in Table 1 above. Homology was calculated as % of identity over the aligned sequences. The query sequences were polynucleotide sequences SEQ ID NOs: 1-573; and polypeptide SEQ ID NOs: 574-930 and the subject sequences are protein sequences identified in the database based on greater than 80% global identity to the predicted translated sequences of the query nucleotide sequences or to the polypeptide sequences. "P.N." = polynucleotide; "P.P." = polypeptide; "Algor." = algorithm (used for sequence alignment and determination of percent homology); "Hom."—homology; "iden."—identity.

The output of the functional genomics approach described herein is a set of genes highly predicted to improve yield and/or other agronomic important traits such as growth rate, vigor, oil content, fiber yield and/or quality, biomass, growth rate, abiotic stress tolerance, nitrogen use efficiency, water use efficiency and fertilizer use efficiency of a plant by increasing their expression. Although each gene is predicted to have its own impact, modifying the mode of expression of more than one gene is expected to provide an additive or synergistic effect on the plant yield and/or other agronomic important yields performance. Altering the expression of each gene described here alone or set of genes together increases the overall yield and/or other agronomic important traits, hence expects to increase agricultural productivity.

Example 3

Production of Barley Transcription and High Throughput Correlation Analysis Using 44K Barley Oligonucleotide Micro-Array In order to produce a high throughput correlation analysis, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?lPage=50879]. The array oligonucleotide represents about 47,500 Barley genes and transcripts. In order to define correlations between the levels of RNA expression and yield or vigor related parameters, various plant characteristics of 25 different Barley accessions were analyzed. Among them, 13 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Five tissues at different developmental stages [meristem, flower, booting spike, stem, flag leaf], representing different plant characteristics, were sampled and RNA was extracted as described hereinabove under "GENERAL EXPERIMENTAL AND BIOINFORMATICS METHODS".

For convenience, each micro-array expression information tissue type has received a Set ID as summarized in Table 3 below.

TABLE 3

Barley transcriptom expression sets

| Expression Set | Set ID |
|---|---|
| booting spike | 1 |
| stem | 2 |
| flowering spike | 3 |
| meristem | 4 |

Table 3:
Provided are the identification (ID) letters of each of the Barley expression sets.

Barley yield components and vigor related parameters assessment—13 Barley accessions in 4 repetitive blocks (named A, B, C, and D), each containing 4 plants per plot were grown at net house. Plants were phenotyped on a daily basis following the to standard descriptor of barley (Table 4, below). Harvest was conducted while 50% of the spikes were dry to avoid spontaneous release of the seeds. Plants were separated to the vegetative part and spikes, of them, 5 spikes were threshed (grains were separated from the glumes) for additional grain analysis such as size measurement, grain count per spike and grain yield per spike. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

TABLE 4

Barley standard descriptors

| Trait | Parameter | Range | Description |
|---|---|---|---|
| Growth habit | Scoring | 1-9 | Prostrate (1) or Erect (9) |
| Hairiness of basal leaves | Scoring | P (Presence)/ A (Absence) | Absence (1) or Presence (2) |

TABLE 4-continued

Barley standard descriptors

| Trait | Parameter | Range | Description |
|---|---|---|---|
| Stem pigmentation | Scoring | 1-5 | Green (1), Basal only or Half or more (5) |
| Days to Flowering | Days | | Days from sowing to emergence of awns |
| Plant height | Centimeter (cm) | | Height from ground level to top of the longest spike excluding awns |
| Spikes per plant | Number | | Terminal Counting |
| Spike length | Centimeter (cm) | | Terminal Counting 5 spikes per plant |
| Grains per spike | Number | | Terminal Counting 5 spikes per plant |
| Vegetative dry weight | Gram | | Oven-dried for 48 hours at 70° C. |
| Spikes dry weight | Gram | | Oven-dried for 48 hours at 30° C. |

Table 4.

At the end of the experiment (50% of the spikes were dry) all spikes from plots within blocks A-D were collected, and the following measurements were performed:

(i) Grains per spike—The total number of grains from 5 spikes that were manually threshed was counted. The average grain per spike was calculated by dividing the total grain number by the number of spikes.

(ii) Grain average size (cm)—The total grains from 5 spikes that were manually threshed were scanned and images were analyzed using the digital imaging system. Grain scanning was done using Brother scanner (model DCP-135), at the 200 dpi resolution and analyzed with Image J software. The average grain size was calculated by dividing the total grain size by the total grain number.

(iii) Grain average weight (mgr)—The total grains from 5 spikes that were manually threshed were counted and weight. The average weight was calculated by dividing the total weight by the total grain number.

(iv) Grain yield per spike (gr)—The total grains from 5 spikes that were manually threshed were weight. The grain yield was calculated by dividing the total weight by the spike number.

(v) Spike length analysis—The five chosen spikes per plant were measured using measuring tape excluding the awns.

(vi) Spike number analysis—The spikes per plant were counted.

Additional parameters were measured as follows:

Growth habit scoring—At growth stage 10 (booting), each of the plants was scored for its growth habit nature. The scale that was used was 1 for prostate nature till 9 for erect.

Hairiness of basal leaves—At growth stage 5 (leaf sheath strongly erect; end of tillering), each of the plants was scored for its hairiness nature of the leaf before the last. The scale that was used was 1 for prostate nature till 9 for erect.

Plant height—At harvest stage (50% of spikes were dry), each of the plants was measured for its height using measuring tape. Height was measured from ground level to top of the longest spike excluding awns.

Days to flowering—Each of the plants was monitored for flowering date. Days of flowering was calculated from sowing date till flowering date.

Stem pigmentation—At growth stage 10 (booting), each of the plants was scored for its stem color. The scale that was used was 1 for green till 5 for full purple.

Vegetative dry weight and spike yield—At the end of the experiment (50% of the spikes were dry) all spikes and vegetative material from plots within blocks A-D are to collected. The biomass and spikes weight of each plot was separated, measured and divided by the number of plants.

Dry weight=total weight of the vegetative portion above ground (excluding roots) after drying at 70° C. in oven for 48 hours;

Spike yield per plant=total spike weight per plant (gr) after drying at 30° C. in oven for 48 hours.

TABLE 5

Barley correlated parameters (vectors)

| Correlated parameter with | Correlation ID |
|---|---|
| Days to flowering (days) | 1 |
| Grain weight (milligrams) | 2 |
| Spike length (cm) | 3 |
| Grains size (mm$^2$) | 4 |
| Grains per spike (numbers) | 5 |
| Growth habit (scores 1-9) | 6 |
| Hairiness of basal leaves (scoring 1-2) | 7 |
| Plant height (cm) | 8 |
| Grain Yield per spike (gr/spike) | 9 |
| Stem pigmentation (scoring 1-5) | 10 |
| Vegetative dry weight (gram) | 11 |
| Spikes per plant (numbers) | 12 |

Table 5.
Provided are the Barley correlated parameters (vectors).

Experimental Results 13 different Barley accessions were grown and characterized for 13 parameters as described above. The average for each of the measured parameter was calculated using the JMP software and values are summarized in Tables 6 and 7 below. Subsequent correlation analysis between the various transcriptom expression sets (Table 3) and the average parameters was conducted. Follow, results were integrated to the database (Table 8 below).

TABLE 6

Measured parameters of correlation Ids in Barley accessions

| Ecotype | Treatment | | | | | | |
|---|---|---|---|---|---|---|---|
| | Line-1 | Line-2 | Line-3 | Line-4 | Line-5 | Line-6 | Line-7 |
| 1 | 62.40 | 64.08 | 65.15 | 58.92 | 63.00 | 70.54 | 60.88 |
| 2 | 35.05 | 28.06 | 28.76 | 17.87 | 41.22 | 29.73 | 34.99 |
| 3 | 12.04 | 10.93 | 11.83 | 9.90 | 11.68 | 11.53 | 11.22 |
| 4 | 0.27 | 0.23 | 0.24 | 0.17 | 0.29 | 0.28 | 0.28 |
| 5 | 20.23 | 17.98 | 17.27 | 17.73 | 14.47 | 16.78 | 14.07 |
| 6 | 2.60 | 2.00 | 1.92 | 3.17 | 4.33 | 2.69 | 3.50 |
| 7 | 1.53 | 1.33 | 1.69 | 1.08 | 1.42 | 1.69 | 1.19 |
| 8 | 134.27 | 130.50 | 138.77 | 114.58 | 127.75 | 129.38 | 121.63 |
| 9 | 3.56 | 2.54 | 2.58 | 1.57 | 3.03 | 2.52 | 2.62 |
| 10 | 1.13 | 2.50 | 1.69 | 1.75 | 2.33 | 2.31 | 2.19 |
| 11 | 78.87 | 66.14 | 68.49 | 53.39 | 68.30 | 74.17 | 58.33 |
| 12 | 48.85 | 48.27 | 37.42 | 61.92 | 33.27 | 41.69 | 40.63 |

Table 6.
Provided are the values of each of the parameters measured in Barley accessions according to the correlation identifications (see Table 5).

TABLE 7

Barley accessions, additional measured parameters

| Ecotype | Treatment | | | | | |
|---|---|---|---|---|---|---|
| | Line-8 | Line-9 | Line-10 | Line-11 | Line-12 | Line-13 |
| 1 | 58.10 | 60.40 | 52.80 | 53.00 | 64.58 | 56.00 |
| 2 | 20.58 | 37.13 | 25.22 | 27.50 | 29.56 | 19.58 |
| 3 | 11.11 | 10.18 | 8.86 | 8.58 | 10.51 | 9.80 |

TABLE 7-continued

Barley accessions, additional measured parameters

| | Treatment | | | | | |
|---|---|---|---|---|---|---|
| Ecotype | Line-8 | Line-9 | Line-10 | Line-11 | Line-12 | Line-13 |
| 4 | 0.19 | 0.27 | 0.22 | 0.22 | 0.27 | 0.18 |
| 5 | 21.54 | 13.40 | 12.12 | 12.10 | 15.28 | 17.07 |
| 6 | 3.00 | 2.47 | 3.60 | 3.67 | 3.50 | 3.00 |
| 7 | 1.00 | 1.60 | 1.30 | 1.17 | 1.08 | 1.17 |
| 8 | 126.80 | 121.40 | 103.89 | 99.83 | 118.42 | 117.17 |
| 9 | 2.30 | 2.68 | 1.55 | 1.68 | 2.35 | 1.67 |
| 10 | 2.30 | 3.07 | 1.70 | 1.83 | 1.58 | 2.17 |
| 11 | 62.23 | 68.31 | 35.35 | 38.32 | 56.15 | 42.68 |
| 12 | 62.00 | 50.60 | 40.00 | 49.33 | 43.09 | 51.40 |

Table 7.
Provided are the values of each of the parameters measured in Barley accessions according to the correlation identifications (see Table 5).

TABLE 8

Correlation between the expression level of the selected polynucleotides of the invention and their homologues in specific tissues or developmental stages and the phenotypic performance across Barley accessions

| Gene Name | R | P value | Exp. set | Corr. Set ID | Gene Name | R | P value | Exp. set | Corr. Set ID |
|---|---|---|---|---|---|---|---|---|---|
| LYM755 | 0.82 | 3.91E−03 | 3 | 6 | LYM755 | 0.80 | 1.83E−02 | 4 | 12 |
| LYM756 | 0.75 | 1.89E−02 | 1 | 4 | LYM756 | 0.79 | 1.15E−02 | 1 | 2 |
| LYM756 | 0.70 | 1.57E−02 | 4 | 3 | LYM756 | 0.75 | 8.28E−03 | 4 | 9 |
| LYM759 | 0.77 | 5.23E−03 | 1 | 8 | LYM759 | 0.84 | 1.27E−03 | 1 | 3 |
| LYM759 | 0.83 | 1.73E−03 | 1 | 9 | LYM759 | 0.77 | 5.48E−03 | 1 | 11 |
| LYM759 | 0.73 | 1.02E−02 | 4 | 4 | LYM760 | 0.96 | 1.98E−04 | 3 | 4 |
| LYM760 | 0.92 | 1.06E−03 | 3 | 2 | LYM760 | 0.76 | 2.83E−02 | 3 | 9 |
| LYM760 | 0.73 | 4.00E−02 | 3 | 7 | LYM762 | 0.73 | 3.95E−02 | 1 | 12 |
| LYM762 | 0.82 | 1.93E−03 | 1 | 5 | LYM763 | 0.74 | 2.39E−02 | 4 | 4 |
| LYM763 | 0.72 | 3.02E−02 | 4 | 2 | LYM764 | 0.78 | 7.19E−03 | 3 | 4 |
| LYM764 | 0.72 | 1.85E−02 | 3 | 2 | LYM764 | 0.86 | 6.10E−03 | 3 | 7 |
| LYM764 | 0.88 | 1.88E−03 | 4 | 4 | LYM764 | 0.88 | 3.90E−04 | 4 | 2 |
| LYM764 | 0.74 | 9.91E−03 | 4 | 9 | LYM764 | 0.71 | 3.15E−02 | 4 | 1 |

Table 8.
Provided are the correlations (R) and p-values (P) between the expression levels of selected genes of some embodiments of the invention in various tissues or developmental stages (Expression sets) and the phenotypic performance in various yield (seed yield, oil yield, oil content), biomass, growth rate and/or vigor components [Correlation (Corr.) vector (Vec.) Expression (Exp.)] Corr. Vector = correlation vector specified in Tables 5, 6 and 7; Exp. Set = expression0 set specified in Table 3.

Example 4

Production of *Arabidopsis* Transcriptom and High Throughput Correlation Analysis of Yield, Biomass and/or Vigor Related Parameters Using 44K *Arabidopsis* Full Genome Oligonucleotide Micro-Array To produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 40,000 *A. thaliana* genes and transcripts designed based on data from the TIGR ATH1 v. 5 database and *Arabidopsis* MPSS (University of Delaware) databases. To define correlations between the levels of RNA expression and yield, biomass components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed *Arabidopsis* tissues—Five tissues at different developmental stages including root, leaf, flower at anthesis, seed at 5 days after flowering (DAF) and seed at 12 DAF, representing different plant characteristics, were sampled and RNA was extracted as described as described hereinabove under "GENERAL EXPERIMENTAL AND BIOINFORMATICS METHODS". For convenience, each microarray expression information tissue type has received a Set ID as summarized in Table 9 below.

TABLE 9

Tissues used for *Arabidopsis* transcriptom expression sets

| Expression Set | Set ID |
|---|---|
| Leaf | 1 |
| Root | 2 |
| Seed 5DAF | 3 |
| Flower | 4 |
| Seed 12DAF | 5 |

Table 9:
Provided are the identification (ID) digits of each of the *Arabidopsis* expression sets (1-5). DAF = days after flowering.

Yield components and vigor related parameters assessment—Eight out of the nine *Arabidopsis* ecotypes were used in each of 5 repetitive blocks (named A, B, C, D and E), each containing 20 plants per plot. The plants were grown in a greenhouse at controlled conditions in 22° C., and the N:P:K fertilizer (20:20:20; weight ratios) [nitrogen (N), phosphorus (P) and potassium (K)] was added. During this time data was collected, documented and analyzed. Additional data was collected through the seedling stage of plants grown in a tissue culture in vertical grown transparent agar plates. Most of chosen parameters were analyzed by digital imaging.

Digital imaging in Tissue culture—A laboratory image acquisition system was used for capturing images of plantlets sawn in square agar plates. The image acquisition system consists of a digital reflex camera (Canon EOS 300D) attached to a 55 mm focal length lens (Canon EF-S series), mounted on a reproduction device (Kaiser RS), which included 4 light units (4×150 Watts light bulb) and located in a darkroom.

Digital imaging in Greenhouse—The image capturing process was repeated every 3-4 days starting at day 7 till day 30. The same camera attached to a 24 mm focal length lens (Canon EF series), placed in a custom made iron mount, was used for capturing images of larger plants sawn in white tubs in an environmental controlled greenhouse. The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37, Java based image processing program, which was developed at the U.S National Institutes of Health and is freely available on the internet at Hypertext Transfer Protocol://rsbweb (dot) nih (dot) gov/. Images were captured in resolution of 6 Mega to Pixels (3072×2048 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images. The blade circularity was calculated as laminar width divided by laminar length.

Figure 3A:
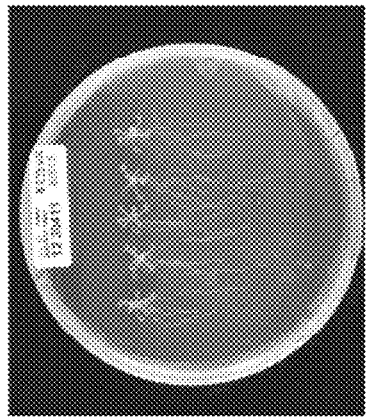
FIGS. 3A-F are images depicting visualization of root development of transgenic plants exogenously expressing the polynucleotide of some embodiments of the invention when grown in transparent agar plates under normal (FIGS. 3A-B), osmotic stress (15% PEG.
Figure 3C:
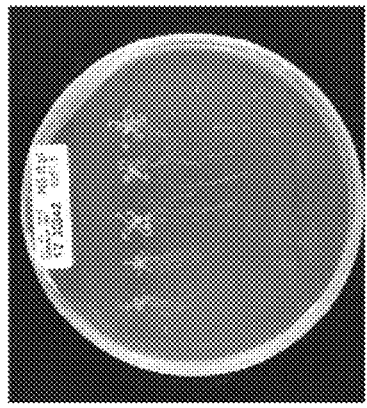
Figure 3E:
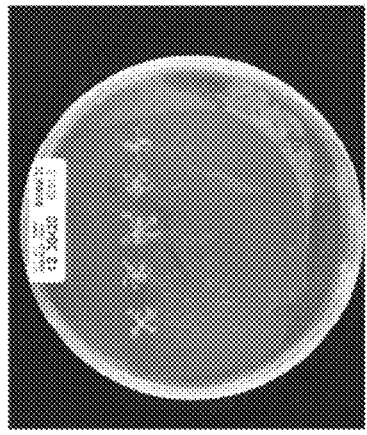
Figure 3B:
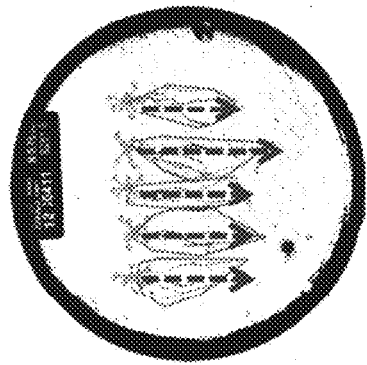
Figure 3D:
Figure 3F:
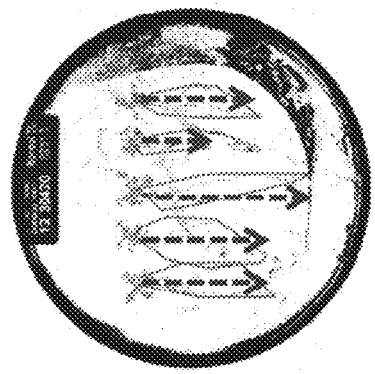
Figure 4:
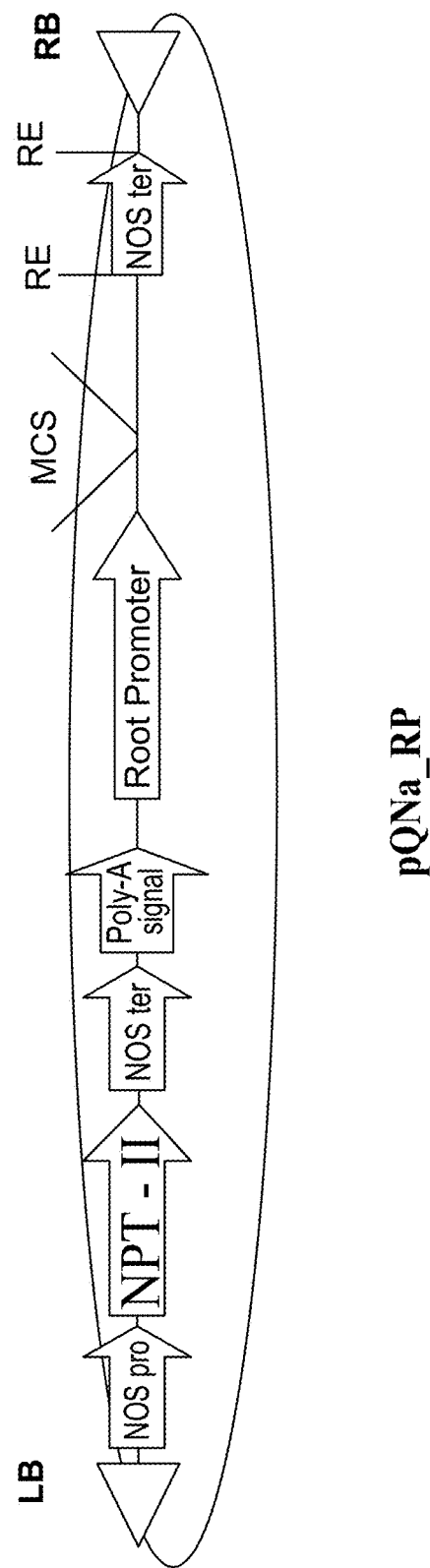
FIG. 4 is a schematic illustration of the modified pGI binary plasmid containing the Root Promoter (pQNa_RP; SEQ ID NO: 10584) used for expressing the isolated polynucleotide sequences of the invention. RB-T-DNA right border; LB-T-DNA left border; NOS pro=nopaline synthase promoter; NPT-II=neomycin phosphotransferase gene; NOS ter=nopaline synthase terminator; Poly-A signal (polyadenylation signal); The isolated polynucleotide sequences according to some embodiments of the invention were cloned into the MCS of the vector.
Figure 5:
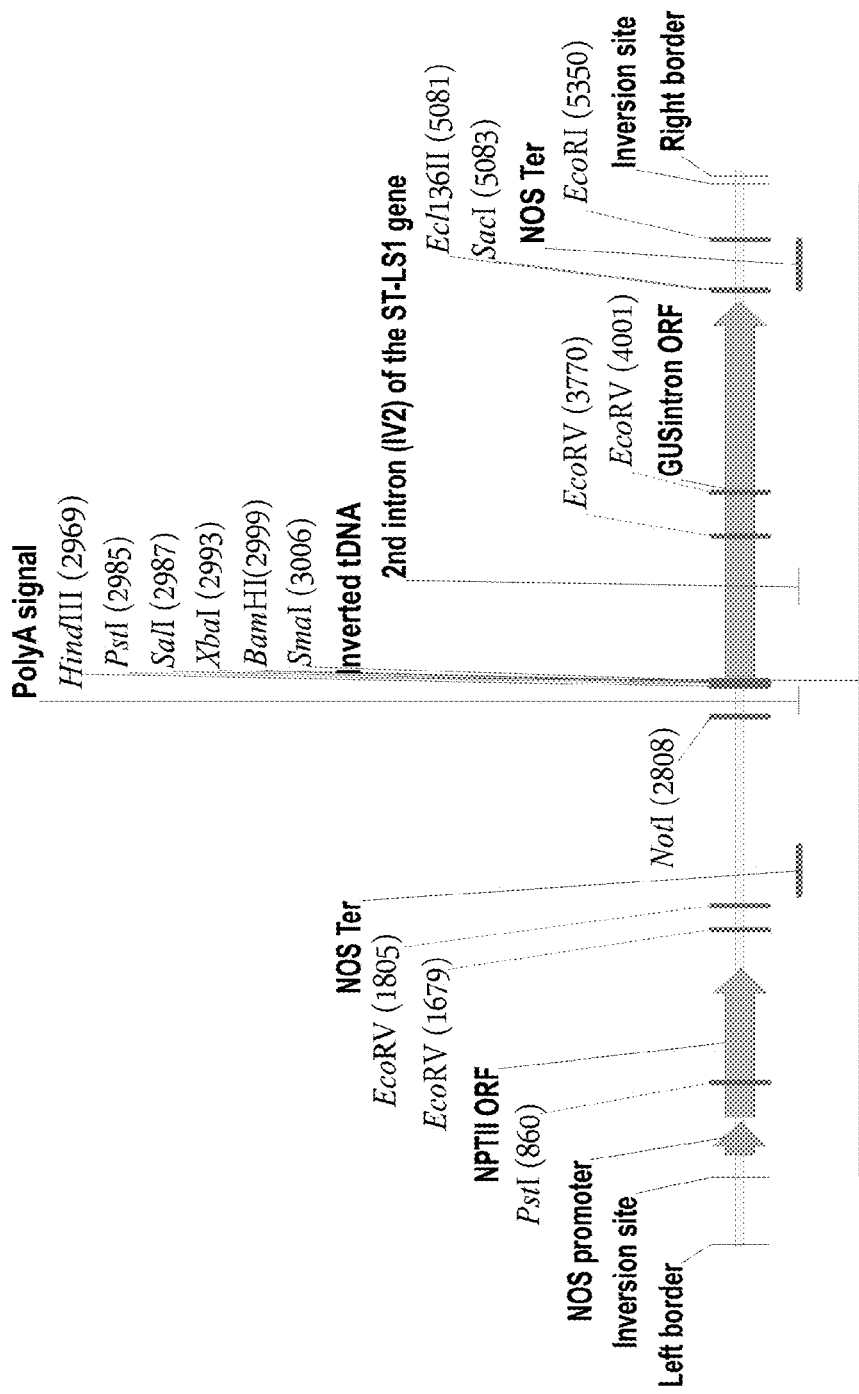
FIG. 5 is a schematic illustration of the pQYN plasmid.
Figure 6:
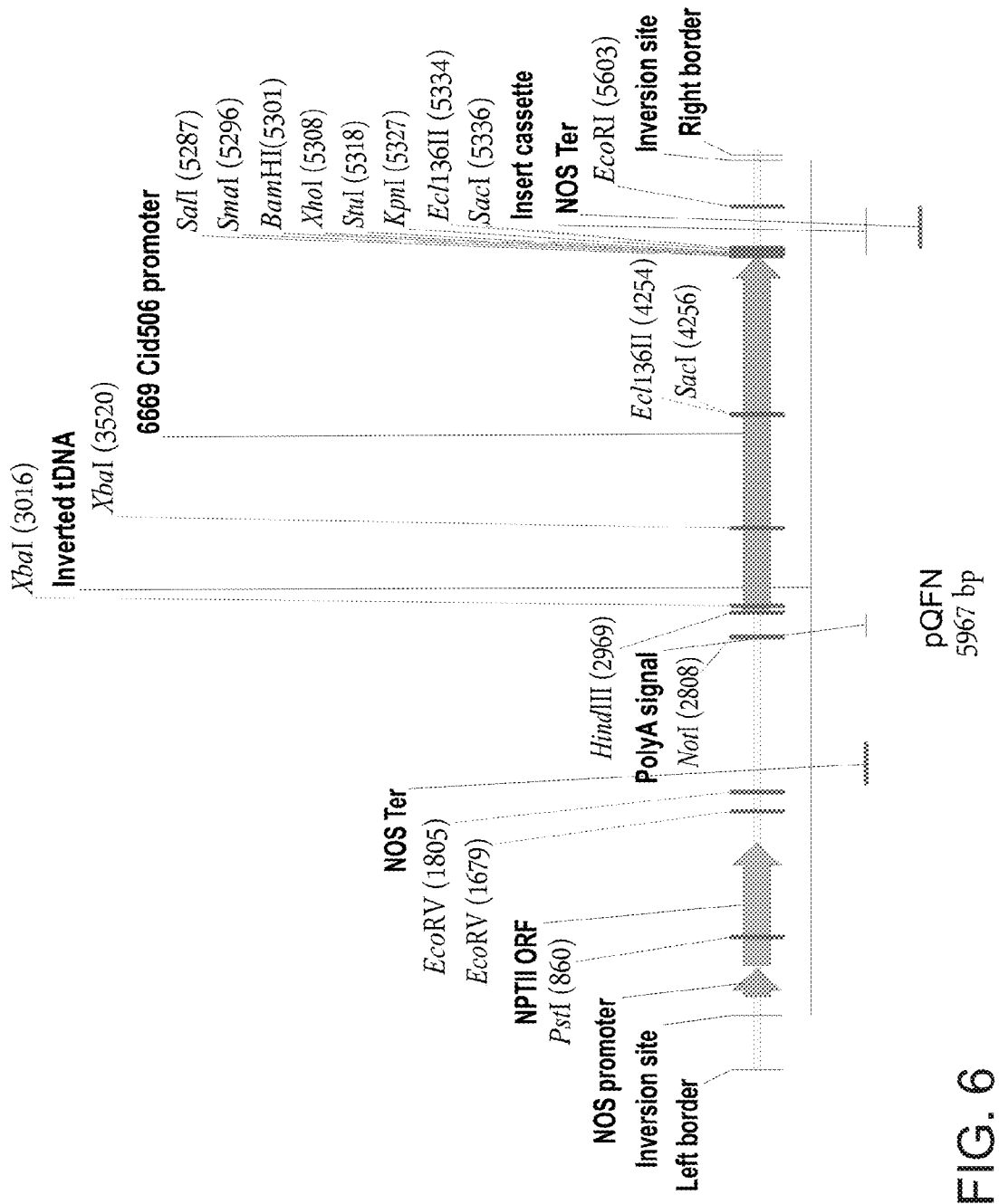
FIG. 6 is a schematic illustration of the pQFN plasmid.
Figure 7:
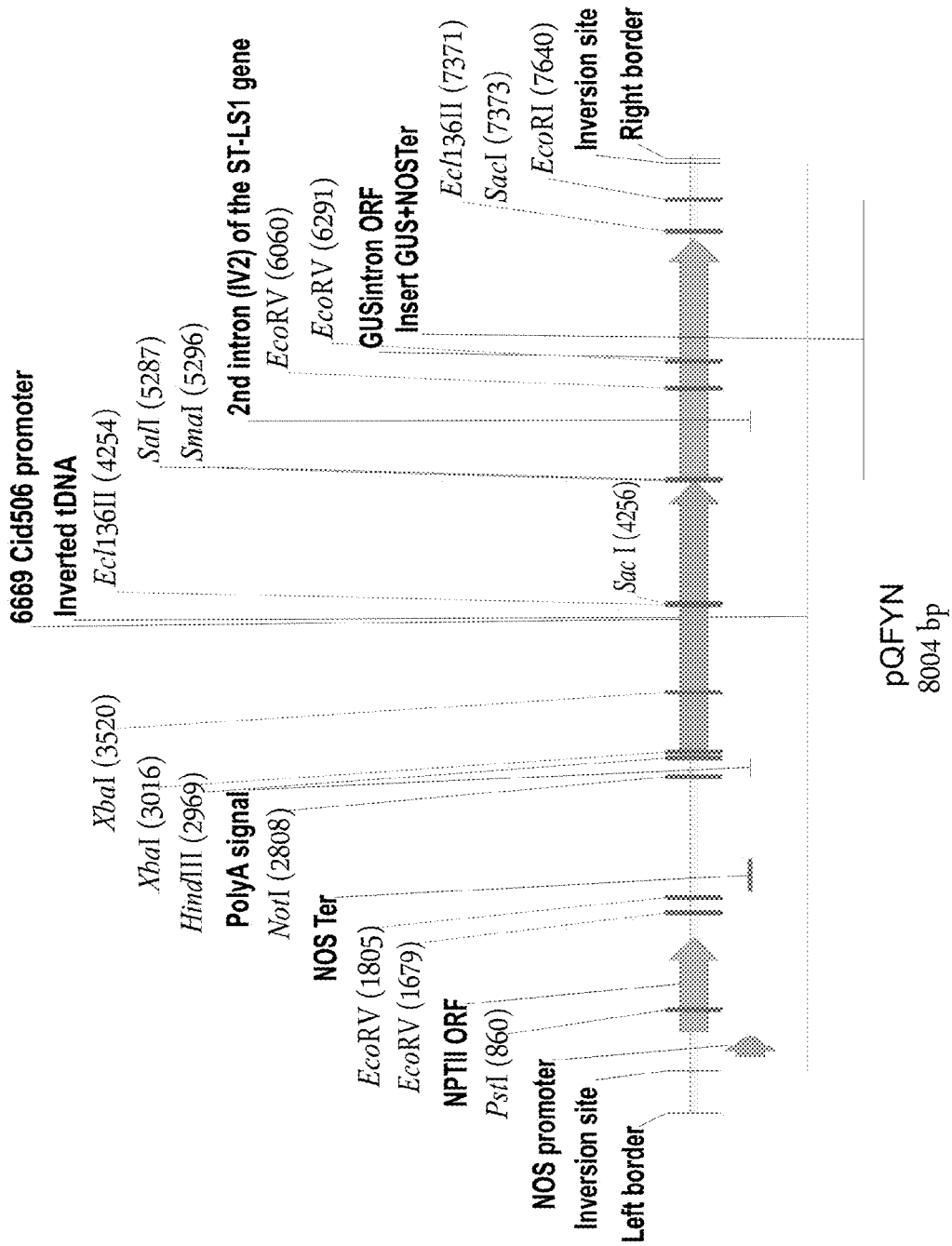
FIG. 7 is a schematic illustration of the pQFYN plasmid.
Figure 8:
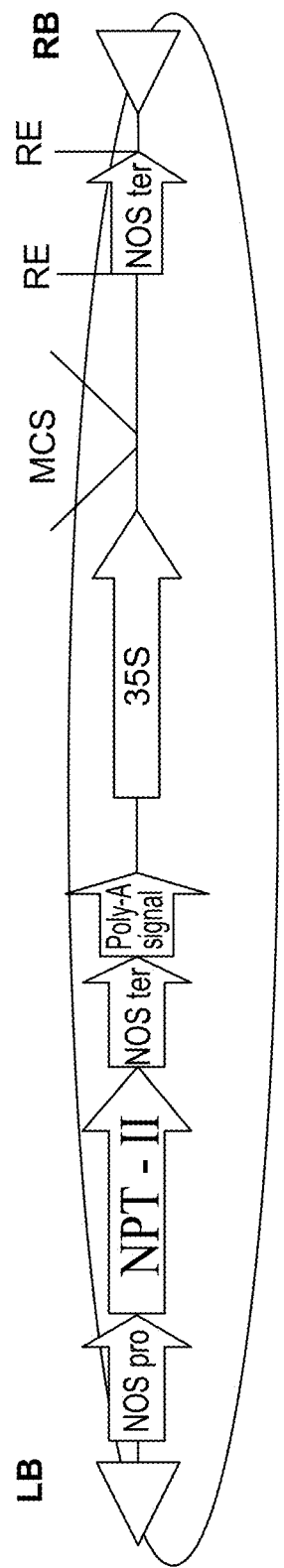
FIG. 8 is a schematic illustration of the modified pGI binary plasmid (pQXNc) used for expressing the isolated polynucleotide sequences of some embodiments of the invention. RB-T-DNA right border; LB-T-DNA left border; NOS pro=nopaline synthase promoter; NPT-II=neomycin phosphotransferase gene; NOS ter=nopaline synthase terminator; RE=any restriction enzyme; Poly-A signal (polyadenylation signal); 35S—the 35S promoter (pqfnc; SEQ ID NO: 10571). The isolated polynucleotide sequences of some embodiments of the invention were cloned into the MCS (Multiple cloning site) of the vector.

Root analysis—During 17 days, the different ecotypes were grown in transparent agar plates. The plates were photographed every 3 days starting at day 7 in the photography room and the roots development was documented (see examples in FIGS. 3A-F). The growth rate of roots was calculated according to Formula V.

Relative growth rate of root coverage=Regression coefficient of root coverage along time course. Formula V:

Vegetative growth rate analysis—was calculated according to Formula VI. The analysis was ended with the appearance of overlapping plants.

Relative vegetative growth rate area=Regression coefficient of vegetative area along time course. Formula VI For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in siliques analysis—On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds average weight—At the end of the experiment all seeds from plots of blocks A-C were collected. An average weight of 0.02 grams was measured from each sample, the seeds were scattered on a glass tray and a picture was taken. Using the digital analysis, the number of seeds in each sample was calculated.

Oil percentage in seeds—At the end of the experiment all seeds from plots of blocks A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for the Low Resonance NMR. The content of oil of all seed samples was determined using the Low Resonance NMR (MARAN Ultra—Oxford Instrument) and its MultiQuant software package.

Silique length analysis—On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetative portion above ground (excluding roots) after drying at 30° C. in a drying chamber; Seed yield per plant=total seed weight per plant (gr).

Oil yield—The oil yield was calculated using Formula VII.

Seed Oil yield=Seed yield per plant(gr.)*Oil % in seed. Formula VII:

Harvest Index (seed)—The harvest index was calculated using Formula IV (described above): Harvest Index=Average seed yield per plant/Average dry weight.

Experimental Results

Nine different *Arabidopsis* ecotypes were grown and characterized for 18 to parameters (named as vectors).

TABLE 10

Arabidopsis correlated parameters (vectors)

| Correlated parameter with | Correlation ID |
|---|---|
| Seeds per silique (number) | 1 |
| Harvest Index (value) | 2 |
| Seed yield per plant (gr) | 3 |
| Dry matter per plant (gr) | 4 |
| Total Leaf Area per plant (cm$^2$) | 5 |
| Oil % per seed (percent) | 6 |
| Oil yield per plant (mg) | 7 |
| Relative root growth (cm/day) in early seedling stages | 8 |
| Root length day 7 (cm) | 9 |
| Root length day 13 (cm) | 10 |
| Fresh weight (gr) (at bolting stage) | 11 |
| 1000 Seed weight (gr) | 12 |

TABLE 10-continued

Arabidopsis correlated parameters (vectors)

| Correlated parameter with | Correlation ID |
|---|---|
| Vegetative growth rate (cm²/day) Until leaves were in overlap | 13 |
| Lamina length (cm) | 14 |
| Lamina width (cm) | 15 |
| Leaf width/length (ratio) | 16 |
| Blade circularity | 17 |
| Silique length (cm) | 18 |

Table 10.
Provided are the Arabidopsis correlated parameters (correlation ID Nos. 1-18). Abbreviations: Cm = centimeter(s); gr = gram(s); 6 mg = milligram(s).

The characterized values are summarized in Tables 11 and 12 below.

Example 5

Production of *Arabidopsis* Transcriptom and High Throughput Correlation Analysis of Normal and Nitrogen Limiting Conditions Using 44K *Arabidopsis* Oligonucleotide Micro-Array In order to produce a high throughput correlation analysis, the present inventors utilized an *Arabidopsis* oligonucleotide micro-array, produced by Agilent Technologies [Hypertext Transfer Protocol://World Wide Web (dot) chem (dot) agilent (dot) com/Scripts/PDS (dot) asp?1Page=50879]. The array oligonucleotide represents about to 44,000 *Arabidopsis* genes and transcripts. To define correlations between the levels of RNA expression with NUE, yield components or vigor related parameters various plant

TABLE 11

Measured parameters in Arabidopsis ecotypes

| Trait | Line-1 | Line-2 | Line-3 | Line-4 | Line-5 | Line-6 | Line-7 | Line-8 | Line-9 |
|---|---|---|---|---|---|---|---|---|---|
| 1 | 45.44 | 53.47 | 58.47 | 35.27 | 48.56 | 37.00 | 39.38 | 40.53 | 25.53 |
| 2 | 0.53 | 0.35 | 0.56 | 0.33 | 0.37 | 0.32 | 0.45 | 0.51 | 0.41 |
| 3 | 0.34 | 0.44 | 0.59 | 0.42 | 0.61 | 0.43 | 0.36 | 0.62 | 0.55 |
| 4 | 0.64 | 1.27 | 1.05 | 1.28 | 1.69 | 1.34 | 0.81 | 1.21 | 1.35 |
| 5 | 46.86 | 109.89 | 58.36 | 56.80 | 114.66 | 110.82 | 88.49 | 121.79 | 93.04 |
| 6 | 34.42 | 31.19 | 38.05 | 27.76 | 35.49 | 32.91 | 31.56 | 30.79 | 34.02 |
| 7 | 118.63 | 138.73 | 224.06 | 116.26 | 218.27 | 142.11 | 114.15 | 190.06 | 187.62 |
| 8 | 0.63 | 0.66 | 1.18 | 1.09 | 0.91 | 0.77 | 0.61 | 0.70 | 0.78 |
| 9 | 0.94 | 1.76 | 0.70 | 0.73 | 0.99 | 1.16 | 1.28 | 1.41 | 1.25 |
| 10 | 4.42 | 8.53 | 5.62 | 4.83 | 5.96 | 6.37 | 5.65 | 7.06 | 7.04 |
| 11 | 1.51 | 3.61 | 1.94 | 2.08 | 3.56 | 4.34 | 3.47 | 3.48 | 3.71 |
| 12 | 0.02 | 0.02 | 0.03 | 0.03 | 0.02 | 0.03 | 0.02 | 0.02 | 0.02 |
| 13 | 0.31 | 0.38 | 0.48 | 0.47 | 0.43 | 0.64 | 0.43 | 0.38 | 0.47 |
| 14 | 2.77 | 3.54 | 3.27 | 3.78 | 3.69 | 4.60 | 3.88 | 3.72 | 4.15 |
| 15 | 1.38 | 1.70 | 1.46 | 1.37 | 1.83 | 1.65 | 1.51 | 1.82 | 1.67 |
| 16 | 0.35 | 0.29 | 0.32 | 0.26 | 0.36 | 0.27 | 0.30 | 0.34 | 0.31 |
| 17 | 0.51 | 0.48 | 0.45 | 0.37 | 0.50 | 0.38 | 0.39 | 0.49 | 0.41 |
| 18 | 1.06 | 1.26 | 1.31 | 1.47 | 1.24 | 1.09 | 1.18 | 1.18 | 1.00 |

Table 11.
Provided are the values of each of the parameters measured in Arabidopsis ecotypes: 3 = Seed yield per plant (gram); 7 = oil yield per plant (mg); 6 = oil % per seed; 12 = 1000 seed weight (gr); 4 = dry matter per plant (gr); 2 = harvest index; 5 = total leaf area per plant (cm²); 1 = seeds per silique; 18 = Silique length (cm); 13 = Vegetative growth rate (cm²/day) Until leaves were in overlap; 8 = relative root growth (cm/day) in early seedling stages; 9 = Root length day 7 (cm); 10 = Root length day 13 (cm); 11 = fresh weight per plant (gr.) at bolting stage; 14. = Lamina length (cm); 15 = Lamina width (cm); 16 = Leaf width/length; 17 = Blade circularity.

TABLE 12

Correlation between the expression level of selected genes of some embodiments of the invention in various tissues and the phenotypic performance under normal conditions across Arabidopsis accessions

| Gene Name | R | P value | Exp. set | Corr. Set ID | Gene Name | R | P value | Exp. set | Corr. Set ID |
|---|---|---|---|---|---|---|---|---|---|
| LYM751 | 0.79 | 3.59E−02 | 2 | 6 | LYM751 | 0.75 | 5.14E−02 | 2 | 8 |
| LYM751 | 0.72 | 4.39E−02 | 5 | 18 | LYM752 | 0.83 | 1.01E−02 | 5 | 4 |
| LYM752 | 0.80 | 1.60E−02 | 5 | 15 | LYM752 | 0.74 | 3.75E−02 | 5 | 3 |
| LYM753 | 0.72 | 4.40E−02 | 5 | 15 | LYM753 | 0.73 | 4.09E−02 | 5 | 3 |
| LYM753 | 0.72 | 4.52E−02 | 5 | 6 | LYM753 | 0.79 | 2.03E−02 | 5 | 7 |
| LYM754 | 0.79 | 1.87E−02 | 1 | 2 | LYM754 | 0.82 | 1.24E−02 | 1 | 6 |

Table 12.
Provided are the correlations (R) between the expression levels of yield improving genes and their homologues in tissues [leaf, flower, seed and root; Expression sets (Exp)] and the phenotypic performance in various yield, biomass, growth rate and/or vigor components [Correlation vector (corr.)] under stress conditions or normal conditions across *Arabidopsis* accessions.
P = p value.

characteristics of 14 different *Arabidopsis* ecotypes were analyzed. Among them, ten ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Two tissues of plants [leaves and stems] growing at two different nitrogen fertilization levels (1.5 mM Nitrogen or 6 mM Nitrogen) were sampled and RNA was extracted as described hereinabove under "GENERAL EXPERIMENTAL AND BIOINFORMATICS METHODS". For convenience, each micro-array expression information tissue type has received a Set ID as summarized in Table 13 below.

TABLE 13

Tissues used for Arabidopsis transcriptom expression sets

| Expression Set | Set ID |
| --- | --- |
| Leaves at 1.5 mM Nitrogen fertilization | 1 |
| Stems at 6 mM Nitrogen fertilization | 2 |
| Leaves at 6 mM Nitrogen fertilization | 3 |
| Stems at 1.5 mM Nitrogen fertilization | 4 |

Table 13:
Provided are the identification (ID) digits of each of the Arabidopsis expression sets.

Assessment of *Arabidopsis* yield components and vigor related parameters under different nitrogen fertilization levels—10 *Arabidopsis* accessions in 2 repetitive plots each containing 8 plants per plot were grown at greenhouse. The growing protocol used was as follows: surface sterilized seeds were sown in Eppendorf tubes containing 0.5×Murashige-Skoog basal salt medium and grown at 23° C. under 12-hour light and 12-hour dark daily cycles for 10 days. Then, seedlings of similar size were carefully transferred to pots filled with a mix of perlite and peat in a 1:1 ratio. Constant nitrogen limiting conditions were achieved by irrigating the plants with a solution containing 1.5 mM inorganic nitrogen in the form of $KNO_3$, supplemented with 2 mM $CaCl_2$, 1.25 mM $KH_2PO_4$, 1.50 mM $MgSO_4$, 5 mM KCl, 0.01 mM $H_3BO_3$ and microelements, while normal irrigation conditions (Normal Nitrogen conditions) was achieved by applying a solution of 6 mM inorganic nitrogen also in the form of $KNO_3$, supplemented with 2 mM $CaCl_2$, 1.25 mM $KH_2PO_4$, 1.50 mM $MgSO_4$, 0.01 mM $H_3BO_3$ and microelements. To follow plant growth, trays were photographed the day nitrogen limiting conditions were initiated and subsequently every 3 days for about 15 additional days. Rosette plant area was then determined from the digital pictures. ImageJ software was used for quantifying the plant size from the digital pictures [Hypertext Transfer Protocol://rsb (dot) info (dot) nih (dot) gov/ij] utilizing proprietary scripts designed to analyze the size of rosette area from individual plants as a function of time. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb(dot)nih(dot) gov/]. Next, analyzed data was saved to text files and processed using the JMP statistical analysis software (SAS institute).

Data parameters collected are summarized in Table 14, hereinbelow.

TABLE 14

Arabidopsis correlated parameters (vectors)

| Correlated parameter with | Correlation ID |
| --- | --- |
| N 6 mM; Seed Yield [gr./plant] | 1 |
| N 6 mM; Harvest Index | 2 |
| N 6 mM; 1000 Seeds weight [gr.] | 3 |
| N 6 mM; seed yield/rosette area day at day 10 [gr./cm$^2$] | 4 |
| N 6 mM; seed yield/leaf blade [gr./cm$^2$] | 5 |
| N 1.5 mM; Rosette Area at day 8 [cm$^2$] | 6 |
| N 1.5 mM; Rosette Area at day 10 [cm$^2$] | 7 |
| N 1.5 mM; Leaf Number at day 10 | 8 |
| N 1.5 mM; Leaf Blade Area at day 10 [cm$^2$] | 9 |
| N 1.5 mM; RGR of Rosette Area at day 3 [cm$^2$/day] | 10 |
| N 1.5 mM; t50 Flowering [day] | 11 |
| N 1.5 mM; Dry Weight [gr./plant] | 12 |
| N 1.5 mM; Seed Yield [gr./plant] | 13 |
| N 1.5 mM; Harvest Index | 14 |
| N 1.5 mM; 1000 Seeds weight [gr.] | 15 |
| N 1.5 mM; seed yield/rosette area at day 10 [gr./cm$^2$] | 16 |
| N 1.5 mM; seed yield/leaf blade [gr./cm$^2$] | 17 |
| N 1.5 mM; % Seed yield reduction compared to N 6 mM | 18 |
| N 1.5 mM; % Biomass reduction compared to N 6 mM | 19 |
| N 6 mM; Rosette Area at day 8 [cm$^2$] | 20 |
| N 6 mM; Rosette Area at day 10 [cm$^2$] | 21 |
| N 6 mM; Leaf Number at day 10 | 22 |
| N 6 mM; Leaf Blade Area at day 10 | 23 |
| N 6 mM; RGR of Rosette Area at day 3 [cm$^2$/gr.] | 24 |
| N 6 mM; t50 Flowering [day] | 25 |
| N 6 mM; Dry Weight [gr./plant] | 26 |
| N 6 mM; N level/DW (SPAD unit/gr. plant) | 27 |
| N 6 mM; DW/N level [gr./SPAD unit] | 28 |
| N 6 mM; N level/FW | 29 |
| N 6 mM; Seed yield/N unit [gr./SPAD unit] | 30 |
| N 1.5 mM; N level/FW [SPAD unit/gr.] | 31 |
| N 1.5 mM; N level/DW [SPAD unit/gr.] | 32 |
| N 1.5 mM; DW/N level [gr/SPAD unit] | 33 |
| N 1.5 mM; seed yield/N level [gr/SPAD unit] | 34 |

Table 14.
Provided are the Arabidopsis correlated parameters (vectors). "N" = Nitrogen at the noted concentrations; "gr." = grams; "SPAD" = chlorophyll levels; "t50" = time where 50% of plants flowered; "gr./SPAD unit" = plant biomass expressed in grams per unit of nitrogen in plant measured by SPAD. "DW" = Plant Dry Weight; "FW" = Plant Fresh weight; "N level/DW" = plant Nitrogen level measured in SPAD unit per plant biomass [gr.]; "DW/N level" = plant biomass per plant [gr.]/SPAD unit; Rosette Area (measured using digital analysis); Plot Coverage at the indicated day [%](calculated by the dividing the total plant area with the total plot area); Leaf Blade Area at the indicated day [cm$^2$] (measured using digital analysis); RGR (relative growth rate) of Rosette Area at the indicated day [cm$^2$/day]; t50 Flowering [day[ (the day in which 50% of plant flower); seed yield/rosette area at day 10 [gr/cm$^2$] (calculated); seed yield/leaf blade [gr/cm$^2$] (calculated); seed yield/N level [gr/SPAD unit] (calculated).

Assessment of NUE, yield components and vigor-related parameters—Ten *Arabidopsis* ecotypes were grown in trays, each containing 8 plants per plot, in a greenhouse with controlled temperature conditions for about 12 weeks. Plants were irrigated with different nitrogen concentration as described above depending on the treatment applied. During this time, data was collected documented and analyzed. Most of chosen parameters were analyzed by digital imaging.

Digital Imaging—Greenhouse Assay

An image acquisition system, which consists of a digital reflex camera (Canon EOS 400D) attached with a 55 mm focal length lens (Canon EF-S series) placed in a custom made Aluminum mount, was used for capturing images of plants planted in containers within an environmental controlled greenhouse. The image capturing process is repeated every 2-3 days starting at day 9-12 till day 16-19 (respectively) from transplanting.

The image processing system which was used is described in Example 4 above. Images were captured in resolution of 10 Mega Pixels (3888×2592 pixels) and stored in a low compression JPEG (Joint Photographic Experts Group standard) format. Next, image processing output data was saved to text files and analyzed using the JMP statistical analysis software (SAS institute).

Leaf analysis—Using the digital analysis leaves data was calculated, including leaf number, leaf blade area, plot coverage, Rosette diameter and Rosette area.

Relative growth rate area: The relative growth rate area of the rosette and the leaves was calculated according to Formulas VIII and IX, respectively.

Relative growth rate of rosette area=Regression coefficient of rosette area along time course.    Formula VIII:

Relative growth rate of plant leaf number=Regression coefficient of plant leaf number along time course.    Formula IX Seed yield and 1000 seeds weight—At the end of the experiment all seeds from all plots were collected and weighed in order to measure seed yield per plant in terms of total seed weight per plant (gr.). For the calculation of 1000 seed weight, an average weight of 0.02 grams was measured from each sample, the seeds were scattered on a glass tray and a picture was taken. Using the digital analysis, the number of seeds in each sample was calculated.

Dry weight and seed yield—At the end of the experiment, plant were harvested and left to dry at 30° C. in a drying chamber. The biomass was separated from the seeds, weighed and divided by the number of plants. Dry weight=total weight of the vegetative portion above ground (excluding roots) after drying at 30° C. in a drying chamber.

Harvest Index (seed)—The harvest index was calculated using Formula IV as described above [Harvest Index=Average seed yield per plant/Average dry weight].

$T_{50}$ days to flowering—Each of the repeats was monitored for flowering date. Days of flowering was calculated from sowing date till 50% of the plots flowered.

Plant nitrogen level—The chlorophyll content of leaves is a good indicator of the nitrogen plant status since the degree of leaf greenness is highly correlated to this parameter. Chlorophyll content was determined using a Minolta SPAD 502 chlorophyll meter and measurement was performed at time of flowering. SPAD meter readings were done on young fully developed leaf. Three measurements per leaf were taken per plot. Based on this measurement, parameters such as the ratio between seed yield per nitrogen unit [seed yield/N level=seed yield per plant [gr.]/SPAD unit], plant DW per nitrogen unit [DW/N level=plant biomass per plant [gr.]/SPAD unit], and nitrogen level per gram of biomass [N level/DW=SPAD unit/plant biomass per plant (gr.)] were calculated.

Percent of seed yield reduction—measures the amount of seeds obtained in plants when grown under nitrogen-limiting conditions compared to seed yield produced at normal nitrogen levels expressed in percentages (%).

Experimental Results 10 different *Arabidopsis* accessions (ecotypes) were grown and characterized for 34 parameters as described above. The average for each of the measured parameters was calculated using the JMP software (Table 15 below). Subsequent correlation analysis between the various transcriptom sets (Table 13) and the average parameters were conducted.

TABLE 15

Measured parameters in Arabidopsis accessions

| Ecotype | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 0.12 | 0.17 | 0.11 | 0.08 | 0.12 | 0.14 | 0.11 | 0.14 | 0.09 | 0.07 |
| 2 | 0.28 | 0.31 | 0.28 | 0.16 | 0.21 | 0.28 | 0.17 | 0.21 | 0.17 | 0.14 |
| 3 | 0.01 | 0.02 | 0.02 | 0.01 | 0.02 | 0.02 | 0.01 | 0.02 | 0.02 | 0.02 |
| 4 | 0.08 | 0.11 | 0.04 | 0.03 | 0.06 | 0.06 | 0.06 | 0.05 | 0.06 | 0.03 |
| 5 | 0.34 | 0.53 | 0.21 | 0.18 | 0.28 | 0.28 | 0.25 | 0.27 | 0.24 | 0.16 |
| 6 | 0.76 | 0.71 | 1.06 | 1.16 | 1.00 | 0.91 | 0.94 | 1.12 | 0.64 | 1.00 |
| 7 | 1.43 | 1.33 | 1.77 | 1.97 | 1.83 | 1.82 | 1.64 | 2.00 | 1.15 | 1.75 |
| 8 | 6.88 | 7.31 | 7.31 | 7.88 | 7.75 | 7.63 | 7.19 | 8.63 | 5.93 | 7.94 |
| 9 | 0.33 | 0.27 | 0.37 | 0.39 | 0.37 | 0.39 | 0.35 | 0.38 | 0.31 | 0.37 |
| 10 | 0.63 | 0.79 | 0.50 | 0.49 | 0.72 | 0.83 | 0.65 | 0.67 | 0.64 | 0.61 |
| 11 | 15.97 | 20.97 | 14.84 | 24.71 | 23.70 | 18.06 | 19.49 | 23.57 | 21.89 | 23.57 |
| 12 | 0.16 | 0.12 | 0.08 | 0.11 | 0.12 | 0.13 | 0.11 | 0.15 | 0.17 | 0.18 |
| 13 | 0.03 | 0.03 | 0.02 | 0.01 | 0.01 | 0.03 | 0.02 | 0.01 | 0.01 | 0.01 |
| 14 | 0.19 | 0.20 | 0.29 | 0.08 | 0.07 | 0.24 | 0.18 | 0.08 | 0.08 | 0.03 |
| 15 | 0.02 | 0.02 | 0.02 | 0.01 | 0.02 | 0.01 | 0.01 | 0.02 | 0.02 | 0.02 |
| 16 | 0.02 | 0.02 | 0.01 | 0.01 | 0.00 | 0.02 | 0.01 | 0.01 | 0.01 | 0.00 |
| 17 | 0.09 | 0.09 | 0.06 | 0.03 | 0.02 | 0.08 | 0.06 | 0.03 | 0.04 | 0.01 |
| 18 | 72.56 | 84.70 | 78.78 | 88.00 | 92.62 | 76.71 | 81.94 | 91.30 | 85.76 | 91.82 |
| 19 | 60.75 | 76.71 | 78.56 | 78.14 | 78.64 | 73.19 | 83.07 | 77.19 | 70.12 | 62.97 |
| 20 | 0.76 | 0.86 | 1.48 | 1.28 | 1.10 | 1.24 | 1.09 | 1.41 | 0.89 | 1.22 |
| 21 | 1.41 | 1.57 | 2.67 | 2.42 | 2.14 | 2.47 | 1.97 | 2.72 | 1.64 | 2.21 |
| 22 | 6.25 | 7.31 | 8.06 | 8.75 | 8.75 | 8.38 | 7.13 | 9.44 | 6.31 | 8.06 |
| 23 | 0.34 | 0.31 | 0.52 | 0.45 | 0.43 | 0.50 | 0.43 | 0.51 | 0.41 | 0.43 |
| 24 | 0.69 | 1.02 | 0.61 | 0.60 | 0.65 | 0.68 | 0.58 | 0.61 | 0.52 | 0.48 |
| 25 | 16.37 | 20.50 | 14.63 | 24.00 | 23.60 | 15.03 | 19.75 | 22.89 | 18.80 | 23.38 |
| 26 | 0.42 | 0.53 | 0.38 | 0.52 | 0.58 | 0.50 | 0.63 | 0.65 | 0.57 | 0.50 |
| 27 | 22.49 | | | 28.27 | | 33.32 | | | 39.00 | 17.64 |
| 28 | 0.02 | | | 0.02 | | 0.02 | | | 0.01 | 0.03 |
| 29 | 53.71 | | | 54.62 | | 66.48 | | | 68.05 | 35.55 |
| 30 | 0.00 | | | 0.00 | | 0.01 | | | 0.00 | 0.00 |
| 31 | 45.59 | | | 42.11 | | 53.11 | | | 67.00 | 28.15 |
| 32 | 167.30 | | | 241.06 | | 194.98 | | | 169.34 | 157.82 |
| 33 | 0.01 | | | 0.00 | | 0.01 | | | 0.01 | 0.01 |
| 34 | 0.00 | | | 0.00 | | 0.00 | | | 0.00 | 0.00 |

Table 15.
Provided are the measured parameters under various treatments in various ecotypes (Arabidopsis accessions).

TABLE 16

Correlation between the expression level of selected genes of some embodiments of the invention in various tissues and the phenotypic performance under normal or abiotic stress conditions across Arabidopsis accessions

| Gene Name | R | P value | Exp. set | Corr. Set ID | Gene Name | R | P value | Exp. set | Corr. Set ID |
|---|---|---|---|---|---|---|---|---|---|
| LYM751 | 0.80 | 5.02E−03 | 3 | 3 | LYM753 | 0.77 | 9.85E−03 | 1 | 11 |
| LYM753 | 0.72 | 1.95E−02 | 1 | 26 | LYM753 | 0.75 | 1.21E−02 | 4 | 11 |
| LYM753 | 0.71 | 2.04E−02 | 4 | 25 | | | | | |

Table 16.
Provided are the correlations (R) between the expression levels of yield improving genes and their homologues in tissues [Leaves or stems; Expression sets (Exp)] and the phenotypic performance in various yield, biomass, growth rate and/or vigor components [Correlation vector (corr.)] under stress conditions or normal conditions across Arabidopsis accessions.
P = p value.

Example 6

Production of Sorghum Transcriptom and High Throughput Correlation Analysis with ABST Related Parameters Using 44K Sorghum Oligonucleotide Micro-Arrays In order to produce a high throughput correlation analysis between plant phenotype and gene expression level, the present inventors utilized a sorghum oligonucleotide microarray, produced by Agilent Technologies [Hypertext Transfer Protocol://World Wide Web (dot) chem. (dot) agilent (dot) com/Scripts/PDS (dot) asp?lPage=50879]. The array oligonucleotide represents about 44,000 sorghum genes and transcripts. In order to define correlations between the levels of RNA expression with ABST, yield and NUE components or vigor related parameters, various plant characteristics of 17 different sorghum hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

I. Correlation of Sorghum Varieties Across Ecotypes Grown Under Regular Growth Conditions, Severe Drought Conditions and Low Nitrogen Conditions Experimental Procedures 17 Sorghum varieties were grown in 3 repetitive plots, in field. Briefly, the growing protocol was as follows:

1. Regular growth conditions: sorghum plants were grown in the field using commercial fertilization and irrigation protocols (370 liter per meter, fertilization of 14 units of 21% urea per entire growth period).

2. Drought conditions: sorghum seeds were sown in soil and grown under normal condition until around 35 days from sowing, around stage V8 (eight green leaves are fully expanded, booting not started yet). At this point, irrigation was stopped, and severe drought stress was developed.

3. Low Nitrogen fertilization conditions: sorghum plants were fertilized with 50% less amount of nitrogen in the field than the amount of nitrogen applied in the regular growth treatment. All the fertilizer was applied before flowering.

Analyzed Sorghum tissues—All 10 selected Sorghum hybrids were sample per each treatment. Tissues [Flag leaf, Flower meristem and Flower] from plants growing under normal conditions, severe drought stress and low nitrogen conditions were sampled and RNA was extracted as described above. Each micro-array expression information tissue type has received a Set ID as summarized in Table 17 below.

TABLE 17

Sorghum transcriptom expression sets

| Expression Set | Set ID |
|---|---|
| Flag leaf Normal conditions | 3 |
| Flower meristem Normal conditions | 6 |
| Flower Normal conditions | 9 |
| Flag leaf Nitrogen-limiting conditions | 2 |
| Flower meristem Nitrogen-limiting conditions | 5 |
| Flower Nitrogen-limiting conditions | 8 |
| Flag leaf Drought | 1 |
| Flower meristem Drought | 4 |
| Flower Drought | 7 |

Table 17:
Provided are the sorghum transcriptom expression sets 1-9. Flag leaf = the leaf below the flower; Flower meristem = Apical meristem following panicle initiation; Flower = the flower at the anthesis day. Expression sets 3, 6, and 9 are from plants grown under normal conditions; Expression sets 2, 5 and 8 are from plants grown under Nitrogen-limiting conditions; Expression sets 1, 4 and 7 are from plants grown under drought conditions.

The following parameters were collected using digital imaging system:

At the end of the growing period the grains were separated from the Plant 'Head' and the following parameters were measured and collected:

Average Grain Area ($cm^2$)—A sample of ~200 grains were weight, photographed and images were processed using the below described image processing system. The grain area was measured from those images and was divided by the number of grains.

Upper and Lower Ratio Average of Grain Area, width, diameter and perimeter—Grain projection of area, width, diameter and perimeter were extracted from the digital images using open source package imagej (nih). Seed data was analyzed in plot average levels as follows:

Average of all seeds.

Average of upper 20% fraction—contained upper 20% fraction of seeds.

Average of lower 20% fraction—contained lower 20% fraction of seeds.

Further on, ratio between each fraction and the plot average was calculated for each of the data parameters.

At the end of the growing period 5 'Heads' were, photographed and images were processed using the below described image processing system.

(i) Head Average Area ($cm^2$)—At the end of the growing period 5 'Heads' were, photographed and images were processed using the below described image processing system. The 'Head' area was measured from those images and was divided by the number of 'Heads'.

(ii) Head Average Length (cm)—At the end of the growing period 5 'Heads' to were, photographed and images were processed using the below described image processing system. The 'Head' length (longest axis) was measured from those images and was divided by the number of 'Heads'.

(iii) Head Average width (cm)—At the end of the growing period 5 'Heads' were, photographed and images were processed using the below described image processing system. The 'Head' width was measured from those images and was divided by the number of 'Heads'.

(iv) Head Average width (cm)—At the end of the growing period 5 'Heads' were, photographed and images were processed using the below described image processing system. The 'Head' perimeter was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S, National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight/Head (gr.) (grain yield)—At the end of the experiment (plant 'Heads') heads from plots within blocks A-C were collected. 5 heads were separately threshed and grains were weighted, all additional heads were threshed together and weighted as well. The average grain weight per head was calculated by dividing the total grain weight by number of total heads per plot (based on plot). In case of 5 heads, the total grains weight of 5 heads was divided by 5.

FW Head/Plant gram—At the end of the experiment (when heads were harvested) total and 5 selected heads per plots within blocks A-C were collected separately. The heads (total and 5) were weighted (gr.) separately and the average fresh weight per plant was calculated for total (FW Head/Plant gr. based on plot) and for 5 (FW Head/Plant gr. based on 5 plants).

Plant height—Plants were characterized for height during growing period at 5 time points. In each measure, plants were measured for their height using a measuring tape. Height was measured from ground level to top of the longest leaf.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot.

Vegetative fresh weight and Heads—At the end of the experiment (when Inflorescence were dry) all Inflorescence and vegetative material from plots within blocks A-C were collected. The biomass and Heads weight of each plot was separated, measured and divided by the number of Heads.

Plant biomass (Fresh weight)—At the end of the experiment (when Inflorescence were dry) the vegetative material from plots within blocks A-C were collected. The plants biomass without the Inflorescence were measured and divided by the number of Plants.

FW Heads/(FW Heads+FW Plants)—The total fresh weight of heads and their respective plant biomass were measured at the harvest day. The heads weight was divided by the sum of weights of heads and plants.

Experimental Results 17 different *sorghum* varieties were grown and characterized for different parameters: The average for each of the measured parameter was calculated using the JMP software (Tables 19-20) and a subsequent correlation analysis between the various transcriptom sets (Table 17) and the average parameters, was conducted (Table 21). Results were then integrated to the database.

TABLE 18

Sorghum correlated parameters (vectors)

| Correlated parameter with | Correlation ID |
|---|---|
| Total grain weight/Head (gr.) (based on plot), Drought | 1 |
| Head Average Area (cm²), Drought | 2 |
| Head Average Perimeter (cm), Drought | 3 |
| Head Average Length (cm), Drought | 4 |
| Head Average Width (cm), Drought | 5 |
| Average Grain Area (cm²), Drought | 6 |
| Upper Ratio Average Grain Area, Drought (value) | 7 |
| Final Plant Height (cm), Drought | 8 |
| FW – Head/Plant (gr) (based on plot), Drought | 9 |
| FW/Plant (gr) (based on plot), Drought | 10 |
| Leaf SPAD 64 DPS (Days Post Sowing), Drought | 11 |
| FW Heads/(FW Heads + FW Plants)(all plot), Drought | 12 |
| [Plant biomass (FW)/SPAD 64 DPS] (gr) Drought | 13 |
| Total grain weight/Head (gr.) (based on plot), Normal | 14 |
| Total grain weight/Head (gr.) (based on 5 heads), Normal | 15 |
| Head Average Area (cm²), Normal | 16 |
| Head Average Perimeter (cm), Normal | 17 |
| Head Average Length (cm), Normal | 18 |
| Head Average Width (cm), Normal | 19 |
| Average Grain Area (cm²), Normal | 20 |
| Upper Ratio Average Grain Area (value), Normal | 21 |
| Lower Ratio Average Grain Area (value), Normal | 22 |
| Lower Ratio Average Grain Perimeter, (value) Normal | 23 |
| Lower Ratio Average Grain Length (value), Normal | 24 |
| Lower Ratio Average Grain Width (value), Normal | 25 |
| Final Plant Height (cm), Normal | 26 |
| FW – Head/Plant (gr.) (based on 5 plants), Normal | 27 |
| FW – Head/Plant (gr.) (based on plot), Normal | 28 |
| FW/Plant (gr.) (based on plot), Normal | 29 |
| Leaf SPAD 64 DPS (Days Post Sowing), Normal | 30 |
| FW Heads/(FW Heads + FW Plants) (all plot), Normal | 31 |
| [Plant biomass (FW)/SPAD 64 DPS] (gr.), Normal | 32 |
| [Grain Yield + plant biomass/SPAD 64 DPS] (gr.), Normal | 33 |
| [Grain yield/SPAD 64 DPS] (gr.), Normal | 34 |
| Total grain weight/Head (based on plot) (gr.), Low N | 35 |
| Total grain weight/Head (gr.) (based on 5 heads), Low N | 36 |
| Head Average Area (cm²), Low N | 37 |
| Head Average Perimeter (cm), Low N | 38 |
| Head Average Length (cm), Low N | 39 |
| Head Average Width (cm), Low N | 40 |
| Average Grain Area (cm²), Low N | 41 |
| Upper Ratio Average Grain Area (value), Low N | 42 |
| Lower Ratio Average Grain Area (value), Low N | 43 |
| Lower Ratio Average Grain Perimeter (value), Low N | 44 |
| Lower Ratio Average Grain Length (value), Low N | 45 |
| Lower Ratio Average Grain Width (value), Low N | 46 |
| Final Plant Height (cm), Low N | 47 |
| FW – Head/Plant (gr.) (based on 5 plants), Low N | 48 |
| FW – Head/Plant (gr.) (based on plot), Low N | 49 |
| FW/Plant (gr.) (based on plot), Low N | 50 |
| Leaf SPAD 64 DPS (Days Post Sowing), Low N | 51 |
| FW Heads/(FW Heads + FW Plants)(all plot), Low N | 52 |
| [Plant biomass (FW)/SPAD 64 DPS] (gr.), Low N | 53 |
| [Grain Yield + plant biomass/SPAD 64 DPS] (gr.), Low N | 54 |
| [Grain yield/SPAD 64 DPS] (gr.), Low N | 55 |

Table 18.
Provided are the Sorghum correlated parameters (vectors). "gr." = grams; "SPAD" = chlorophyll levels; "FW" = Plant Fresh weight; "normal" = standard growth conditions.

TABLE 19

Measured parameters in Sorghum accessions

| Ecotype | Line-1 | Line-2 | Line-3 | Line-4 | Line-5 | Line-6 | Line-7 | Line-8 | Line-9 |
|---|---|---|---|---|---|---|---|---|---|
| 1 | 22.11 | 16.77 | 9.19 | 104.44 | 3.24 | 22.00 | 9.97 | 18.58 | 29.27 |
| 2 | 83.14 | 107.79 | 88.68 | 135.91 | 90.76 | 123.95 | 86.06 | 85.20 | 113.10 |
| 3 | 52.78 | 64.49 | 56.59 | 64.37 | 53.21 | 71.66 | 55.61 | 52.96 | 69.83 |
| 4 | 21.63 | 21.94 | 21.57 | 22.01 | 20.99 | 28.60 | 21.35 | 20.81 | 24.68 |
| 5 | 4.83 | 6.31 | 5.16 | 7.78 | 5.28 | 5.49 | 5.04 | 5.07 | 5.77 |
| 6 | 0.10 | 0.11 | 0.11 | 0.09 | 0.09 | 0.11 | | | |
| 7 | 1.31 | 1.19 | 1.29 | 1.46 | 1.21 | 1.21 | | | |
| 8 | 89.40 | 75.73 | 92.10 | 94.30 | 150.80 | 110.73 | 99.20 | 84.00 | 99.00 |
| 9 | 154.90 | 122.02 | 130.51 | 241.11 | 69.03 | 186.41 | 62.11 | 39.02 | 58.94 |
| 10 | 207.99 | 138.02 | 255.41 | 402.22 | 233.55 | 391.75 | 89.31 | 50.61 | 87.02 |
| 11 | 40.58 | 40.88 | 45.01 | 42.30 | 45.24 | 40.56 | 44.80 | 45.07 | 40.65 |
| 12 | 0.42 | 0.47 | 0.42 | 0.37 | 0.23 | 0.31 | 0.41 | 0.44 | 0.40 |
| 13 | 5.13 | 3.38 | 5.67 | 9.51 | 5.16 | 9.66 | 1.99 | 1.12 | 2.14 |
| 14 | 31.12 | 26.35 | 18.72 | 38.38 | 26.67 | 28.84 | 47.67 | 31.00 | 39.99 |
| 15 | 47.40 | 46.30 | 28.37 | 70.40 | 32.15 | 49.23 | 63.45 | 44.45 | 56.65 |
| 16 | 120.14 | 167.60 | 85.14 | 157.26 | 104.00 | 102.48 | 168.54 | 109.32 | 135.13 |
| 17 | 61.22 | 67.90 | 56.26 | 65.38 | 67.46 | 67.46 | 74.35 | 56.16 | 61.64 |
| 18 | 25.58 | 26.84 | 21.02 | 26.84 | 23.14 | 21.82 | 31.33 | 23.18 | 25.70 |
| 19 | 5.97 | 7.92 | 4.87 | 7.43 | 5.58 | 5.88 | 6.78 | 5.99 | 6.62 |
| 20 | 0.10 | 0.11 | 0.13 | 0.13 | 0.14 | 0.14 | 0.11 | 0.11 | 0.10 |
| 21 | 1.22 | 1.30 | 1.13 | 1.14 | 1.16 | 1.15 | 1.19 | 1.23 | 1.25 |
| 22 | 0.83 | 0.74 | 0.78 | 0.80 | 0.70 | 0.70 | 0.83 | 0.81 | 0.84 |
| 23 | 0.91 | 0.87 | 0.91 | 0.95 | 0.90 | 0.91 | 0.91 | 0.91 | 0.92 |
| 24 | 0.91 | 0.88 | 0.92 | 0.91 | 0.89 | 0.88 | 0.91 | 0.90 | 0.92 |
| 25 | 0.91 | 0.83 | 0.85 | 0.87 | 0.79 | 0.80 | 0.90 | 0.89 | 0.91 |
| 26 | 95.25 | 79.20 | 197.85 | 234.20 | 189.40 | 194.67 | 117.25 | 92.80 | 112.65 |
| 27 | 406.50 | 518.00 | 148.00 | 423.00 | 92.00 | 101.33 | 423.50 | 386.50 | 409.50 |
| 28 | 175.15 | 223.49 | 56.40 | 111.62 | 67.34 | 66.90 | 126.18 | 107.74 | 123.86 |
| 29 | 162.56 | 212.59 | 334.83 | 313.46 | 462.28 | 318.26 | 151.13 | 137.60 | 167.98 |
| 30 | 43.01 | . | 43.26 | 44.74 | 45.76 | 41.61 | 45.21 | 45.14 | 43.03 |
| 31 | 0.51 | 0.51 | 0.12 | 0.26 | 0.12 | 0.18 | 0.46 | 0.43 | 0.42 |
| 32 | 0.72 | 0.43 | 0.86 | 0.58 | 0.69 | 1.05 | 0.69 | 0.93 | 0.84 |
| 33 | 4.50 | 8.17 | 7.87 | 10.68 | 8.34 | 4.40 | 3.74 | 4.83 | 3.67 |
| 34 | 3.78 | 7.74 | 7.01 | 10.10 | 7.65 | 3.34 | 3.05 | 3.90 | 2.83 |
| 35 | 25.95 | 30.57 | 19.37 | 35.62 | 25.18 | 22.18 | 49.96 | 27.48 | 51.12 |
| 36 | 50.27 | 50.93 | 36.13 | 73.10 | 37.87 | 36.40 | 71.67 | 35.00 | 76.73 |
| 37 | 96.24 | 214.72 | 98.59 | 182.83 | 119.64 | 110.19 | 172.36 | 84.81 | 156.25 |
| 38 | 56.32 | 79.20 | 53.25 | 76.21 | 67.27 | 59.49 | 79.28 | 51.52 | 69.88 |
| 39 | 23.22 | 25.58 | 20.93 | 28.43 | 24.32 | 22.63 | 32.11 | 20.38 | 26.69 |
| 40 | 5.26 | 10.41 | 5.93 | 8.25 | 6.19 | 6.12 | 6.80 | 5.25 | 7.52 |
| 41 | 0.11 | 0.11 | 0.14 | 0.12 | 0.14 | 0.13 | 0.12 | 0.12 | 0.12 |
| 42 | 1.18 | 1.31 | 1.11 | 1.21 | 1.19 | 1.18 | 1.16 | 1.23 | 1.17 |
| 43 | 0.82 | 0.77 | 0.81 | 0.79 | 0.78 | 0.80 | 0.83 | 0.79 | 0.81 |
| 44 | 0.90 | 0.88 | 0.92 | 0.90 | 0.92 | 0.92 | 0.92 | 0.89 | 0.90 |
| 45 | 0.91 | 0.90 | 0.92 | 0.90 | 0.91 | 0.93 | 0.92 | 0.89 | 0.90 |
| 46 | 0.90 | 0.85 | 0.89 | 0.88 | 0.86 | 0.87 | 0.91 | 0.89 | 0.90 |
| 47 | 104.00 | 80.93 | 204.73 | 125.40 | 225.40 | 208.07 | 121.40 | 100.27 | 121.13 |
| 48 | 388.00 | 428.67 | 297.67 | 280.00 | 208.33 | 303.67 | 436.00 | 376.33 | 474.67 |
| 49 | 214.78 | 205.05 | 73.49 | 122.96 | 153.07 | 93.23 | 134.11 | 77.43 | 129.63 |
| 50 | 204.78 | 199.64 | 340.51 | 240.60 | 537.78 | 359.40 | 149.20 | 129.06 | 178.71 |
| 51 | 38.33 | 38.98 | 42.33 | 40.90 | 43.15 | 39.85 | 42.68 | 43.31 | 39.01 |
| 52 | 0.51 | 0.51 | 0.17 | 0.39 | 0.21 | 0.19 | 0.48 | 0.37 | 0.42 |
| 53 | 5.34 | 5.12 | 8.05 | 5.88 | 12.46 | 9.02 | 3.50 | 2.98 | 4.58 |
| 54 | 6.02 | 5.91 | 8.50 | 6.75 | 13.05 | 9.58 | 4.67 | 3.61 | 5.89 |
| 55 | 0.68 | 0.78 | 0.46 | 0.87 | 0.58 | 0.56 | 1.17 | 0.63 | 1.31 |

Table 19:
Provided are the values of each of the parameters (as described above) measured in Sorghum accessions (ecotype) under normal, low nitrogen and drought conditions. Growth conditions are specified in the experimental procedure section.

TABLE 20

Additional measured parameters in Sorghum accessions

| Ecotype | Line-10 | Line-11 | Line-12 | Line-13 | Line-14 | Line-15 | Line-16 | Line-17 |
|---|---|---|---|---|---|---|---|---|
| 1 | 10.45 | 14.77 | 12.86 | 18.24 | 11.60 | 18.65 | 16.36 | |
| 2 | 100.79 | 80.41 | 126.89 | 86.41 | 92.29 | 77.89 | 76.93 | |
| 3 | 65.14 | 55.27 | 69.06 | 53.32 | 56.29 | 49.12 | 51.88 | |

TABLE 20-continued

Additional measured parameters in Sorghum accessions

| | Treatment | | | | | | | |
|---|---|---|---|---|---|---|---|---|
| Ecotype | Line-10 | Line-11 | Line-12 | Line-13 | Line-14 | Line-15 | Line-16 | Line-17 |
| 4 | 24.28 | 21.95 | 24.98 | 19.49 | 20.42 | 16.81 | 18.88 | |
| 5 | 5.37 | 4.66 | 6.35 | 5.58 | 5.76 | 5.86 | 5.10 | |
| 6 | | | | | | | | |
| 7 | | | | | | | | |
| 8 | 92.20 | 81.93 | 98.80 | 86.47 | 99.60 | 83.00 | 83.53 | 92.30 |
| 9 | 76.37 | 33.47 | 42.20 | 41.53 | 131.67 | 60.84 | 44.33 | 185.44 |
| 10 | 120.43 | 37.21 | 48.18 | 44.20 | 231.60 | 116.01 | 123.08 | 342.50 |
| 11 | 45.43 | 42.58 | 44.18 | 44.60 | 42.41 | 43.25 | 40.30 | 40.75 |
| 12 | 0.44 | 0.47 | 0.47 | 0.48 | 0.35 | 0.35 | 0.23 | 0.33 |
| 13 | 2.65 | 0.87 | 1.09 | 0.99 | 5.46 | 2.68 | 3.05 | 8.40 |
| 14 | 38.36 | 32.10 | 32.69 | 32.79 | 51.53 | 35.71 | 38.31 | 42.44 |
| 15 | 60.00 | 45.45 | 58.19 | 70.60 | 70.10 | 53.95 | 59.87 | 52.65 |
| 16 | 169.03 | 156.10 | 112.14 | 154.74 | 171.70 | 168.51 | 162.51 | 170.46 |
| 17 | 71.40 | 68.56 | 56.44 | 67.79 | 71.54 | 78.94 | 67.03 | 74.11 |
| 18 | 28.82 | 28.13 | 22.97 | 28.09 | 30.00 | 30.54 | 27.17 | 29.26 |
| 19 | 7.42 | 6.98 | 6.19 | 7.02 | 7.18 | 7.00 | 7.39 | 7.35 |
| 20 | 0.12 | 0.12 | 0.11 | 0.12 | 0.11 | 0.10 | 0.11 | 0.11 |
| 21 | 1.24 | 1.32 | 1.22 | 1.18 | 1.18 | 1.22 | 1.25 | 1.22 |
| 22 | 0.79 | 0.77 | 0.80 | 0.81 | 0.82 | 0.81 | 0.82 | 0.82 |
| 23 | 0.93 | 0.91 | 0.92 | 0.90 | 0.91 | 0.90 | 0.91 | 0.91 |
| 24 | 0.92 | 0.89 | 0.91 | 0.91 | 0.91 | 0.90 | 0.90 | 0.91 |
| 25 | 0.85 | 0.86 | 0.88 | 0.90 | 0.90 | 0.91 | 0.90 | 0.90 |
| 26 | 97.50 | 98.00 | 100.00 | 105.60 | 151.15 | 117.10 | 124.45 | 126.50 |
| 27 | 328.95 | 391.00 | 435.75 | 429.50 | 441.00 | 415.75 | 429.50 | 428.50 |
| 28 | 102.75 | 82.33 | 77.59 | 91.17 | 150.44 | 109.10 | 107.58 | 130.88 |
| 29 | 128.97 | 97.62 | 99.32 | 112.24 | 157.42 | 130.55 | 135.66 | 209.21 |
| 30 | 45.59 | 44.83 | 45.33 | 46.54 | 43.99 | 45.09 | 45.14 | 43.13 |
| 31 | 0.44 | 0.46 | 0.45 | 0.45 | 0.51 | 0.46 | 0.44 | 0.39 |
| 32 | 0.72 | 0.72 | 0.70 | 1.17 | 0.79 | 0.85 | 0.98 | |
| 33 | 2.89 | 2.91 | 3.12 | 4.75 | 3.69 | 3.85 | 5.84 | |
| 34 | 2.18 | 2.19 | 2.41 | 3.58 | 2.90 | 3.01 | 4.85 | |
| 35 | 36.84 | 29.45 | 26.70 | 29.42 | 51.12 | 37.04 | 39.85 | 41.78 |
| 36 | 57.58 | 42.93 | 36.47 | 68.60 | 71.80 | 49.27 | 43.87 | 52.07 |
| 37 | 136.71 | 137.70 | 96.54 | 158.19 | 163.95 | 138.39 | 135.46 | 165.64 |
| 38 | 66.17 | 67.37 | 57.90 | 70.61 | 73.76 | 66.87 | 65.40 | 75.97 |
| 39 | 26.31 | 25.43 | 23.11 | 27.87 | 28.88 | 27.64 | 25.52 | 30.33 |
| 40 | 6.59 | 6.85 | 5.32 | 7.25 | 7.19 | 6.27 | 6.57 | 6.82 |
| 41 | 0.13 | 0.13 | 0.12 | 0.12 | 0.11 | 0.11 | 0.12 | 0.11 |
| 42 | 1.22 | 1.24 | 1.19 | 1.23 | 1.16 | 1.34 | 1.21 | 1.21 |
| 43 | 0.77 | 0.74 | 0.80 | 0.79 | 0.82 | 0.80 | 0.81 | 0.81 |
| 44 | 0.91 | 0.89 | 0.90 | 0.90 | 0.91 | 0.89 | 0.90 | 0.90 |
| 45 | 0.91 | 0.89 | 0.90 | 0.89 | 0.91 | 0.89 | 0.89 | 0.90 |
| 46 | 0.86 | 0.84 | 0.90 | 0.89 | 0.91 | 0.90 | 0.90 | 0.90 |
| 47 | 94.53 | 110.00 | 115.07 | 104.73 | 173.67 | 115.60 | 138.80 | 144.40 |
| 48 | 437.67 | 383.00 | 375.00 | 425.00 | 434.00 | 408.67 | 378.50 | 432.00 |
| 49 | 99.83 | 76.95 | 84.25 | 92.24 | 138.83 | 113.32 | 95.50 | 129.49 |
| 50 | 124.27 | 101.33 | 132.12 | 117.90 | 176.99 | 143.67 | 126.98 | 180.45 |
| 51 | 42.71 | 40.08 | 43.98 | 45.44 | 44.75 | 42.58 | 43.81 | 46.73 |
| 52 | 0.44 | 0.43 | 0.39 | 0.44 | 0.44 | 0.44 | 0.43 | 0.42 |
| 53 | 2.91 | 2.53 | 3.00 | 2.60 | 3.96 | 3.38 | 2.90 | 3.86 |
| 54 | 3.77 | 3.26 | 3.61 | 3.24 | 5.10 | 4.25 | 3.81 | 4.76 |
| 55 | 0.86 | 0.73 | 0.61 | 0.65 | 1.14 | 0.87 | 0.91 | 0.89 |

Table 20:
Provided are the values of each of the parameters (as described above) measured in Sorghum accessions (ecotype) under normal, low nitrogen and drought conditions. Growth conditions are specified in the experimental procedure section.

TABLE 21

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM1009 | 0.72 | 1.97E−02 | 6 | 20 | LYM1009 | 0.72 | 2.01E−02 | 5 | 41 |
| LYM1009 | 0.82 | 7.17E−03 | 1 | 1 | LYM881 | 0.72 | 1.79E−02 | 6 | 31 |
| LYM881 | 0.73 | 1.73E−02 | 6 | 28 | LYM881 | 0.77 | 9.09E−03 | 6 | 29 |
| LYM881 | 0.90 | 4.44E−04 | 2 | 48 | LYM881 | 0.76 | 1.08E−02 | 2 | 37 |

TABLE 21-continued

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM881 | 0.75 | 1.19E−02 | 2 | 38 | LYM881 | 0.86 | 1.56E−03 | 4 | 13 |
| LYM881 | 0.80 | 5.83E−03 | 4 | 9 | LYM881 | 0.87 | 1.05E−03 | 4 | 10 |
| LYM881 | 0.72 | 1.97E−02 | 5 | 37 | LYM881 | 0.70 | 2.32E−02 | 5 | 35 |
| LYM881 | 0.73 | 1.60E−02 | 5 | 38 | LYM881 | 0.73 | 1.76E−02 | 5 | 55 |
| LYM881 | 0.75 | 1.24E−02 | 3 | 17 | LYM881 | 0.71 | 2.12E−02 | 3 | 18 |
| LYM881 | 0.73 | 1.57E−02 | 3 | 14 | LYM882 | 0.71 | 2.21E−02 | 2 | 41 |
| LYM882 | 0.75 | 1.29E−02 | 3 | 18 | LYM882 | 0.84 | 4.72E−03 | 7 | 2 |
| LYM882 | 0.85 | 3.92E−03 | 7 | 5 | LYM882 | 0.84 | 4.49E−03 | 7 | 3 |
| LYM883 | 0.73 | 1.57E−02 | 6 | 20 | LYM883 | 0.76 | 1.04E−02 | 2 | 47 |
| LYM883 | 0.75 | 1.94E−02 | 4 | 5 | LYM883 | 0.74 | 1.47E−02 | 3 | 23 |
| LYM883 | 0.82 | 6.67E−03 | 7 | 2 | LYM883 | 0.74 | 2.27E−02 | 7 | 5 |
| LYM883 | 0.84 | 4.16E−03 | 7 | 3 | LYM883 | 0.72 | 2.75E−02 | 7 | 4 |
| LYM883 | 0.85 | 3.54E−03 | 1 | 5 | LYM884 | 0.83 | 2.66E−03 | 6 | 20 |
| LYM885 | 0.82 | 3.87E−03 | 6 | 34 | LYM885 | 0.75 | 1.23E−02 | 6 | 28 |
| LYM885 | 0.80 | 5.88E−03 | 6 | 29 | LYM885 | 0.78 | 7.46E−03 | 6 | 33 |
| LYM885 | 0.83 | 3.04E−03 | 4 | 11 | LYM885 | 0.74 | 1.35E−02 | 5 | 41 |
| LYM886 | 0.73 | 1.56E−02 | 6 | 19 | LYM886 | 0.77 | 8.99E−03 | 6 | 16 |
| LYM886 | 0.79 | 1.21E−02 | 3 | 32 | LYM886 | 0.77 | 8.83E−03 | 3 | 15 |
| LYM887 | 0.76 | 9.95E−03 | 3 | 20 | LYM889 | 0.74 | 1.45E−02 | 6 | 19 |
| LYM889 | 0.78 | 8.37E−03 | 6 | 34 | LYM889 | 0.78 | 8.40E−03 | 6 | 21 |
| LYM889 | 0.75 | 1.31E−02 | 6 | 33 | LYM889 | 0.79 | 1.19E−02 | 9 | 34 |
| LYM889 | 0.73 | 2.58E−02 | 9 | 33 | LYM889 | 0.83 | 2.70E−03 | 9 | 27 |
| LYM889 | 0.73 | 1.71E−02 | 3 | 21 | LYM889 | 0.77 | 8.87E−03 | 3 | 20 |
| LYM890 | 0.83 | 2.65E−03 | 6 | 26 | LYM890 | 0.85 | 1.70E−03 | 4 | 13 |
| LYM890 | 0.74 | 1.44E−02 | 4 | 9 | LYM890 | 0.85 | 1.82E−03 | 4 | 10 |
| LYM890 | 0.74 | 1.40E−02 | 5 | 35 | LYM891 | 0.82 | 3.62E−03 | 6 | 34 |
| LYM891 | 0.80 | 5.88E−03 | 6 | 28 | LYM891 | 0.72 | 1.86E−02 | 6 | 29 |
| LYM891 | 0.80 | 5.94E−03 | 6 | 33 | LYM891 | 0.70 | 2.39E−02 | 6 | 27 |
| LYM891 | 0.80 | 5.31E−03 | 2 | 42 | LYM891 | 0.73 | 1.63E−02 | 3 | 20 |
| LYM891 | 0.77 | 1.55E−02 | 7 | 3 | LYM892 | 0.80 | 5.09E−03 | 1 | 8 |
| LYM893 | 0.77 | 9.52E−03 | 2 | 42 | LYM893 | 0.81 | 4.74E−03 | 2 | 40 |
| LYM894 | 0.70 | 2.41E−02 | 6 | 19 | LYM894 | 0.75 | 1.28E−02 | 6 | 32 |
| LYM894 | 0.71 | 2.26E−02 | 6 | 33 | LYM894 | 0.82 | 3.82E−03 | 2 | 42 |
| LYM894 | 0.89 | 4.77E−04 | 8 | 41 | LYM894 | 0.83 | 5.21E−03 | 3 | 34 |
| LYM894 | 0.76 | 1.10E−02 | 3 | 30 | LYM894 | 0.71 | 2.05E−02 | 3 | 25 |
| LYM894 | 0.74 | 1.42E−02 | 3 | 23 | LYM894 | 0.86 | 2.76E−03 | 3 | 33 |
| LYM894 | 0.72 | 1.98E−02 | 1 | 8 | LYM895 | 0.80 | 5.80E−03 | 6 | 34 |
| LYM895 | 0.86 | 1.56E−03 | 6 | 28 | LYM895 | 0.91 | 2.77E−04 | 6 | 29 |
| LYM895 | 0.77 | 8.78E−03 | 6 | 33 | LYM895 | 0.71 | 2.09E−02 | 2 | 42 |
| LYM895 | 0.84 | 2.52E−03 | 3 | 27 | LYM895 | 0.74 | 1.45E−02 | 7 | 12 |
| LYM896 | 0.76 | 1.11E−02 | 2 | 48 | LYM896 | 0.72 | 1.99E−02 | 5 | 49 |
| LYM896 | 0.73 | 1.59E−02 | 5 | 43 | LYM896 | 0.74 | 1.36E−02 | 5 | 54 |
| LYM896 | 0.84 | 2.23E−03 | 5 | 45 | LYM896 | 0.76 | 1.12E−02 | 5 | 50 |
| LYM896 | 0.95 | 3.44E−05 | 3 | 26 | LYM896 | 0.91 | 2.54E−04 | 3 | 14 |
| LYM896 | 0.75 | 1.18E−02 | 3 | 15 | LYM897 | 0.71 | 2.22E−02 | 6 | 28 |
| LYM897 | 0.70 | 2.30E−02 | 6 | 29 | LYM897 | 0.71 | 2.24E−02 | 2 | 49 |
| LYM897 | 0.70 | 2.28E−02 | 2 | 53 | LYM898 | 0.81 | 4.09E−03 | 6 | 16 |
| LYM898 | 0.80 | 5.84E−03 | 6 | 18 | LYM898 | 0.74 | 1.44E−02 | 8 | 52 |
| LYM898 | 0.77 | 9.34E−03 | 5 | 48 | LYM898 | 0.78 | 7.32E−03 | 5 | 39 |
| LYM898 | 0.76 | 1.11E−02 | 5 | 38 | LYM898 | 0.74 | 1.47E−02 | 3 | 20 |
| LYM899 | 0.73 | 1.56E−02 | 2 | 35 | LYM899 | 0.77 | 8.69E−03 | 2 | 39 |
| LYM899 | 0.71 | 2.18E−02 | 2 | 55 | LYM899 | 0.82 | 6.32E−03 | 3 | 34 |
| LYM899 | 0.83 | 2.99E−03 | 3 | 28 | LYM899 | 0.84 | 2.12E−03 | 3 | 29 |
| LYM899 | 0.83 | 5.76E−03 | 3 | 33 | LYM900 | 0.78 | 8.36E−03 | 6 | 28 |
| LYM900 | 0.86 | 1.52E−03 | 6 | 29 | LYM900 | 0.79 | 6.95E−03 | 2 | 47 |
| LYM900 | 0.70 | 2.33E−02 | 5 | 37 | LYM900 | 0.83 | 2.98E−03 | 5 | 40 |
| LYM901 | 0.90 | 4.40E−04 | 6 | 19 | LYM901 | 0.70 | 2.39E−02 | 6 | 16 |
| LYM901 | 0.91 | 2.39E−04 | 9 | 27 | LYM901 | 0.72 | 1.93E−02 | 8 | 37 |
| LYM901 | 0.78 | 8.41E−03 | 8 | 40 | LYM901 | 0.71 | 2.07E−02 | 5 | 41 |
| LYM901 | 0.85 | 2.07E−03 | 3 | 19 | LYM901 | 0.84 | 2.19E−03 | 3 | 27 |
| LYM902 | 0.88 | 6.87E−04 | 6 | 19 | LYM902 | 0.85 | 2.07E−03 | 6 | 16 |
| LYM902 | 0.76 | 1.14E−02 | 5 | 45 | LYM902 | 0.76 | 1.01E−02 | 3 | 15 |
| LYM903 | 0.76 | 1.02E−02 | 6 | 34 | LYM903 | 0.80 | 5.03E−03 | 6 | 33 |
| LYM903 | 0.80 | 9.98E−03 | 7 | 2 | LYM903 | 0.85 | 3.83E−03 | 7 | 5 |
| LYM903 | 0.82 | 7.00E−03 | 7 | 3 | LYM904 | 0.73 | 1.75E−02 | 6 | 14 |
| LYM904 | 0.84 | 2.19E−03 | 4 | 13 | LYM904 | 0.85 | 1.88E−03 | 4 | 10 |
| LYM904 | 0.81 | 4.32E−03 | 5 | 50 | LYM904 | 0.85 | 1.62E−03 | 3 | 15 |
| LYM904 | 0.70 | 3.57E−02 | 7 | 1 | LYM905 | 0.75 | 1.29E−02 | 6 | 20 |
| LYM905 | 0.71 | 2.03E−02 | 5 | 41 | LYM905 | 0.71 | 3.28E−02 | 3 | 33 |
| LYM906 | 0.72 | 1.83E−02 | 9 | 15 | LYM906 | 0.71 | 2.09E−02 | 8 | 45 |
| LYM906 | 0.78 | 1.26E−02 | 7 | 5 | LYM907 | 0.81 | 4.08E−03 | 6 | 26 |
| LYM907 | 0.70 | 2.34E−02 | 6 | 14 | LYM907 | 0.73 | 1.65E−02 | 9 | 15 |

TABLE 21-continued

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM907 | 0.81 | 4.80E−03 | 4 | 13 | LYM907 | 0.75 | 1.23E−02 | 4 | 9 |
| LYM907 | 0.81 | 4.32E−03 | 4 | 10 | LYM907 | 0.73 | 1.66E−02 | 3 | 26 |
| LYM907 | 0.74 | 1.47E−02 | 3 | 14 | LYM908 | 0.85 | 1.91E−03 | 6 | 26 |
| LYM908 | 0.86 | 1.58E−03 | 6 | 14 | LYM908 | 0.70 | 2.31E−02 | 2 | 42 |
| LYM908 | 0.75 | 1.17E−02 | 4 | 13 | LYM908 | 0.77 | 9.55E−03 | 4 | 10 |
| LYM908 | 0.72 | 1.83E−02 | 5 | 35 | LYM908 | 0.70 | 2.28E−02 | 5 | 50 |
| LYM908 | 0.71 | 2.10E−02 | 5 | 55 | LYM909 | 0.76 | 1.05E−02 | 9 | 15 |
| LYM910 | 0.82 | 3.52E−03 | 6 | 34 | LYM910 | 0.73 | 1.72E−02 | 6 | 29 |
| LYM910 | 0.83 | 3.06E−03 | 6 | 33 | LYM910 | 0.85 | 3.45E−03 | 9 | 34 |
| LYM910 | 0.85 | 3.67E−03 | 9 | 33 | LYM910 | 0.78 | 7.31E−03 | 9 | 27 |
| LYM910 | 0.91 | 2.50E−04 | 2 | 42 | LYM910 | 0.71 | 2.11E−02 | 3 | 20 |
| LYM911 | 0.79 | 6.19E−03 | 6 | 14 | LYM911 | 0.79 | 1.05E−02 | 4 | 2 |
| LYM911 | 0.76 | 1.69E−02 | 4 | 3 | LYM911 | 0.70 | 3.45E−02 | 4 | 4 |
| LYM911 | 0.71 | 2.19E−02 | 5 | 48 | LYM911 | 0.79 | 6.90E−03 | 5 | 35 |
| LYM911 | 0.73 | 1.56E−02 | 5 | 55 | LYM911 | 0.89 | 1.44E−03 | 3 | 34 |
| LYM911 | 0.90 | 1.10E−03 | 3 | 33 | LYM911 | 0.85 | 1.79E−03 | 1 | 13 |
| LYM911 | 0.72 | 1.85E−02 | 1 | 9 | LYM911 | 0.85 | 1.84E−03 | 1 | 10 |
| LYM912 | 0.91 | 2.91E−04 | 6 | 26 | LYM912 | 0.92 | 1.83E−04 | 6 | 14 |
| LYM912 | 0.73 | 1.68E−02 | 6 | 15 | LYM912 | 0.91 | 2.85E−04 | 4 | 13 |
| LYM912 | 0.84 | 2.25E−03 | 4 | 9 | LYM912 | 0.91 | 2.21E−04 | 4 | 10 |
| LYM912 | 0.73 | 1.58E−02 | 5 | 54 | LYM912 | 0.80 | 5.58E−03 | 5 | 50 |
| LYM913 | 0.74 | 1.39E−02 | 6 | 15 | LYM913 | 0.75 | 1.25E−02 | 8 | 41 |
| LYM913 | 0.71 | 2.23E−02 | 5 | 43 | LYM913 | 0.73 | 1.59E−02 | 3 | 15 |
| LYM914 | 0.84 | 2.12E−03 | 6 | 26 | LYM914 | 0.82 | 3.43E−03 | 6 | 14 |
| LYM914 | 0.79 | 6.12E−03 | 4 | 13 | LYM914 | 0.81 | 4.66E−03 | 4 | 10 |
| LYM914 | 0.86 | 1.61E−03 | 8 | 43 | LYM914 | 0.77 | 8.85E−03 | 8 | 46 |
| LYM914 | 0.86 | 1.39E−03 | 8 | 45 | LYM914 | 0.87 | 9.65E−04 | 8 | 44 |
| LYM914 | 0.71 | 2.08E−02 | 5 | 35 | LYM914 | 0.87 | 1.13E−03 | 5 | 47 |
| LYM914 | 0.79 | 6.52E−03 | 1 | 8 | LYM915 | 0.73 | 1.59E−02 | 6 | 34 |
| LYM915 | 0.86 | 1.57E−03 | 6 | 28 | LYM915 | 0.85 | 1.87E−03 | 6 | 29 |
| LYM915 | 0.75 | 1.31E−02 | 6 | 27 | LYM915 | 0.78 | 7.94E−03 | 5 | 49 |
| LYM915 | 0.71 | 2.22E−02 | 5 | 54 | LYM915 | 0.74 | 1.45E−02 | 5 | 53 |
| LYM915 | 0.74 | 1.35E−02 | 5 | 45 | LYM915 | 0.73 | 1.75E−02 | 1 | 11 |
| LYM916 | 0.73 | 1.59E−02 | 6 | 14 | LYM916 | 0.70 | 2.35E−02 | 6 | 24 |
| LYM916 | 0.74 | 1.49E−02 | 5 | 48 | LYM916 | 0.81 | 4.36E−03 | 5 | 36 |
| LYM916 | 0.76 | 1.13E−02 | 3 | 29 | LYM917 | 0.78 | 8.44E−03 | 6 | 28 |
| LYM917 | 0.87 | 1.23E−03 | 6 | 29 | LYM917 | 0.77 | 8.81E−03 | 5 | 49 |
| LYM917 | 0.73 | 1.69E−02 | 5 | 54 | LYM917 | 0.73 | 1.69E−02 | 5 | 53 |
| LYM917 | 0.71 | 2.10E−02 | 5 | 50 | LYM917 | 0.80 | 5.74E−03 | 7 | 12 |
| LYM917 | 0.74 | 1.37E−02 | 1 | 12 | | | | | |
| LYM919 | 0.86 | 1.57E−03 | 6 | 26 | LYM919 | 0.81 | 4.41E−03 | 6 | 14 |
| LYM919 | 0.79 | 6.87E−03 | 2 | 42 | LYM919 | 0.72 | 1.88E−02 | 5 | 47 |
| LYM920 | 0.83 | 2.68E−03 | 6 | 26 | LYM920 | 0.79 | 6.05E−03 | 6 | 14 |
| LYM920 | 0.86 | 1.32E−03 | 4 | 13 | LYM920 | 0.71 | 2.17E−02 | 4 | 9 |
| LYM920 | 0.87 | 1.10E−03 | 4 | 10 | LYM920 | 0.75 | 1.19E−02 | 5 | 54 |
| LYM920 | 0.76 | 1.04E−02 | 5 | 50 | LYM920 | 0.72 | 1.89E−02 | 3 | 28 |
| LYM921 | 0.83 | 2.68E−03 | 2 | 47 | LYM921 | 0.75 | 1.21E−02 | 3 | 26 |
| LYM921 | 0.77 | 8.55E−03 | 3 | 14 | LYM922 | 0.73 | 1.59E−02 | 2 | 47 |
| LYM922 | 0.83 | 5.68E−03 | 3 | 34 | LYM922 | 0.79 | 6.88E−03 | 3 | 28 |
| LYM922 | 0.83 | 5.12E−03 | 3 | 33 | LYM922 | 0.71 | 2.26E−02 | 3 | 27 |
| LYM923 | 0.82 | 3.70E−03 | 6 | 34 | LYM923 | 0.79 | 6.59E−03 | 6 | 33 |
| LYM923 | 0.79 | 6.91E−03 | 6 | 27 | LYM923 | 0.78 | 8.11E−03 | 5 | 41 |
| LYM923 | 0.74 | 1.53E−02 | 3 | 20 | LYM923 | 0.77 | 1.47E−02 | 7 | 2 |
| LYM923 | 0.80 | 1.00E−02 | 7 | 3 | LYM924 | 0.74 | 1.49E−02 | 6 | 26 |
| LYM924 | 0.75 | 1.21E−02 | 6 | 14 | LYM924 | 0.77 | 9.41E−03 | 9 | 20 |
| LYM924 | 0.92 | 1.89E−04 | 4 | 13 | LYM924 | 0.79 | 6.75E−03 | 4 | 9 |
| LYM924 | 0.92 | 1.90E−04 | 4 | 10 | LYM924 | 0.76 | 1.68E−02 | 3 | 34 |
| LYM924 | 0.70 | 2.41E−02 | 3 | 28 | LYM924 | 0.76 | 1.72E−02 | 3 | 33 |
| LYM924 | 0.71 | 2.10E−02 | 1 | 8 | LYM925 | 0.72 | 1.91E−02 | 4 | 12 |
| LYM925 | 0.86 | 1.29E−03 | 3 | 28 | LYM925 | 0.77 | 9.39E−03 | 3 | 29 |
| LYM926 | 0.82 | 3.56E−03 | 6 | 34 | LYM926 | 0.84 | 2.36E−03 | 6 | 33 |
| LYM926 | 0.71 | 2.15E−02 | 2 | 35 | LYM926 | 0.84 | 2.10E−03 | 2 | 47 |
| LYM926 | 0.75 | 1.26E−02 | 3 | 28 | LYM927 | 0.83 | 3.25E−03 | 6 | 26 |
| LYM927 | 0.79 | 6.11E−03 | 6 | 14 | LYM927 | 0.83 | 3.30E−03 | 4 | 13 |
| LYM927 | 0.80 | 5.89E−03 | 4 | 9 | LYM927 | 0.83 | 2.92E−03 | 4 | 10 |
| LYM927 | 0.83 | 2.94E−03 | 5 | 49 | LYM927 | 0.84 | 2.44E−03 | 5 | 54 |
| LYM927 | 0.84 | 2.31E−03 | 5 | 53 | LYM927 | 0.88 | 7.94E−04 | 5 | 50 |
| LYM927 | 0.73 | 1.58E−02 | 3 | 15 | LYM928 | 0.80 | 5.45E−03 | 6 | 26 |
| LYM928 | 0.76 | 1.14E−02 | 6 | 14 | LYM928 | 0.94 | 6.87E−05 | 4 | 13 |
| LYM928 | 0.86 | 1.39E−03 | 4 | 9 | LYM928 | 0.94 | 5.56E−05 | 4 | 10 |
| LYM928 | 0.84 | 4.64E−03 | 3 | 32 | LYM929 | 0.70 | 2.41E−02 | 6 | 19 |
| LYM929 | 0.85 | 2.01E−03 | 6 | 34 | LYM929 | 0.80 | 5.46E−03 | 6 | 31 |

TABLE 21-continued

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM929 | 0.86 | 1.35E−03 | 6 | 28 | LYM929 | 0.86 | 1.47E−03 | 6 | 29 |
| LYM929 | 0.87 | 1.14E−03 | 6 | 33 | LYM929 | 0.82 | 4.03E−03 | 4 | 13 |
| LYM929 | 0.93 | 9.89E−05 | 4 | 9 | LYM929 | 0.81 | 4.86E−03 | 4 | 10 |
| LYM929 | 0.81 | 4.12E−03 | 5 | 49 | LYM929 | 0.74 | 1.54E−02 | 5 | 54 |
| LYM929 | 0.75 | 1.18E−02 | 5 | 53 | LYM929 | 0.76 | 1.14E−02 | 5 | 52 |
| LYM929 | 0.73 | 1.65E−02 | 5 | 50 | LYM930 | 0.82 | 3.87E−03 | 6 | 26 |
| LYM930 | 0.73 | 1.70E−02 | 6 | 14 | LYM930 | 0.86 | 1.57E−03 | 4 | 13 |
| LYM930 | 0.76 | 1.02E−02 | 4 | 9 | LYM930 | 0.87 | 1.22E−03 | 4 | 10 |
| LYM930 | 0.74 | 2.22E−02 | 7 | 2 | LYM930 | 0.72 | 3.03E−02 | 7 | 3 |
| LYM931 | 0.71 | 2.07E−02 | 9 | 14 | LYM932 | 0.71 | 2.20E−02 | 9 | 15 |
| LYM932 | 0.85 | 2.03E−03 | 2 | 35 | LYM932 | 0.70 | 2.42E−02 | 2 | 39 |
| LYM932 | 0.72 | 1.93E−02 | 2 | 36 | LYM932 | 0.82 | 3.31E−03 | 2 | 55 |
| LYM932 | 0.79 | 6.43E−03 | 2 | 44 | LYM932 | 0.72 | 1.90E−02 | 2 | 47 |
| LYM932 | 0.79 | 6.97E−03 | 3 | 28 | LYM932 | 0.72 | 1.80E−02 | 3 | 29 |
| LYM933 | 0.71 | 2.12E−02 | 2 | 35 | LYM933 | 0.70 | 2.36E−02 | 2 | 55 |
| LYM933 | 0.86 | 1.25E−03 | 5 | 42 | LYM933 | 0.85 | 1.70E−03 | 3 | 28 |
| LYM933 | 0.76 | 1.13E−02 | 3 | 29 | LYM934 | 0.72 | 1.89E−02 | 6 | 34 |
| LYM934 | 0.78 | 7.39E−03 | 6 | 28 | LYM934 | 0.72 | 1.77E−02 | 6 | 29 |
| LYM934 | 0.77 | 9.54E−03 | 8 | 49 | LYM934 | 0.81 | 4.54E−03 | 8 | 54 |
| LYM934 | 0.75 | 1.25E−02 | 8 | 53 | LYM934 | 0.71 | 2.18E−02 | 8 | 52 |
| LYM934 | 0.74 | 1.42E−02 | 8 | 45 | LYM934 | 0.70 | 2.30E−02 | 8 | 50 |
| LYM934 | 0.76 | 9.95E−03 | 5 | 52 | LYM935 | 0.88 | 8.52E−04 | 6 | 26 |
| LYM935 | 0.83 | 3.17E−03 | 6 | 14 | LYM935 | 0.86 | 1.52E−03 | 4 | 13 |
| LYM935 | 0.81 | 4.61E−03 | 4 | 9 | LYM935 | 0.86 | 1.45E−03 | 4 | 10 |
| LYM935 | 0.72 | 1.84E−03 | 5 | 48 | LYM935 | 0.77 | 1.50E−02 | 3 | 34 |
| LYM935 | 0.75 | 1.23E−02 | 3 | 28 | LYM935 | 0.89 | 5.09E−04 | 3 | 29 |
| LYM935 | 0.73 | 2.60E−02 | 3 | 33 | LYM936 | 0.71 | 2.15E−02 | 3 | 14 |
| LYM936 | 0.75 | 2.05E−02 | 1 | 2 | LYM936 | 0.83 | 5.73E−03 | 1 | 3 |
| LYM936 | 0.80 | 9.66E−03 | 1 | 4 | LYM937 | 0.87 | 1.12E−03 | 6 | 34 |
| LYM937 | 0.84 | 2.14E−03 | 6 | 33 | LYM938 | 0.72 | 1.78E−02 | 6 | 14 |
| LYM938 | 0.77 | 1.55E−02 | 7 | 5 | LYM939 | 0.74 | 1.35E−02 | 6 | 31 |
| LYM939 | 0.83 | 3.10E−03 | 6 | 28 | LYM939 | 0.80 | 5.88E−03 | 6 | 29 |
| LYM939 | 0.82 | 3.42E−03 | 2 | 42 | LYM940 | 0.82 | 3.35E−03 | 6 | 26 |
| LYM940 | 0.91 | 2.97E−04 | 6 | 14 | LYM940 | 0.74 | 1.40E−02 | 5 | 47 |
| LYM941 | 0.80 | 1.01E−02 | 3 | 32 | LYM941 | 0.75 | 1.28E−02 | 3 | 15 |
| LYM942 | 0.72 | 1.88E−02 | 6 | 28 | LYM942 | 0.75 | 1.18E−02 | 6 | 29 |
| LYM942 | 0.72 | 2.00E−02 | 2 | 47 | LYM943 | 0.70 | 2.33E−02 | 6 | 28 |
| LYM943 | 0.72 | 1.90E−02 | 6 | 29 | LYM943 | 0.71 | 2.05E−02 | 4 | 13 |
| LYM943 | 0.70 | 2.34E−02 | 4 | 9 | LYM943 | 0.72 | 2.00E−02 | 4 | 10 |
| LYM944 | 0.83 | 5.91E−03 | 7 | 2 | LYM944 | 0.79 | 1.07E−02 | 7 | 5 |
| LYM944 | 0.89 | 1.25E−03 | 7 | 3 | LYM945 | 0.77 | 9.75E−03 | 6 | 19 |
| LYM945 | 0.71 | 2.08E−02 | 6 | 34 | LYM945 | 0.72 | 1.86E−02 | 6 | 33 |
| LYM945 | 0.72 | 2.00E−02 | 8 | 41 | LYM946 | 0.78 | 8.10E−03 | 9 | 30 |
| LYM946 | 0.80 | 9.88E−03 | 9 | 32 | LYM946 | 0.75 | 1.17E−02 | 2 | 35 |
| LYM946 | 0.77 | 8.50E−03 | 2 | 44 | LYM946 | 0.82 | 3.87E−03 | 2 | 47 |
| LYM946 | 0.72 | 2.73E−02 | 3 | 32 | LYM947 | 0.93 | 9.20E−05 | 6 | 26 |
| LYM947 | 0.90 | 3.32E−04 | 6 | 14 | LYM947 | 0.77 | 9.56E−03 | 6 | 15 |
| LYM947 | 0.75 | 1.25E−02 | 2 | 51 | LYM947 | 0.78 | 7.88E−03 | 5 | 51 |
| LYM947 | 0.72 | 1.98E−02 | 5 | 35 | LYM947 | 0.70 | 2.38E−02 | 5 | 47 |
| LYM948 | 0.72 | 1.80E−02 | 6 | 31 | LYM948 | 0.86 | 1.54E−03 | 6 | 28 |
| LYM948 | 0.89 | 5.94E−04 | 6 | 29 | LYM948 | 0.80 | 8.95E−03 | 9 | 34 |
| LYM948 | 0.80 | 9.52E−03 | 9 | 33 | LYM948 | 0.70 | 2.30E−02 | 2 | 42 |
| LYM948 | 0.71 | 2.09E−02 | 2 | 40 | LYM948 | 0.93 | 3.23E−04 | 7 | 2 |
| LYM948 | 0.94 | 1.25E−04 | 7 | 5 | LYM948 | 0.91 | 5.77E−04 | 7 | 3 |
| LYM949 | 0.77 | 1.55E−02 | 9 | 34 | LYM949 | 0.76 | 1.11E−02 | 9 | 21 |
| LYM949 | 0.75 | 2.09E−02 | 9 | 33 | LYM949 | 0.79 | 6.58E−03 | 9 | 20 |
| LYM949 | 0.78 | 7.99E−03 | 2 | 42 | LYM949 | 0.90 | 3.66E−04 | 4 | 13 |
| LYM949 | 0.84 | 2.35E−03 | 4 | 9 | LYM949 | 0.90 | 4.46E−04 | 4 | 10 |
| LYM950 | 0.81 | 4.61E−03 | 4 | 13 | LYM950 | 0.78 | 7.17E−03 | 4 | 9 |
| LYM950 | 0.80 | 5.07E−03 | 4 | 10 | LYM950 | 0.78 | 7.21E−03 | 3 | 20 |
| LYM951 | 0.73 | 2.42E−02 | 3 | 34 | LYM951 | 0.73 | 1.71E−02 | 3 | 28 |
| LYM951 | 0.73 | 2.51E−02 | 3 | 33 | LYM952 | 0.86 | 1.33E−03 | 6 | 34 |
| LYM952 | 0.77 | 9.81E−03 | 6 | 28 | LYM952 | 0.79 | 6.64E−03 | 6 | 29 |
| LYM952 | 0.85 | 1.68E−03 | 6 | 33 | LYM952 | 0.72 | 1.83E−02 | 6 | 27 |
| LYM952 | 0.77 | 8.73E−03 | 9 | 26 | LYM952 | 0.71 | 2.15E−02 | 4 | 13 |
| LYM952 | 0.75 | 1.18E−02 | 4 | 9 | LYM952 | 0.71 | 2.15E−02 | 4 | 10 |
| LYM952 | 0.73 | 1.55E−02 | 8 | 50 | LYM952 | 0.77 | 1.49E−02 | 3 | 34 |
| LYM952 | 0.89 | 6.17E−04 | 3 | 28 | LYM952 | 0.96 | 8.65E−06 | 3 | 29 |
| LYM952 | 0.72 | 2.81E−02 | 3 | 33 | LYM952 | 0.79 | 1.20E−02 | 7 | 5 |
| LYM952 | 0.73 | 1.67E−02 | 1 | 13 | LYM952 | 0.77 | 8.78E−03 | 1 | 9 |
| LYM952 | 0.72 | 1.87E−02 | 1 | 10 | LYM953 | 0.72 | 1.84E−02 | 9 | 28 |
| LYM953 | 0.78 | 8.17E−03 | 8 | 52 | LYM954 | 0.71 | 2.09E−02 | 6 | 17 |

TABLE 21-continued

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM954 | 0.72 | 1.90E−02 | 5 | 54 | LYM954 | 0.72 | 1.78E−02 | 5 | 45 |
| LYM954 | 0.77 | 9.53E−03 | 5 | 50 | LYM955 | 0.70 | 2.32E−02 | 2 | 42 |
| LYM955 | 0.95 | 1.77E−05 | 4 | 13 | LYM955 | 0.98 | 5.14E−07 | 4 | 9 |
| LYM955 | 0.95 | 1.75E−05 | 4 | 10 | LYM955 | 0.70 | 2.42E−02 | 5 | 54 |
| LYM955 | 0.74 | 1.52E−02 | 5 | 50 | LYM955 | 0.90 | 9.96E−04 | 3 | 34 |
| LYM955 | 0.78 | 7.78E−03 | 3 | 28 | LYM955 | 0.88 | 1.80E−03 | 3 | 33 |
| LYM956 | 0.76 | 1.13E−02 | 6 | 19 | LYM956 | 0.72 | 1.83E−02 | 8 | 45 |
| LYM956 | 0.76 | 1.71E−02 | 3 | 32 | LYM956 | 0.74 | 1.34E−02 | 3 | 15 |
| LYM956 | 0.87 | 2.23E−03 | 7 | 2 | LYM956 | 0.97 | 2.45E−05 | 7 | 5 |
| LYM956 | 0.81 | 8.76E−03 | 7 | 3 | LYM957 | 0.74 | 1.52E−02 | 6 | 28 |
| LYM957 | 0.74 | 1.54E−02 | 6 | 29 | LYM958 | 0.75 | 1.29E−02 | 9 | 14 |
| LYM958 | 0.74 | 1.35E−02 | 2 | 52 | LYM959 | 0.88 | 7.21E−04 | 6 | 34 |
| LYM959 | 0.85 | 1.79E−03 | 6 | 33 | LYM959 | 0.74 | 1.36E−02 | 6 | 27 |
| LYM959 | 0.71 | 2.18E−02 | 2 | 53 | LYM959 | 0.74 | 1.45E−02 | 2 | 41 |
| LYM959 | 0.77 | 8.78E−03 | 5 | 41 | LYM959 | 0.76 | 1.87E−02 | 7 | 2 |
| LYM960 | 0.70 | 2.32E−02 | 6 | 31 | LYM960 | 0.75 | 1.26E−02 | 9 | 20 |
| LYM960 | 0.89 | 5.79E−04 | 4 | 13 | LYM960 | 0.77 | 9.39E−03 | 4 | 9 |
| LYM960 | 0.89 | 5.90E−04 | 4 | 10 | LYM960 | 0.86 | 1.27E−03 | 8 | 41 |
| LYM960 | 0.78 | 7.44E−03 | 5 | 50 | LYM960 | 0.82 | 7.03E−03 | 3 | 32 |
| LYM961 | 0.78 | 8.28E−03 | 6 | 34 | LYM961 | 0.81 | 4.36E−03 | 6 | 33 |
| LYM961 | 0.94 | 2.09E−04 | 4 | 2 | LYM961 | 0.78 | 1.22E−02 | 4 | 5 |
| LYM961 | 0.88 | 1.96E−03 | 4 | 3 | LYM961 | 0.78 | 1.34E−02 | 4 | 4 |
| LYM961 | 0.70 | 2.36E−02 | 8 | 53 | LYM961 | 0.72 | 1.85E−02 | 8 | 50 |
| LYM962 | 0.70 | 2.38E−02 | 9 | 18 | LYM962 | 0.77 | 9.29E−03 | 9 | 14 |
| LYM962 | 0.81 | 4.72E−03 | 2 | 35 | LYM962 | 0.75 | 1.31E−02 | 2 | 45 |
| LYM962 | 0.82 | 3.41E−03 | 2 | 55 | LYM962 | 0.82 | 4.06E−03 | 2 | 44 |
| LYM962 | 0.86 | 1.38E−03 | 3 | 28 | LYM962 | 0.78 | 8.36E−03 | 3 | 27 |
| LYM963 | 0.89 | 5.06E−04 | 2 | 49 | LYM963 | 0.91 | 2.11E−04 | 2 | 54 |
| LYM963 | 0.92 | 1.54E−04 | 2 | 53 | LYM963 | 0.74 | 1.46E−02 | 2 | 45 |
| LYM963 | 0.91 | 2.90E−04 | 2 | 50 | LYM963 | 0.72 | 1.91E−02 | 8 | 43 |
| LYM963 | 0.71 | 3.05E−02 | 3 | 34 | LYM963 | 0.73 | 1.59E−02 | 3 | 31 |
| LYM963 | 0.91 | 2.62E−04 | 3 | 28 | LYM963 | 0.70 | 2.37E−02 | 7 | 8 |
| LYM963 | 0.82 | 7.02E−03 | 1 | 2 | LYM963 | 0.83 | 5.90E−03 | 1 | 5 |
| LYM963 | 0.84 | 4.84E−03 | 1 | 3 | LYM963 | 0.75 | 2.07E−02 | 1 | 4 |
| LYM964 | 0.72 | 1.83E−02 | 6 | 33 | LYM964 | 0.77 | 9.68E−03 | 2 | 42 |
| LYM964 | 0.73 | 1.64E−02 | 5 | 49 | LYM964 | 0.78 | 7.32E−03 | 1 | 8 |
| LYM965 | 0.70 | 2.40E−02 | 6 | 31 | LYM965 | 0.73 | 1.58E−02 | 6 | 28 |
| LYM965 | 0.75 | 1.17E−02 | 6 | 29 | LYM965 | 0.73 | 1.75E−02 | 4 | 13 |
| LYM965 | 0.72 | 1.98E−02 | 4 | 10 | LYM965 | 0.76 | 1.14E−02 | 5 | 48 |
| LYM965 | 0.73 | 1.72E−02 | 3 | 14 | LYM965 | 0.76 | 1.14E−02 | 1 | 8 |
| LYM966 | 0.91 | 6.25E−04 | 3 | 34 | LYM966 | 0.85 | 1.89E−03 | 3 | 28 |
| LYM966 | 0.72 | 1.99E−02 | 3 | 29 | LYM966 | 0.89 | 1.46E−03 | 3 | 33 |
| LYM967 | 0.78 | 8.42E−03 | 6 | 21 | LYM968 | 0.81 | 4.63E−03 | 6 | 19 |
| LYM968 | 0.88 | 8.58E−04 | 6 | 31 | LYM968 | 0.86 | 1.48E−03 | 6 | 28 |
| LYM968 | 0.81 | 4.36E−03 | 6 | 29 | LYM968 | 0.88 | 8.21E−04 | 6 | 27 |
| LYM968 | 0.79 | 6.52E−03 | 9 | 27 | LYM968 | 0.80 | 5.48E−03 | 2 | 42 |
| LYM968 | 0.73 | 1.73E−02 | 2 | 40 | LYM968 | 0.74 | 1.42E−02 | 8 | 41 |
| LYM968 | 0.85 | 1.63E−03 | 5 | 49 | LYM968 | 0.79 | 6.76E−03 | 5 | 54 |
| LYM968 | 0.82 | 4.04E−03 | 5 | 53 | LYM968 | 0.76 | 1.10E−02 | 5 | 52 |
| LYM968 | 0.87 | 1.10E−03 | 5 | 50 | LYM969 | 0.73 | 1.67E−02 | 6 | 20 |
| LYM969 | 0.75 | 1.30E−02 | 9 | 26 | LYM969 | 0.84 | 2.27E−03 | 2 | 35 |
| LYM969 | 0.73 | 1.61E−02 | 2 | 36 | LYM969 | 0.84 | 2.26E−03 | 2 | 55 |
| LYM969 | 0.83 | 2.95E−03 | 2 | 44 | LYM969 | 0.78 | 7.35E−03 | 2 | 47 |
| LYM969 | 0.76 | 1.06E−02 | 8 | 41 | LYM969 | 0.81 | 4.31E−03 | 5 | 41 |
| LYM969 | 0.78 | 8.11E−03 | 3 | 26 | LYM969 | 0.87 | 1.19E−03 | 3 | 14 |
| LYM970 | 0.81 | 4.58E−03 | 6 | 26 | LYM970 | 0.87 | 1.08E−03 | 6 | 15 |
| LYM970 | 0.70 | 2.37E−02 | 9 | 15 | LYM971 | 0.80 | 5.98E−03 | 6 | 15 |
| LYM971 | 0.72 | 1.89E−02 | 5 | 46 | LYM971 | 0.70 | 2.39E−02 | 5 | 47 |
| LYM972 | 0.72 | 1.81E−02 | 2 | 49 | LYM972 | 0.78 | 7.30E−03 | 2 | 48 |
| LYM972 | 0.77 | 8.75E−03 | 2 | 54 | LYM972 | 0.74 | 1.53E−02 | 2 | 53 |
| LYM972 | 0.83 | 2.68E−03 | 2 | 50 | LYM972 | 0.91 | 2.42E−04 | 3 | 26 |
| LYM972 | 0.73 | 1.64E−02 | 3 | 17 | LYM972 | 0.71 | 2.25E−02 | 3 | 16 |
| LYM972 | 0.74 | 1.43E−02 | 3 | 18 | LYM972 | 0.88 | 8.74E−04 | 3 | 14 |
| LYM972 | 0.71 | 2.03E−02 | 3 | 15 | | | | | |
| LYM974 | 0.84 | 2.18E−03 | 2 | 51 | LYM974 | 0.80 | 5.85E−03 | 2 | 47 |
| LYM974 | 0.87 | 1.14E−03 | 4 | 13 | LYM974 | 0.88 | 8.67E−04 | 4 | 9 |
| LYM974 | 0.87 | 1.05E−03 | 4 | 10 | LYM974 | 0.82 | 4.01E−03 | 3 | 26 |
| LYM974 | 0.70 | 2.41E−02 | 3 | 17 | LYM974 | 0.72 | 1.98E−02 | 3 | 16 |
| LYM974 | 0.75 | 1.22E−02 | 3 | 18 | LYM974 | 0.84 | 2.43E−03 | 3 | 14 |
| LYM974 | 0.75 | 1.29E−02 | 3 | 15 | LYM974 | 0.71 | 2.12E−02 | 1 | 13 |
| LYM974 | 0.78 | 7.66E−03 | 1 | 9 | LYM975 | 0.80 | 5.76E−03 | 9 | 20 |
| LYM975 | 0.78 | 7.40E−03 | 2 | 47 | LYM975 | 0.85 | 3.75E−03 | 4 | 1 |

TABLE 21-continued

Correlation between the expression level of selected genes of some embodiments of the invention in various tissues and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM976 | 0.86 | 1.25E−03 | 6 | 34 | LYM976 | 0.83 | 3.02E−03 | 6 | 33 |
| LYM976 | 0.77 | 9.33E−03 | 6 | 27 | LYM976 | 0.73 | 1.73E−02 | 4 | 11 |
| LYM976 | 0.71 | 2.13E−02 | 5 | 41 | LYM977 | 0.75 | 1.23E−02 | 3 | 31 |
| LYM977 | 0.85 | 1.85E−03 | 1 | 11 | LYM978 | 0.79 | 6.07E−03 | 6 | 19 |
| LYM978 | 0.72 | 1.88E−02 | 6 | 31 | LYM978 | 0.84 | 2.47E−03 | 9 | 19 |
| LYM978 | 0.71 | 2.17E−02 | 9 | 16 | LYM978 | 0.84 | 2.44E−03 | 9 | 27 |
| LYM978 | 0.76 | 1.09E−02 | 4 | 13 | LYM978 | 0.76 | 1.13E−02 | 4 | 10 |
| LYM978 | 0.74 | 1.43E−02 | 5 | 49 | LYM978 | 0.74 | 1.35E−02 | 5 | 37 |
| LYM978 | 0.78 | 7.83E−03 | 5 | 54 | LYM978 | 0.75 | 1.27E−02 | 5 | 53 |
| LYM978 | 0.75 | 1.19E−02 | 5 | 35 | LYM978 | 0.83 | 3.02E−03 | 5 | 50 |
| LYM978 | 0.73 | 1.63E−02 | 5 | 38 | LYM978 | 0.79 | 6.20E−03 | 5 | 55 |
| LYM978 | 0.75 | 1.18E−02 | 3 | 19 | LYM978 | 0.71 | 2.14E−02 | 3 | 17 |
| LYM978 | 0.80 | 5.55E−03 | 3 | 16 | LYM978 | 0.82 | 3.77E−03 | 3 | 15 |
| LYM979 | 0.79 | 6.96E−03 | 6 | 21 | LYM979 | 0.84 | 2.55E−03 | 2 | 47 |
| LYM979 | 0.78 | 7.69E−03 | 3 | 26 | | | | | |

Table 21.
Provided are the correlations (R) between the expression levels of yield improving genes and their homologues in tissues [Flag leaf, Flower meristem, stem and Flower; Expression sets (Exp)] and the phenotypic performance in various yield, biomass, growth rate and/or vigor components [Correlation vector (corr.)] under stress conditions or normal conditions across Sorghum accessions.
P = p value.

II. Correlation of *Sorghum* Varieties Across Ecotype Grown Under Salinity Stress and Cold Stress Conditions

*Sorghum* vigor related parameters under 100 mM NaCl and low temperature (10±2° C.)—Ten *Sorghum* varieties were grown in 3 repetitive plots, each containing 17 plants, at a net house under semi-hydroponics conditions. Briefly, the growing protocol was as follows: *Sorghum* seeds were sown in trays filled with a mix of vermiculite and peat in a 1:1 ratio. Following germination, the trays were transferred to the high salinity solution (100 mM NaCl in addition to the Full Hogland solution), low temperature (10±2° C. in the presence of Full Hogland solution) or at Normal growth solution [Full Hogland solution at 28±2° C.].

Full Hogland solution consists of: $KNO_3$—0.808 grams/liter, $MgSO_4$—0.12 grams/liter, $KH_2PO_4$—0.172 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

All 10 selected *Sorghum* varieties were sampled per each treatment. Two tissues [leaves and roots] growing at 100 mM NaCl, low temperature (10±2° C.) or under Normal conditions (full Hogland at a temperature between 28±2° C.) were sampled and RNA was extracted as described hereinabove under "GENERAL EXPERIMENTAL AND BIOINFORMATICS METHODS".

TABLE 22

*Sorghum* transcriptom expression sets

| Expression Set | Set ID |
|---|---|
| Sorghum bath/low nitrogen/root | 1 |
| Sorghum bath/low nitrogen/vegetative meristem | 2 |
| Sorghum bath/NaCl/vegetative meristem | 3 |
| Sorghum bath/NaCl/root | 4 |
| Sorghum bath/Cold/vegetative meristem | 5 |
| Sorghum bath/Normal/root | 6 |

TABLE 22-continued

*Sorghum* transcriptom expression sets

| Expression Set | Set ID |
|---|---|
| Sorghum bath/Normal/vegetative meristem | 7 |
| Sorghum bath/Cold/root | 8 |

Table 22:
Provided are the Sorghum transcriptom expression sets. Cold conditions = 10 ± 2° C.; NaCl = 100 mM NaCl; low nitrogen = 1.2 mM Nitrogen; Normal conditions = 16 mM Nitrogen.

Experimental Results 10 different *Sorghum* varieties were grown and characterized for the following parameters: "Leaf number Normal"=leaf number per plant under normal conditions (average of five plants); "Plant Height Normal"=plant height under normal conditions (average of five plants); "Root DW 100 mM NaCl"—root dry weight per plant under salinity conditions (average of five plants); The average for each of the measured parameters was calculated using the JMP software and values are summarized in Table 24 below. Subsequent correlation analysis between the various transcriptom sets and the average parameters were conducted (Table 25). Results were then integrated to the database.

TABLE 23

Sorghum correlated parameters (vectors)

| Correlated parameter with | Correlation ID |
|---|---|
| Shoot Biomass (DW, gr.)/SPAD [Low Nitrogen] | 1 |
| Root Biomass (DW, gr.)/SPAD [Low Nitrogen] | 2 |
| Total Biomass (Root + Shoot; DW, gr.)/SPAD [Low Nitrogen] | 3 |
| N level/Leaf [Low Nitrogen] | 4 |
| Low N percent shoot biomass compared to normal | 5 |
| Low N percent root biomass compared to normal | 6 |
| Low N percent total biomass reduction compared to normal | 7 |
| Low N (low nitrogen) shoots DW (gr.) | 8 |
| Low N (low nitrogen) roots DW (gr.) | 9 |
| Low N – NUE total biomass (gr.) | 10 |
| Low N – Shoot/Root (ratio) | 11 |

TABLE 23-continued

Sorghum correlated parameters (vectors)

| Correlated parameter with | Correlation ID |
|---|---|
| DW Shoot/Plant (gr./number) at Low Nitrogen | 12 |
| DW Root/Plant (gr./number) at Low Nitrogen | 13 |
| SPAD (number) at Low Nitrogen | 14 |
| Shoot Biomass (DW, gr.)/SPAD [Cold] | 15 |
| Root Biomass (DW, gr.)/SPAD [Cold] | 16 |
| Total Biomass (Root + Shoot; DW, gr.)/SPAD [Cold] | 17 |
| N level/Leaf [Cold] | 18 |
| DW Shoot/Plant (gr./number)-100 mM NaCl | 19 |
| DW Root/Plant (gr./number)-100 mM NaCl | 20 |
| SPAD at 100 mM NaCl (number) | 21 |
| Plant Height (at time point 1), under Cold | 22 |
| Plant Height (at time point 2), under Cold | 23 |
| Leaf (at time point 1), under Cold | 24 |
| Leaf (at time point 2), under Cold | 25 |
| Leaf (at time point 3), under Cold | 26 |
| DW Shoot/Plant, under Cold | 27 |
| DW Root/Plant, under Cold | 28 |
| SPAD, underCold | 29 |
| Shoot Biomass (DW, gr.)/SPAD [Normal] | 30 |
| Root Biomass [DW, gr.]/SPAD [Normal] | 31 |
| Total Biomass (Root + Shoot; DW, gr.)/SPAD [Normal] | 32 |
| N level/Leaf [Normal] | 33 |
| Shoots DW (gr) [normal] | 34 |
| Roots DW (gr) [normal] | 35 |
| Total biomass (gr) [normal] | 36 |
| Normal, Shoot/Root (ratio) | 37 |
| DW Shoot/Plant (gr/number)-Normal | 38 |
| DW Root/Plant (gr/number)-Normal | 39 |
| SPAD (number)-Normal | 40 |
| RGR Leaf Num Normal | 41 |
| Shoot Biomass (DW, gr.)/SPAD [100 mM NaCl] | 42 |
| Root Biomass (DW-gr.)/SPAD [100 mM NaCl] | 43 |
| Total Biomass (Root + Shoot; DW, gr.)/SPAD [100 mM NaCl] | 44 |
| N level/Leaf [100 mM NaCl] | 45 |

Table 23:
Provided are the Sorghum correlated parameters. Cold conditions = 10 ± 2° C.; NaCl = 100 mM NaCl; low nitrogen = 1.2 mM Nitrogen; Normal conditions = 16 mM Nitrogen.

TABLE 24

Sorghum accessions, measured parameters

| Ecotype | Line-1 | Line-2 | Line-3 | Line-4 | Line-5 | Line-6 | Line-7 | Line-8 | Line-9 | Line-10 |
|---|---|---|---|---|---|---|---|---|---|---|
| 12 | 0.08 | 0.19 | 0.33 | 0.16 | 0.16 | 0.16 | 0.26 | 0.20 | 0.13 | 0.18 |
| 13 | 0.04 | 0.11 | 0.20 | 0.10 | 0.08 | 0.09 | 0.13 | 0.09 | 0.09 | 0.09 |
| 14 | 26.88 | 28.02 | 29.64 | 31.52 | 29.61 | 26.82 | 28.48 | 28.21 | 30.48 | 27.63 |
| 1 | 0.00 | 0.01 | 0.01 | 0.01 | 0.01 | 0.01 | 0.01 | 0.01 | 0.00 | 0.01 |
| 2 | 0.00 | 0.00 | 0.01 | 0.00 | 0.00 | 0.00 | 0.00 | 0.00 | 0.00 | 0.00 |
| 3 | 0.00 | 0.01 | 0.02 | 0.01 | 0.01 | 0.01 | 0.01 | 0.01 | 0.01 | 0.01 |
| 4 | 6.89 | 6.57 | 6.31 | 7.45 | 6.89 | 5.87 | 6.15 | 6.05 | 7.68 | 6.74 |
| 5 | 81.57 | 79.16 | 104.75 | 103.50 | 83.71 | 83.22 | 107.69 | 81.39 | 70.30 | 75.86 |
| 6 | 84.53 | 80.95 | 117.00 | 100.52 | 72.54 | 71.78 | 93.47 | 76.05 | 86.82 | 80.51 |
| 7 | 82.58 | 79.81 | 109.10 | 102.32 | 79.74 | 78.77 | 102.49 | 79.59 | 76.07 | 77.36 |
| 8 | 17.88 | 40.59 | 71.35 | 35.44 | 35.33 | 22.66 | 56.38 | 43.20 | 28.27 | 39.91 |
| 9 | 9.65 | 23.54 | 43.88 | 22.58 | 16.89 | 12.44 | 28.19 | 20.53 | 18.76 | 20.09 |
| 10 | 27.53 | 64.12 | 115.23 | 58.02 | 52.22 | 35.10 | 84.57 | 63.73 | 47.03 | 60.00 |
| 11 | 1.87 | 1.71 | 1.73 | 1.57 | 2.10 | 1.81 | 2.06 | 2.10 | 1.50 | 2.00 |
| 15 | 0.00 | 0.01 | 0.01 | 0.00 | 0.00 | 0.01 | 0.00 | 0.01 | 0.00 | 0.00 |
| 16 | 0.00 | 0.00 | 0.01 | 0.00 | 0.00 | 0.00 | 0.00 | 0.00 | 0.00 | 0.00 |
| 17 | 0.01 | 0.01 | 0.01 | 0.01 | 0.01 | 0.01 | 0.01 | 0.01 | 0.01 | 0.01 |
| 18 | 6.05 | 5.68 | 4.98 | 5.87 | 5.30 | 5.90 | 7.21 | 5.30 | 5.91 | 5.70 |
| 19 | 0.09 | 0.19 | 0.20 | 0.14 | 0.13 | 0.13 | 0.15 | 0.19 | 0.10 | 0.12 |
| 20 | 0.05 | 0.10 | 0.12 | 0.07 | 0.08 | 0.08 | 0.14 | 0.10 | 0.16 | 0.14 |
| 21 | 32.73 | 35.14 | 27.97 | 30.93 | 34.53 | 29.99 | 32.09 | 31.86 | 32.51 | 34.32 |
| 22 | 6.50 | 8.77 | 10.40 | 6.80 | 9.03 | 9.00 | 7.97 | 9.17 | 6.50 | 7.23 |
| 23 | 11.17 | 15.87 | 18.43 | 12.20 | 16.03 | 14.63 | 14.60 | 17.27 | 13.43 | 13.91 |
| 24 | 3.00 | 3.00 | 3.50 | 3.17 | 3.40 | 3.20 | 3.13 | 3.07 | 3.07 | 3.00 |
| 25 | 3.90 | 4.13 | 4.63 | 4.17 | 4.27 | 4.23 | 4.20 | 4.30 | 4.17 | 4.00 |
| 26 | 4.73 | 5.33 | 5.43 | 5.50 | 5.33 | 5.07 | 4.50 | 5.40 | 5.37 | 5.18 |
| 27 | 0.08 | 0.15 | 0.19 | 0.11 | 0.13 | 0.16 | 0.15 | 0.15 | 0.11 | 0.14 |
| 28 | 0.07 | 0.11 | 0.16 | 0.09 | 0.08 | 0.11 | 0.14 | 0.13 | 0.11 | 0.14 |
| 29 | 28.62 | 30.31 | 27.04 | 32.28 | 28.28 | 29.89 | 32.47 | 28.63 | 31.71 | 29.56 |
| 30 | 0.00 | 0.01 | 0.01 | 0.01 | 0.01 | 0.01 | 0.01 | 0.01 | 0.01 | 0.01 |
| 31 | 0.00 | 0.00 | 0.01 | 0.00 | 0.00 | 0.00 | 0.00 | 0.00 | 0.00 | 0.00 |
| 32 | 0.01 | 0.01 | 0.02 | 0.01 | 0.01 | 0.01 | 0.01 | 0.01 | 0.01 | 0.01 |
| 33 | 5.01 | 5.00 | 4.82 | 5.02 | 4.31 | 4.29 | 5.37 | 4.25 | 5.87 | 5.53 |
| 34 | 1.65 | 3.87 | 5.14 | 2.58 | 3.18 | 3.08 | 3.95 | 4.00 | 2.02 | 3.97 |
| 35 | 0.86 | 2.19 | 2.83 | 1.69 | 1.76 | 1.96 | 2.27 | 2.04 | 1.09 | 1.88 |
| 36 | 2.51 | 6.06 | 7.96 | 4.28 | 4.94 | 5.04 | 6.22 | 6.04 | 3.11 | 5.85 |
| 37 | 1.98 | 1.94 | 1.90 | 1.59 | 1.81 | 1.58 | 1.76 | 1.99 | 1.89 | 2.20 |
| 38 | 0.10 | 0.24 | 0.31 | 0.16 | 0.19 | 0.19 | 0.24 | 0.24 | 0.19 | 0.24 |
| 39 | 0.05 | 0.13 | 0.17 | 0.10 | 0.11 | 0.12 | 0.14 | 0.12 | 0.10 | 0.11 |
| 40 | 26.70 | 29.33 | 29.86 | 29.09 | 24.98 | 24.62 | 30.79 | 25.50 | 32.89 | 33.54 |
| 41 | 0.16 | 0.19 | 0.16 | 0.17 | 0.17 | 0.17 | 0.17 | 0.17 | 0.17 | 0.20 |
| 42 | 0.00 | 0.01 | 0.01 | 0.00 | 0.00 | 0.00 | 0.00 | 0.01 | 0.00 | 0.00 |
| 43 | 0.00 | 0.00 | 0.00 | 0.00 | 0.00 | 0.00 | 0.00 | 0.00 | 0.01 | 0.00 |

TABLE 24-continued

Sorghum accessions, measured parameters

Treatment

| Ecotype | Line-1 | Line-2 | Line-3 | Line-4 | Line-5 | Line-6 | Line-7 | Line-8 | Line-9 | Line-10 |
|---|---|---|---|---|---|---|---|---|---|---|
| 44 | 0.00 | 0.01 | 0.01 | 0.01 | 0.01 | 0.01 | 0.01 | 0.01 | 0.01 | 0.01 |
| 45 | 8.18 | 8.50 | 6.12 | 6.98 | 8.49 | 6.92 | 7.76 | 7.08 | 8.60 | 8.17 |

Table 24:
Provided are the measured parameters under 100 mM NaCl and low temperature (8-10° C.) conditions of Sorghum accessions (Seed ID) according to the Correlation ID numbers (described in Table 23 above).

TABLE 25

Correlation between the expression level of selected genes of some embodiments of the invention in roots and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM1009 | 0.78 | 1.30E−02 | 5 | 18 | LYM881 | 0.82 | 2.51E−02 | 1 | 14 |
| LYM881 | 0.81 | 2.58E−02 | 1 | 4 | LYM881 | 0.71 | 3.25E−02 | 5 | 16 |
| LYM881 | 0.77 | 1.56E−02 | 5 | 24 | LYM881 | 0.74 | 2.26E−02 | 5 | 15 |
| LYM881 | 0.75 | 2.09E−02 | 5 | 17 | LYM881 | 0.92 | 4.49E−04 | 5 | 25 |
| LYM884 | 0.85 | 3.41E−03 | 2 | 2 | LYM884 | 0.83 | 5.15E−03 | 2 | 9 |
| LYM884 | 0.87 | 2.24E−03 | 2 | 3 | LYM884 | 0.86 | 2.64E−03 | 2 | 8 |
| LYM884 | 0.83 | 5.15E−03 | 2 | 13 | LYM884 | 0.86 | 2.71E−03 | 2 | 10 |
| LYM884 | 0.86 | 2.64E−03 | 2 | 12 | LYM884 | 0.86 | 2.67E−03 | 2 | 1 |
| LYM884 | 0.76 | 1.66E−02 | 3 | 43 | LYM884 | 0.73 | 2.67E−02 | 3 | 20 |
| LYM884 | 0.72 | 3.01E−02 | 5 | 27 | LYM884 | 0.72 | 2.82E−02 | 5 | 15 |
| LYM884 | 0.71 | 3.06E−02 | 5 | 17 | LYM884 | 0.73 | 2.61E−02 | 5 | 25 |
| LYM884 | 0.74 | 1.48E−02 | 8 | 27 | LYM884 | 0.73 | 1.62E−02 | 8 | 15 |
| LYM884 | 0.70 | 2.29E−02 | 8 | 22 | LYM885 | 0.74 | 2.21E−02 | 2 | 2 |
| LYM885 | 0.72 | 2.92E−02 | 2 | 9 | LYM885 | 0.72 | 2.92E−02 | 2 | 13 |
| LYM885 | 0.73 | 2.58E−02 | 5 | 16 | LYM885 | 0.75 | 1.98E−02 | 5 | 24 |
| LYM885 | 0.79 | 1.16E−02 | 5 | 15 | LYM885 | 0.78 | 1.27E−02 | 5 | 17 |
| LYM885 | 0.74 | 2.30E−02 | 5 | 22 | LYM885 | 0.87 | 2.31E−03 | 5 | 25 |
| LYM886 | 0.88 | 9.65E−03 | 1 | 2 | LYM886 | 0.78 | 3.91E−02 | 1 | 9 |
| LYM886 | 0.80 | 3.08E−02 | 1 | 3 | LYM886 | 0.83 | 2.14E−02 | 1 | 13 |
| LYM886 | 0.74 | 5.58E−02 | 1 | 10 | LYM886 | 0.73 | 6.51E−02 | 1 | 12 |
| LYM886 | 0.72 | 6.54E−02 | 1 | 1 | LYM886 | 0.71 | 3.31E−02 | 3 | 43 |
| LYM886 | 0.78 | 1.26E−02 | 3 | 20 | LYM886 | 0.72 | 2.95E−02 | 6 | 34 |
| LYM886 | 0.79 | 1.18E−02 | 6 | 38 | LYM886 | 0.71 | 3.10E−02 | 5 | 16 |
| LYM886 | 0.73 | 2.64E−02 | 7 | 33 | LYM886 | 0.78 | 1.34E−02 | 7 | 40 |
| LYM887 | 0.71 | 7.59E−02 | 1 | 4 | LYM887 | 0.80 | 5.47E−03 | 8 | 18 |
| LYM889 | 0.77 | 1.42E−02 | 2 | 11 | LYM889 | 0.72 | 1.91E−02 | 8 | 16 |
| LYM890 | 0.72 | 2.90E−02 | 2 | 2 | LYM890 | 0.72 | 2.93E−02 | 2 | 9 |
| LYM890 | 0.72 | 2.93E−02 | 2 | 13 | LYM890 | 0.91 | 7.73E−04 | 3 | 19 |
| LYM890 | 0.82 | 7.02E−03 | 3 | 42 | LYM890 | 0.73 | 2.43E−02 | 5 | 27 |
| LYM890 | 0.72 | 2.96E−02 | 5 | 15 | LYM890 | 0.80 | 9.97E−03 | 5 | 22 |
| LYM890 | 0.88 | 1.86E−03 | 5 | 23 | LYM891 | 0.72 | 3.01E−02 | 5 | 27 |
| LYM891 | 0.80 | 9.84E−03 | 5 | 24 | LYM891 | 0.77 | 1.51E−02 | 5 | 15 |
| LYM891 | 0.76 | 1.83E−02 | 5 | 17 | LYM891 | 0.73 | 2.56E−02 | 5 | 22 |
| LYM891 | 0.87 | 2.23E−03 | 5 | 25 | LYM895 | 0.72 | 2.86E−02 | 5 | 27 |
| LYM895 | 0.74 | 2.40E−02 | 5 | 16 | LYM895 | 0.77 | 1.62E−02 | 5 | 15 |
| LYM895 | 0.77 | 1.46E−02 | 5 | 17 | LYM895 | 0.90 | 8.26E−04 | 5 | 25 |
| LYM896 | 0.75 | 5.16E−02 | 1 | 9 | LYM896 | 0.76 | 4.79E−02 | 1 | 8 |
| LYM896 | 0.77 | 4.10E−02 | 1 | 10 | LYM896 | 0.72 | 2.73E−02 | 2 | 9 |
| LYM896 | 0.72 | 2.73E−02 | 2 | 13 | LYM897 | 0.87 | 2.47E−03 | 5 | 27 |
| LYM897 | 0.83 | 6.09E−03 | 5 | 24 | LYM897 | 0.88 | 1.57E−03 | 5 | 15 |
| LYM897 | 0.80 | 9.30E−03 | 5 | 17 | LYM897 | 0.85 | 3.47E−03 | 5 | 22 |
| LYM897 | 0.84 | 4.38E−03 | 5 | 23 | LYM897 | 0.87 | 2.38E−03 | 5 | 25 |
| LYM898 | 0.80 | 2.96E−02 | 1 | 5 | LYM898 | 0.84 | 4.77E−03 | 5 | 24 |
| LYM898 | 0.87 | 2.49E−03 | 7 | 41 | LYM898 | 0.74 | 1.39E−02 | 8 | 18 |
| LYM900 | 0.70 | 3.56E−02 | 5 | 27 | LYM901 | 0.75 | 5.26E−02 | 1 | 2 |
| LYM901 | 0.73 | 6.01E−02 | 1 | 13 | LYM902 | 0.70 | 7.96E−02 | 1 | 7 |
| LYM902 | 0.82 | 2.48E−02 | 1 | 5 | LYM902 | 0.84 | 4.39E−02 | 5 | 27 |
| LYM902 | 0.86 | 2.68E−03 | 5 | 16 | LYM902 | 0.85 | 4.01E−03 | 5 | 28 |
| LYM902 | 0.83 | 5.81E−03 | 5 | 15 | LYM902 | 0.87 | 2.32E−03 | 5 | 17 |
| LYM902 | 0.72 | 2.75E−02 | 5 | 22 | LYM902 | 0.79 | 1.15E−02 | 5 | 23 |
| LYM902 | 0.76 | 1.66E−02 | 5 | 25 | LYM903 | 0.77 | 1.58E−02 | 5 | 18 |
| LYM904 | 0.77 | 1.52E−02 | 5 | 27 | LYM904 | 0.71 | 3.11E−02 | 5 | 15 |
| LYM904 | 0.80 | 9.77E−03 | 5 | 23 | LYM904 | 0.83 | 5.89E−03 | 5 | 25 |
| LYM905 | 0.85 | 1.61E−02 | 1 | 4 | LYM905 | 0.79 | 1.19E−02 | 5 | 29 |
| LYM907 | 0.77 | 1.61E−02 | 2 | 2 | LYM907 | 0.74 | 2.21E−02 | 2 | 9 |
| LYM907 | 0.80 | 9.66E−03 | 2 | 3 | LYM907 | 0.80 | 1.02E−02 | 2 | 8 |

TABLE 25-continued

Correlation between the expression level of selected genes of some embodiments of the invention in roots and the phenotypic performance under normal or abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM907 | 0.74 | 2.21E-02 | 2 | 13 | LYM907 | 0.79 | 1.22E-02 | 2 | 10 |
| LYM907 | 0.80 | 1.02E-02 | 2 | 12 | LYM907 | 0.80 | 9.00E-03 | 2 | 1 |
| LYM908 | 0.79 | 3.44E-02 | 1 | 9 | LYM908 | 0.80 | 3.05E-02 | 1 | 14 |
| LYM908 | 0.76 | 4.65E-02 | 1 | 4 | LYM908 | 0.71 | 7.21E-02 | 1 | 10 |
| LYM908 | 0.77 | 1.48E-02 | 3 | 19 | LYM911 | 0.84 | 4.53E-03 | 2 | 7 |
| LYM911 | 0.75 | 1.88E-02 | 2 | 5 | LYM911 | 0.86 | 3.23E-03 | 2 | 6 |
| LYM912 | 0.79 | 6.08E-03 | 8 | 29 | LYM912 | 0.75 | 1.28E-02 | 8 | 18 |
| LYM913 | 0.70 | 7.73E-02 | 1 | 3 | LYM913 | 0.79 | 3.64E-02 | 1 | 8 |
| LYM913 | 0.71 | 7.67E-02 | 1 | 13 | LYM913 | 0.76 | 4.80E-02 | 1 | 10 |
| LYM913 | 0.83 | 2.05E-02 | 1 | 12 | LYM913 | 0.71 | 7.37E-02 | 1 | 1 |
| LYM914 | 0.78 | 1.24E-02 | 5 | 22 | LYM916 | 0.77 | 1.60E-02 | 2 | 14 |
| LYM917 | 0.75 | 1.95E-02 | 5 | 27 | LYM917 | 0.73 | 2.47E-02 | 5 | 15 |
| LYM917 | 0.74 | 2.36E-02 | 5 | 17 | LYM917 | 0.85 | 3.41E-03 | 5 | 25 |
| LYM917 | 0.73 | 2.58E-02 | 7 | 33 | LYM919 | 0.78 | 4.00E-02 | 1 | 4 |
| LYM919 | 0.79 | 1.08E-02 | 2 | 2 | LYM919 | 0.76 | 1.73E-02 | 2 | 9 |
| LYM919 | 0.81 | 8.16E-03 | 2 | 3 | LYM919 | 0.79 | 1.12E-02 | 2 | 8 |
| LYM919 | 0.76 | 1.73E-02 | 2 | 13 | LYM919 | 0.79 | 1.15E-02 | 2 | 10 |
| LYM919 | 0.79 | 1.12E-02 | 2 | 12 | LYM919 | 0.80 | 9.01E-03 | 2 | 1 |
| LYM919 | 0.71 | 3.11E-02 | 3 | 19 | LYM919 | 0.77 | 1.60E-02 | 3 | 43 |
| LYM919 | 0.79 | 1.07E-02 | 3 | 20 | LYM919 | 0.85 | 3.63E-03 | 5 | 27 |
| LYM919 | 0.80 | 9.65E-03 | 5 | 15 | LYM919 | 0.76 | 1.85E-02 | 5 | 17 |
| LYM919 | 0.72 | 2.80E-02 | 5 | 23 | LYM920 | 0.78 | 3.83E-02 | 1 | 2 |
| LYM920 | 0.76 | 4.59E-02 | 1 | 3 | LYM920 | 0.75 | 5.20E-02 | 1 | 13 |
| LYM920 | 0.75 | 5.13E-02 | 1 | 12 | LYM920 | 0.72 | 6.72E-02 | 1 | 1 |
| LYM920 | 0.76 | 1.79E-02 | 2 | 2 | LYM920 | 0.77 | 1.47E-02 | 2 | 9 |
| LYM920 | 0.73 | 2.68E-02 | 2 | 3 | LYM920 | 0.72 | 2.72E-02 | 2 | 8 |
| LYM920 | 0.77 | 1.47E-02 | 2 | 13 | LYM920 | 0.75 | 1.96E-02 | 2 | 10 |
| LYM920 | 0.76 | 1.70E-02 | 2 | 6 | LYM920 | 0.72 | 2.72E-02 | 2 | 12 |
| LYM920 | 0.74 | 2.28E-02 | 3 | 21 | LYM920 | 0.71 | 3.36E-02 | 6 | 39 |
| LYM920 | 0.73 | 2.50E-02 | 6 | 35 | LYM920 | 0.83 | 5.81E-03 | 5 | 22 |
| LYM920 | 0.76 | 1.75E-02 | 5 | 23 | LYM920 | 0.72 | 2.78E-02 | 5 | 25 |
| LYM921 | 0.87 | 2.26E-03 | 5 | 26 | LYM922 | 0.74 | 2.27E-02 | 6 | 41 |
| LYM923 | 0.77 | 1.48E-02 | 5 | 24 | LYM924 | 0.84 | 1.83E-02 | 1 | 14 |
| LYM924 | 0.79 | 1.14E-02 | 2 | 2 | LYM924 | 0.72 | 2.71E-02 | 2 | 7 |
| LYM924 | 0.79 | 1.07E-02 | 2 | 9 | LYM924 | 0.75 | 1.89E-02 | 2 | 3 |
| LYM924 | 0.75 | 2.02E-02 | 2 | 8 | LYM924 | 0.79 | 1.07E-02 | 2 | 13 |
| LYM924 | 0.77 | 1.50E-02 | 2 | 10 | LYM924 | 0.78 | 1.36E-02 | 2 | 6 |
| LYM924 | 0.75 | 2.02E-02 | 2 | 12 | LYM924 | 0.72 | 2.82E-02 | 2 | 1 |
| LYM924 | 0.75 | 2.07E-02 | 3 | 19 | LYM924 | 0.87 | 2.57E-03 | 5 | 27 |
| LYM924 | 0.88 | 1.78E-03 | 5 | 15 | LYM924 | 0.80 | 8.88E-03 | 5 | 17 |
| LYM924 | 0.92 | 5.20E-04 | 5 | 22 | LYM924 | 0.91 | 5.43E-04 | 5 | 23 |
| LYM924 | 0.93 | 2.63E-04 | 5 | 25 | LYM928 | 0.76 | 1.77E-02 | 5 | 27 |
| LYM928 | 0.71 | 3.29E-02 | 5 | 16 | LYM928 | 0.76 | 1.68E-02 | 5 | 28 |
| LYM928 | 0.71 | 3.23E-02 | 5 | 17 | LYM929 | 0.76 | 4.95E-02 | 1 | 5 |
| LYM929 | 0.70 | 3.44E-02 | 2 | 3 | LYM929 | 0.73 | 2.57E-02 | 2 | 8 |
| LYM929 | 0.71 | 3.14E-02 | 2 | 10 | LYM929 | 0.73 | 2.57E-02 | 2 | 12 |
| LYM929 | 0.71 | 3.09E-02 | 2 | 1 | LYM929 | 0.76 | 1.75E-02 | 3 | 20 |
| LYM929 | 0.85 | 3.91E-03 | 5 | 27 | LYM929 | 0.84 | 4.42E-03 | 5 | 16 |
| LYM929 | 0.81 | 8.06E-03 | 5 | 28 | LYM929 | 0.85 | 4.04E-03 | 5 | 15 |
| LYM929 | 0.87 | 2.38E-03 | 5 | 17 | LYM929 | 0.75 | 2.06E-02 | 5 | 22 |
| LYM929 | 0.73 | 2.41E-02 | 5 | 23 | LYM929 | 0.85 | 3.54E-03 | 5 | 25 |
| LYM931 | 0.85 | 1.48E-02 | 1 | 11 | LYM932 | 0.72 | 6.62E-02 | 1 | 8 |
| LYM932 | 0.74 | 5.86E-02 | 1 | 13 | LYM932 | 0.71 | 7.64E-02 | 1 | 5 |
| LYM932 | 0.73 | 6.51E-02 | 1 | 10 | LYM934 | 0.72 | 2.88E-02 | 5 | 23 |
| LYM934 | 0.83 | 5.33E-03 | 5 | 25 | LYM935 | 0.72 | 2.82E-02 | 7 | 33 |
| LYM935 | 0.78 | 1.34E-02 | 7 | 40 | LYM936 | 0.80 | 9.37E-03 | 2 | 2 |
| LYM936 | 0.79 | 1.18E-02 | 2 | 9 | LYM936 | 0.75 | 2.03E-02 | 2 | 3 |
| LYM936 | 0.71 | 3.29E-02 | 2 | 8 | LYM936 | 0.79 | 1.18E-02 | 2 | 13 |
| LYM936 | 0.75 | 2.08E-02 | 2 | 10 | LYM936 | 0.71 | 3.29E-02 | 2 | 12 |
| LYM936 | 0.70 | 3.48E-02 | 2 | 1 | LYM936 | 0.86 | 3.28E-03 | 6 | 31 |
| LYM936 | 0.82 | 6.34E-03 | 6 | 36 | LYM936 | 0.79 | 1.19E-02 | 6 | 34 |
| LYM936 | 0.84 | 4.23E-03 | 6 | 38 | LYM936 | 0.95 | 1.13E-04 | 6 | 39 |
| LYM936 | 0.79 | 1.08E-02 | 6 | 30 | LYM936 | 0.83 | 5.99E-03 | 6 | 32 |
| LYM936 | 0.87 | 2.45E-03 | 6 | 35 | LYM936 | 0.76 | 1.79E-02 | 5 | 24 |
| LYM936 | 0.74 | 2.38E-02 | 5 | 25 | LYM936 | 0.80 | 9.04E-03 | 7 | 30 |
| LYM936 | 0.77 | 1.48E-02 | 7 | 32 | LYM937 | 0.72 | 2.72E-02 | 5 | 24 |
| LYM937 | 0.79 | 1.09E-02 | 5 | 25 | LYM939 | 0.74 | 5.51E-02 | 1 | 4 |
| LYM939 | 0.76 | 1.80E-02 | 5 | 22 | LYM939 | 0.71 | 3.05E-02 | 5 | 23 |
| LYM939 | 0.86 | 2.71E-03 | 5 | 25 | LYM940 | 0.73 | 2.67E-02 | 5 | 18 |
| LYM941 | 0.78 | 4.02E-02 | 1 | 7 | LYM941 | 0.86 | 1.23E-02 | 1 | 5 |
| LYM944 | 0.73 | 2.68E-02 | 2 | 2 | LYM944 | 0.72 | 2.90E-02 | 2 | 9 |
| LYM944 | 0.72 | 2.90E-02 | 2 | 13 | LYM944 | 0.74 | 2.33E-02 | 3 | 19 |
| LYM946 | 0.71 | 7.29E-02 | 1 | 6 | LYM947 | 0.75 | 5.08E-02 | 1 | 13 |

TABLE 25-continued

Correlation between the expression level of selected genes of some embodiments
of the invention in roots and the phenotypic performance under normal or
abiotic stress conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM947 | 0.72 | 6.72E−02 | 1 | 12 | LYM948 | 0.71 | 7.52E−02 | 1 | 14 |
| LYM948 | 0.77 | 1.55E−02 | 2 | 2 | LYM948 | 0.76 | 1.85E−02 | 2 | 9 |
| LYM948 | 0.72 | 2.82E−02 | 2 | 3 | LYM948 | 0.76 | 1.85E−02 | 2 | 13 |
| LYM948 | 0.72 | 2.80E−02 | 2 | 10 | LYM948 | 0.82 | 6.91E−03 | 5 | 24 |
| LYM948 | 0.77 | 1.57E−02 | 5 | 15 | LYM948 | 0.74 | 2.14E−02 | 5 | 17 |
| LYM948 | 0.76 | 1.83E−02 | 5 | 22 | LYM948 | 0.90 | 9.72E−04 | 5 | 25 |
| LYM949 | 0.70 | 7.73E−02 | 1 | 11 | LYM949 | 0.70 | 3.41E−02 | 2 | 11 |
| LYM949 | 0.73 | 2.68E−02 | 3 | 19 | LYM949 | 0.83 | 6.15E−03 | 5 | 26 |
| LYM949 | 0.72 | 2.98E−02 | 5 | 23 | LYM951 | 0.87 | 1.14E−02 | 1 | 7 |
| LYM951 | 0.81 | 2.74E−02 | 1 | 5 | LYM951 | 0.74 | 2.20E−02 | 6 | 41 |
| LYM951 | 0.75 | 1.18E−02 | 8 | 29 | LYM952 | 0.73 | 2.57E−02 | 3 | 43 |
| LYM952 | 0.79 | 1.13E−02 | 5 | 29 | LYM952 | 0.77 | 1.60E−02 | 5 | 18 |
| LYM955 | 0.81 | 2.74E−02 | 1 | 9 | LYM955 | 0.86 | 1.26E−02 | 1 | 14 |
| LYM955 | 0.75 | 5.29E−02 | 1 | 8 | LYM955 | 0.79 | 3.46E−02 | 1 | 10 |
| LYM955 | 0.71 | 3.34E−02 | 2 | 2 | LYM955 | 0.73 | 2.46E−02 | 3 | 45 |
| LYM955 | 0.73 | 2.55E−02 | 3 | 21 | LYM955 | 0.74 | 2.17E−02 | 5 | 24 |
| LYM955 | 0.76 | 1.80E−02 | 5 | 15 | LYM955 | 0.71 | 3.27E−02 | 5 | 17 |
| LYM955 | 0.77 | 1.47E−02 | 5 | 22 | LYM955 | 0.72 | 2.75E−02 | 5 | 23 |
| LYM955 | 0.90 | 9.60E−04 | 5 | 25 | LYM956 | 0.87 | 1.19E−02 | 1 | 2 |
| LYM956 | 0.87 | 1.15E−02 | 1 | 9 | LYM956 | 0.81 | 2.65E−02 | 1 | 3 |
| LYM956 | 0.82 | 2.37E−02 | 1 | 8 | LYM956 | 0.92 | 3.30E−03 | 1 | 13 |
| LYM956 | 0.86 | 1.35E−02 | 1 | 10 | LYM956 | 0.86 | 1.33E−02 | 1 | 12 |
| LYM956 | 0.75 | 5.26E−02 | 1 | 1 | LYM956 | 0.71 | 3.28E−02 | 6 | 33 |
| LYM956 | 0.81 | 8.05E−03 | 6 | 40 | LYM956 | 0.80 | 5.25E−03 | 8 | 16 |
| LYM956 | 0.75 | 1.17E−02 | 8 | 28 | LYM956 | 0.71 | 2.03E−02 | 8 | 15 |
| LYM956 | 0.78 | 7.38E−03 | 8 | 17 | LYM956 | 0.77 | 9.44E−03 | 8 | 25 |
| LYM957 | 0.85 | 1.56E−02 | 1 | 9 | LYM957 | 0.87 | 1.04E−02 | 1 | 8 |
| LYM957 | 0.78 | 3.74E−02 | 1 | 13 | LYM957 | 0.88 | 8.16E−03 | 1 | 10 |
| LYM957 | 0.79 | 3.38E−02 | 1 | 12 | LYM957 | 0.76 | 1.86E−02 | 5 | 27 |
| LYM957 | 0.83 | 5.09E−03 | 5 | 15 | LYM957 | 0.75 | 1.95E−02 | 5 | 17 |
| LYM957 | 0.90 | 1.08E−03 | 5 | 22 | LYM957 | 0.86 | 2.92E−03 | 5 | 23 |
| LYM957 | 0.86 | 3.30E−03 | 5 | 25 | LYM958 | 0.73 | 2.70E−02 | 2 | 4 |
| LYM959 | 0.71 | 3.11E−02 | 5 | 27 | LYM959 | 0.78 | 1.22E−02 | 5 | 24 |
| LYM959 | 0.73 | 2.70E−02 | 5 | 15 | LYM959 | 0.85 | 3.57E−03 | 5 | 25 |
| LYM961 | 0.74 | 2.38E−02 | 7 | 38 | LYM961 | 0.71 | 3.12E−02 | 7 | 39 |
| LYM961 | 0.71 | 3.18E−02 | 7 | 30 | LYM961 | 0.71 | 3.32E−02 | 7 | 32 |
| LYM962 | 0.76 | 1.83E−02 | 2 | 14 | LYM962 | 0.80 | 1.02E−02 | 2 | 4 |
| LYM964 | 0.74 | 5.50E−02 | 1 | 7 | LYM964 | 0.71 | 7.18E−02 | 1 | 5 |
| LYM967 | 0.77 | 9.89E−03 | 8 | 29 | LYM968 | 0.77 | 1.44E−02 | 3 | 19 |
| LYM968 | 0.90 | 1.02E−03 | 5 | 27 | LYM968 | 0.72 | 2.92E−02 | 5 | 16 |
| LYM968 | 0.93 | 3.03E−04 | 5 | 15 | LYM968 | 0.85 | 3.48E−03 | 5 | 17 |
| LYM968 | 0.92 | 4.34E−04 | 5 | 22 | LYM968 | 0.90 | 8.11E−04 | 5 | 23 |
| LYM968 | 0.83 | 5.92E−03 | 5 | 25 | LYM969 | 0.72 | 1.95E−02 | 8 | 27 |
| LYM969 | 0.88 | 8.64E−04 | 8 | 16 | LYM969 | 0.83 | 2.77E−03 | 8 | 28 |
| LYM969 | 0.76 | 1.16E−02 | 8 | 15 | LYM969 | 0.84 | 2.25E−03 | 8 | 17 |
| LYM969 | 0.74 | 1.51E−02 | 8 | 26 | LYM969 | 0.74 | 1.47E−02 | 8 | 25 |
| LYM972 | 0.77 | 4.42E−02 | 1 | 4 | LYM972 | 0.76 | 1.69E−02 | 2 | 2 |
| LYM972 | 0.74 | 2.34E−02 | 2 | 9 | LYM972 | 0.71 | 3.10E−02 | 2 | 3 |
| LYM972 | 0.74 | 2.34E−02 | 2 | 13 | LYM972 | 0.71 | 3.12E−02 | 3 | 20 |
| LYM972 | 0.71 | 3.07E−02 | 5 | 16 | LYM972 | 0.73 | 2.53E−02 | 5 | 15 |
| LYM972 | 0.74 | 2.16E−02 | 5 | 17 | LYM972 | 0.81 | 8.03E−03 | 5 | 25 |
| LYM974 | 0.76 | 1.77E−02 | 6 | 41 | LYM974 | 0.77 | 4.38E−02 | 1 | 11 |
| LYM974 | 0.74 | 2.14E−02 | 5 | 18 | LYM974 | 0.86 | 2.74E−03 | 5 | 29 |
| LYM976 | 0.72 | 2.80E−02 | 5 | 15 | LYM976 | 0.70 | 3.51E−02 | 5 | 27 |
| LYM976 | 0.72 | 1.80E−02 | 8 | 29 | LYM976 | 0.73 | 2.62E−02 | 5 | 25 |
| LYM977 | 0.75 | 1.22E−02 | 8 | 18 | LYM977 | 0.72 | 1.91E−02 | 8 | 29 |
| LYM978 | 0.74 | 5.57E−02 | 1 | 13 | LYM978 | 0.85 | 1.43E−02 | 1 | 9 |
| LYM978 | 0.75 | 2.05E−02 | 3 | 44 | LYM978 | 0.73 | 6.06E−02 | 1 | 10 |
| LYM978 | 0.83 | 6.10E−03 | 5 | 18 | LYM978 | 0.71 | 3.04E−02 | 5 | 29 |
| LYM979 | 0.87 | 2.55E−03 | 7 | 41 | LYM979 | 0.71 | 3.26E−02 | 6 | 38 |
|  |  |  |  |  | LYM979 | 0.80 | 5.76E−03 | 8 | 29 |
| LYM979 | 0.74 | 1.41E−02 | 8 | 18 |  |  |  |  |  |

Table 25.
Provided are the correlations (R) between the expression levels yield improving genes and their homologues in various tissues [Expression sets (Exp)] and the phenotypic performance [yield, biomass, growth rate and/or vigor components (Correlation vector)] under abiotic stress conditions (salinity) or normal conditions across Sorghum accessions.
Corr. - Correlation vector as described hereinabove (Table 23).
P = p value.

Example 7

Production of Maize Transcriptom and High Throughput Correlation Analysis Using 60K Maize Oligonucleotide Micro-Array To produce a high throughput correlation analysis, the present inventors utilized a Maize oligonucleotide microarray, produced by Agilent Technologies [Hypertxt Transfer Protocol://World Wide Web (dot) chem. (dot) agilent (dot) com/Scripts/PDS (dot) asp?1 Page=50879]. The array oligonucleotide represents about 60K Maize genes and transcripts designed based on data from Public databases (Example 1). To define correlations between the levels of RNA expression and yield, biomass components or vigor related parameters, various plant characteristics of 12 different Maize hybrids were analyzed. Among them, 10 hybrids encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Five tissues at different developmental stages including Ear (flowering –R1), leaf (flowering –R1), Leaf Grain from the basal ear part, Grain from the distal ear, representing different plant characteristics, were sampled and RNA was extracted as described in "GENERAL EXPERIMENTAL AND BIOINFORMATICS METHODS". For convenience, each micro-array expression information tissue type has received a Set ID as summarized in Table 26 below.

TABLE 26

Tissues used for Maize transcriptom expression sets

| Expression Set | Set ID |
|---|---|
| Ear under normal conditions at reproductive stage: R1-R2 | 1 |
| Grain distal under normal conditions at reproductive stage: R1-R2 | 2 |
| Leaf under normal conditions at vegetative stage: Vegetative V2-3 | 3 |
| Internode under normal conditions at vegetative stage: Vegetative V2-3 | 4 |
| Internode under normal conditions at reproductive stage: R3-R4 | 5 |
| Ear under normal conditions at reproductive stage: R3-R4 | 6 |

Table 26:
Provided are the identification (ID) number of each of the Maize expression sets The following parameters were collected:

Grain Area ($cm^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was to divided by the number of grains.

Ear Area ($cm^2$)—At the end of the growing period 6 ears were, photographed and images were processed using the below described image processing system. The Ear area was measured from those images and was divided by the number of Ears.

Ear Length and Ear Width (cm) At the end of the growing period 6 ears were, photographed and images were processed using the below described image processing system. The Ear length and width (longest axis) was measured from those images and was divided by the number of ears.

Filled per Whole Ear—it was calculated as the length of the ear with grains out of the total ear.

Percent Filled Ear—At the end of the growing period 6 ears were, photographed and images were processed using the below described image processing system. The percent filled Ear grain was the ear with grains out of the total ear and was measured from those images and was divided by the number of Ears.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 6 plants per plot or by measuring the parameter across all the plants within the plot.

Normalized Grain Weight per plant (gr.), measurement of yield parameter—At the end of the experiment all ears from plots within blocks A-C were collected. Six ears were separately threshed and grains were weighted, all additional ears were threshed together and weighted as well. The grain weight was normalized using the relative humidity to be 0%. The normalized average grain weight per ear was calculated by dividing the total normalized grain weight by the total number of ears per plot (based on plot). In case of 6 ears, the total grains weight of 6 ears was divided by 6.

Ear fresh weight (FW) (gr.)—At the end of the experiment (when ears were harvested) total and 6 selected ears per plots within blocks A-C were collected separately. The plants' ears (total and 6) were weighted (gr.) separately and the average ear per plant was calculated for total (Ear FW per plot) and for 6 (Ear FW per plant).

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Leaf number per plant—Plants were characterized for leaf number during growing period at 5 time points. In each measure, plants were measured for their leaf number by counting all the leaves of 3 selected plants per plot.

Relative Growth Rate was calculated using regression coefficient of leaf number change a long time course.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS)

Dry weight per plant—At the end of the experiment when all vegetative material from plots within blocks A-C were collected, weight and divided by the number of plants.

Ear diameter [cm]—The diameter of the ear at the mid of the ear was measured using a ruler.

Cob diameter [cm]—The diameter of the cob without grains was measured using a ruler.

Kernel Row Number per Ear—The number of rows in each ear was counted. The average of 6 ears per plot was calculated.

Leaf area index [LAI]=total leaf area of all plants in a plot. Measurement was performed using a Leaf area-meter.

Yield/LAI [kg]—is the ratio between total grain yields and total leaf area index.

TABLE 27

Maize correlated parameters (vectors)

| Correlated parameter with | Correlation ID |
|---|---|
| SPAD R1 | 1 |
| SPAD R2 | 2 |
| Growth Rate Leaf Number | 3 |
| Plant Height per Plot (cm) | 4 |
| Ear Height (cm) | 5 |
| Leaf Number per Plant | 6 |
| Ear Length (cm) | 7 |
| Percent Filled Ear | 8 |
| Cob Diameter (mm) | 9 |
| Kernel Row Number per Ear | 10 |
| DW per Plant based on 6 (gr.) | 11 |
| Ear FW per Plant based on 6 (gr.) | 12 |
| Normalized Grain Weight per plant based on 6 (gr.) | 13 |
| Ears FW per plant based on all (gr.) | 14 |
| Normalized Grain Weight per Plant based on all (gr.) | 15 |
| Ear Area (cm$^2$) | 16 |
| Ear Width (cm) | 17 |
| Filled per Whole Ear | 18 |
| Grain Area (cm$^2$) | 19 |
| Grain Length (cm) | 20 |
| Grain Width (cm) | 21 |

Table 27.

Twelve maize varieties were grown, and characterized for parameters, as described above. The average for each parameter was calculated using the JMP software, and values are summarized in Tables 28-29 below. Subsequent correlation between the various transcriptom sets for all or sub sets of lines was done by the bioinformatic unit and results were integrated into the database (Table 30 below).

TABLE 28

Measured parameters in Maize Hybrid

| Ecotype | Treatment | | | | |
|---|---|---|---|---|---|
| | Line-1 | Line-2 | Line-3 | Line-4 | Line-5 |
| 1 | 54.28 | 57.18 | 56.01 | 59.68 | 54.77 |
| 2 | 51.67 | 56.41 | 53.55 | 55.21 | 55.30 |
| 3 | 0.28 | 0.22 | 0.28 | 0.27 | 0.31 |
| 4 | 278.08 | 260.50 | 275.13 | 238.50 | 286.94 |
| 5 | 135.17 | 122.33 | 131.97 | 114.00 | 135.28 |
| 6 | 12.00 | 11.11 | 11.69 | 11.78 | 11.94 |
| 7 | 19.69 | 19.05 | 20.52 | 21.34 | 20.92 |
| 8 | 80.62 | 86.76 | 82.14 | 92.71 | 80.38 |
| 9 | 28.96 | 25.08 | 28.05 | 25.73 | 28.72 |
| 10 | 16.17 | 14.67 | 16.20 | 15.89 | 16.17 |
| 11 | 657.50 | 491.67 | 641.11 | 580.56 | 655.56 |
| 12 | 245.83 | 208.33 | 262.22 | 263.89 | 272.22 |
| 13 | 140.68 | 139.54 | 153.67 | 176.98 | 156.61 |
| 14 | 278.19 | 217.50 | 288.28 | 247.88 | 280.11 |
| 15 | 153.90 | 135.88 | 152.50 | 159.16 | 140.46 |
| 16 | 85.06 | 85.84 | 90.51 | 95.95 | 91.62 |
| 17 | 5.58 | 5.15 | 5.67 | 5.53 | 5.73 |
| 18 | 0.92 | 0.92 | 0.93 | 0.92 | 0.91 |
| 19 | 0.75 | 0.71 | 0.75 | 0.77 | 0.81 |
| 20 | 1.17 | 1.09 | 1.18 | 1.20 | 1.23 |
| 21 | 0.81 | 0.81 | 0.80 | 0.80 | 0.82 |

Table 28.

TABLE 29

Measured parameters in Maize Hybrid additional parameters

| Treatment | Ecotype | | | | | | |
|---|---|---|---|---|---|---|---|
| | Line-6 | Line-7 | Line-8 | Line-9 | Line-10 | Line-11 | Line-12 |
| 1 | 59.14 | 57.99 | 60.36 | 54.77 | 51.39 | 61.14 | 53.34 |
| 2 | 59.35 | 58.48 | 55.88 | 52.98 | 53.86 | 59.75 | 49.99 |
| 3 | 0.24 | 0.24 | 0.27 | | 0.19 | 0.30 | |
| 4 | 224.83 | 264.44 | 251.61 | | 163.78 | 278.44 | |
| 5 | 94.28 | 120.94 | 107.72 | | 60.44 | 112.50 | |
| 6 | 12.33 | 12.44 | 12.22 | | 9.28 | 12.56 | |
| 7 | 18.23 | 19.02 | 18.57 | | 16.69 | 21.70 | |
| 8 | 82.76 | 73.25 | 81.06 | | 81.06 | 91.60 | |
| 9 | 25.78 | 26.43 | 25.19 | | 26.67 | | |
| 10 | 15.17 | 16.00 | 14.83 | | 14.27 | 15.39 | |
| 11 | 569.44 | 511.11 | 544.44 | | 574.17 | 522.22 | |
| 12 | 177.78 | 188.89 | 197.22 | | 141.11 | 261.11 | |
| 13 | 119.67 | 119.69 | 133.51 | | 54.32 | 173.23 | |
| 14 | 175.84 | 192.47 | 204.70 | | 142.72 | 264.24 | |
| 15 | 117.14 | 123.24 | 131.27 | | 40.84 | 170.66 | |
| 16 | 72.41 | 74.03 | 76.53 | | 55.20 | 95.36 | |
| 17 | 5.23 | 5.22 | 5.33 | | 4.12 | 5.58 | |
| 18 | 0.95 | 0.87 | 0.94 | | 0.80 | 0.96 | |
| 19 | 0.71 | 0.71 | 0.75 | | 0.50 | 0.76 | |
| 20 | 1.12 | 1.14 | 1.13 | | 0.92 | 1.18 | |
| 21 | 0.80 | 0.79 | 0.84 | | 0.67 | 0.81 | |

Table 29.

TABLE 30

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM798 | 0.72 | 0.04 | 5 | 3 | LYM798 | 0.72 | 0.07 | 7 | 5 |
| LYM798 | 0.72 | 0.07 | 7 | 21 | LYM798 | 0.70 | 0.08 | 1 | 6 |
| LYM798 | 0.79 | 0.02 | 2 | 9 | LYM798 | 0.97 | 0.00 | 2 | 3 |
| LYM798 | 0.88 | 0.00 | 2 | 20 | LYM798 | 0.96 | 0.00 | 2 | 19 |
| LYM798 | 0.80 | 0.02 | 2 | 11 | LYM798 | 0.88 | 0.00 | 2 | 17 |
| LYM798 | 0.71 | 0.05 | 2 | 14 | LYM798 | 0.73 | 0.04 | 2 | 12 |
| LYM798 | 0.74 | 0.09 | 6 | 10 | LYM798 | 0.77 | 0.08 | 6 | 6 |
| LYM800 | 0.72 | 0.07 | 7 | 15 | LYM800 | 0.71 | 0.07 | 7 | 10 |
| LYM800 | 0.77 | 0.04 | 7 | 20 | LYM800 | 0.78 | 0.04 | 7 | 18 |
| LYM800 | 0.78 | 0.04 | 7 | 19 | LYM800 | 0.74 | 0.06 | 7 | 4 |
| LYM800 | 0.83 | 0.02 | 7 | 5 | LYM800 | 0.82 | 0.02 | 7 | 17 |
| LYM800 | 0.75 | 0.05 | 7 | 21 | LYM800 | 0.70 | 0.08 | 8 | 18 |
| LYM800 | 0.72 | 0.07 | 8 | 21 | LYM800 | 0.72 | 0.07 | 1 | 6 |
| LYM800 | 0.72 | 0.07 | 1 | 20 | LYM800 | 0.74 | 0.06 | 1 | 18 |
| LYM800 | 0.79 | 0.03 | 1 | 19 | LYM800 | 0.75 | 0.05 | 1 | 5 |
| LYM800 | 0.72 | 0.07 | 1 | 17 | LYM800 | 0.85 | 0.02 | 1 | 21 |
| LYM800 | 0.70 | 0.04 | 4 | 10 | LYM800 | 0.74 | 0.02 | 4 | 5 |
| LYM801 | 0.77 | 0.04 | 1 | 21 | LYM801 | 0.79 | 0.06 | 6 | 10 |
| LYM802 | 0.72 | 0.07 | 7 | 16 | LYM802 | 0.72 | 0.07 | 7 | 4 |
| LYM802 | 0.73 | 0.06 | 8 | 16 | LYM802 | 0.72 | 0.07 | 8 | 15 |
| LYM802 | 0.70 | 0.08 | 8 | 18 | LYM802 | 0.78 | 0.04 | 8 | 4 |
| LYM802 | 0.76 | 0.05 | 8 | 5 | LYM802 | 0.75 | 0.05 | 1 | 16 |
| LYM802 | 0.87 | 0.01 | 1 | 15 | LYM802 | 0.96 | 0.00 | 1 | 6 |
| LYM802 | 0.91 | 0.00 | 1 | 3 | LYM802 | 0.88 | 0.01 | 1 | 20 |
| LYM802 | 0.77 | 0.04 | 1 | 7 | LYM802 | 0.96 | 0.00 | 1 | 18 |
| LYM802 | 0.88 | 0.01 | 1 | 19 | LYM802 | 0.86 | 0.01 | 1 | 4 |
| LYM802 | 0.73 | 0.06 | 1 | 5 | LYM802 | 0.87 | 0.01 | 1 | 17 |
| LYM802 | 0.87 | 0.01 | 1 | 21 | LYM802 | 0.71 | 0.08 | 1 | 12 |
| LYM802 | 0.84 | 0.02 | 1 | 13 | LYM802 | 0.81 | 0.02 | 2 | 9 |
| LYM802 | 0.71 | 0.05 | 2 | 11 | LYM802 | 0.83 | 0.00 | 3 | 4 |
| LYM802 | 0.76 | 0.01 | 3 | 5 | LYM802 | 0.73 | 0.03 | 4 | 4 |
| LYM802 | 0.84 | 0.04 | 6 | 6 | LYM803 | 0.76 | 0.05 | 7 | 7 |
| LYM803 | 0.87 | 0.01 | 7 | 8 | LYM803 | 0.70 | 0.08 | 8 | 15 |
| LYM803 | 0.74 | 0.06 | 8 | 7 | LYM803 | 0.81 | 0.03 | 8 | 8 |
| LYM803 | 0.79 | 0.03 | 1 | 16 | LYM803 | 0.85 | 0.02 | 1 | 15 |
| LYM803 | 0.83 | 0.02 | 1 | 6 | LYM803 | 0.85 | 0.01 | 1 | 3 |
| LYM803 | 0.79 | 0.03 | 1 | 20 | LYM803 | 0.83 | 0.02 | 1 | 7 |
| LYM803 | 0.86 | 0.01 | 1 | 18 | LYM803 | 0.77 | 0.04 | 1 | 19 |
| LYM803 | 0.81 | 0.03 | 1 | 4 | LYM803 | 0.82 | 0.02 | 1 | 17 |
| LYM803 | 0.74 | 0.06 | 1 | 14 | LYM803 | 0.76 | 0.05 | 1 | 12 |
| LYM803 | 0.81 | 0.03 | 1 | 13 | LYM803 | 0.80 | 0.02 | 2 | 8 |
| LYM803 | 0.84 | 0.00 | 3 | 16 | LYM803 | 0.83 | 0.00 | 3 | 15 |
| LYM803 | 0.86 | 0.00 | 3 | 7 | LYM803 | 0.86 | 0.00 | 3 | 8 |
| LYM803 | 0.77 | 0.01 | 3 | 12 | LYM803 | 0.83 | 0.00 | 3 | 13 |
| LYM803 | 0.83 | 0.01 | 4 | 16 | LYM803 | 0.85 | 0.00 | 4 | 15 |
| LYM803 | 0.75 | 0.02 | 4 | 6 | LYM803 | 0.73 | 0.03 | 4 | 20 |
| LYM803 | 0.84 | 0.00 | 4 | 7 | LYM803 | 0.71 | 0.03 | 4 | 18 |
| LYM803 | 0.73 | 0.02 | 4 | 19 | LYM803 | 0.80 | 0.01 | 4 | 4 |
| LYM803 | 0.72 | 0.03 | 4 | 17 | LYM803 | 0.71 | 0.03 | 4 | 21 |
| LYM803 | 0.85 | 0.00 | 4 | 13 | LYM803 | 0.71 | 0.11 | 6 | 6 |
| LYM803 | 0.92 | 0.01 | 6 | 18 | LYM803 | 0.76 | 0.08 | 6 | 8 |
| LYM804 | 0.81 | 0.03 | 7 | 6 | LYM804 | 0.78 | 0.04 | 7 | 18 |
| LYM804 | 0.72 | 0.07 | 8 | 15 | LYM804 | 0.93 | 0.00 | 8 | 6 |
| LYM804 | 0.88 | 0.01 | 8 | 1 | LYM804 | 0.73 | 0.06 | 8 | 20 |
| LYM804 | 0.90 | 0.01 | 8 | 18 | LYM804 | 0.75 | 0.05 | 8 | 19 |
| LYM804 | 0.73 | 0.06 | 8 | 17 | LYM804 | 0.75 | 0.05 | 8 | 21 |
| LYM804 | 0.79 | 0.04 | 1 | 6 | LYM804 | 0.82 | 0.02 | 1 | 18 |
| LYM804 | 0.75 | 0.05 | 1 | 21 | LYM804 | 0.76 | 0.03 | 2 | 21 |
| LYM804 | 0.77 | 0.01 | 4 | 18 | LYM805 | 0.74 | 0.06 | 7 | 10 |
| LYM805 | 0.72 | 0.10 | 6 | 20 | LYM805 | 0.71 | 0.12 | 6 | 12 |
| LYM806 | 0.82 | 0.01 | 5 | 10 | LYM806 | 0.83 | 0.01 | 5 | 20 |
| LYM806 | 0.73 | 0.04 | 5 | 17 | LYM806 | 0.88 | 0.02 | 1 | 9 |
| LYM806 | 0.79 | 0.04 | 1 | 11 | LYM806 | 0.71 | 0.05 | 2 | 10 |
| LYM806 | 0.72 | 0.05 | 2 | 17 | LYM806 | 0.76 | 0.08 | 6 | 10 |
| LYM807 | 0.72 | 0.04 | 5 | 20 | LYM807 | 0.77 | 0.03 | 5 | 19 |
| LYM807 | 0.74 | 0.06 | 7 | 16 | LYM807 | 0.77 | 0.04 | 7 | 15 |
| LYM807 | 0.81 | 0.03 | 7 | 20 | LYM807 | 0.71 | 0.08 | 7 | 18 |
| LYM807 | 0.84 | 0.02 | 7 | 19 | LYM807 | 0.71 | 0.08 | 7 | 4 |
| LYM807 | 0.87 | 0.01 | 7 | 5 | LYM807 | 0.81 | 0.03 | 7 | 17 |
| LYM807 | 0.84 | 0.02 | 7 | 21 | LYM807 | 0.77 | 0.04 | 7 | 13 |
| LYM807 | 0.72 | 0.02 | 3 | 15 | LYM807 | 0.80 | 0.01 | 3 | 4 |
| LYM807 | 0.79 | 0.01 | 3 | 5 | LYM807 | 0.88 | 0.00 | 4 | 16 |
| LYM807 | 0.85 | 0.00 | 4 | 15 | LYM807 | 0.71 | 0.03 | 4 | 10 |
| LYM807 | 0.83 | 0.01 | 4 | 3 | LYM807 | 0.87 | 0.00 | 4 | 20 |

TABLE 30-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM807 | 0.82 | 0.01 | 4 | 7 | LYM807 | 0.71 | 0.03 | 4 | 18 |
| LYM807 | 0.91 | 0.00 | 4 | 19 | LYM807 | 0.94 | 0.00 | 4 | 4 |
| LYM807 | 0.95 | 0.00 | 4 | 5 | LYM807 | 0.90 | 0.00 | 4 | 17 |
| LYM807 | 0.86 | 0.00 | 4 | 14 | LYM807 | 0.87 | 0.00 | 4 | 21 |
| LYM807 | 0.88 | 0.00 | 4 | 12 | LYM807 | 0.88 | 0.00 | 4 | 13 |
| LYM807 | 0.88 | 0.02 | 6 | 18 | LYM807 | 0.76 | 0.08 | 6 | 8 |
| LYM807 | 0.83 | 0.04 | 6 | 21 | LYM808 | 0.71 | 0.07 | 7 | 21 |
| LYM809 | 0.83 | 0.04 | 6 | 10 | LYM811 | 0.82 | 0.01 | 5 | 21 |
| LYM811 | 0.87 | 0.01 | 7 | 6 | LYM811 | 0.80 | 0.03 | 7 | 18 |
| LYM811 | 0.87 | 0.01 | 8 | 6 | LYM811 | 0.88 | 0.01 | 8 | 1 |
| LYM811 | 0.80 | 0.03 | 8 | 18 | LYM811 | 0.75 | 0.05 | 8 | 19 |
| LYM811 | 0.82 | 0.02 | 8 | 21 | LYM811 | 0.78 | 0.04 | 1 | 6 |
| LYM811 | 0.76 | 0.05 | 1 | 18 | LYM811 | 0.72 | 0.05 | 2 | 4 |
| LYM811 | 0.82 | 0.00 | 3 | 6 | LYM811 | 0.80 | 0.01 | 4 | 6 |
| LYM811 | 0.77 | 0.07 | 6 | 6 | LYM811 | 0.87 | 0.03 | 6 | 10 |
| LYM812 | 0.86 | 0.03 | 6 | 5 | LYM813 | 0.80 | 0.02 | 5 | 6 |
| LYM813 | 0.80 | 0.02 | 5 | 18 | LYM813 | 0.77 | 0.04 | 7 | 4 |
| LYM813 | 0.70 | 0.08 | 1 | 6 | LYM813 | 0.78 | 0.02 | 2 | 9 |
| LYM813 | 0.71 | 0.05 | 2 | 11 | LYM814 | 0.77 | 0.04 | 8 | 6 |
| LYM814 | 0.75 | 0.05 | 8 | 3 | LYM814 | 0.81 | 0.05 | 1 | 9 |
| LYM814 | 0.71 | 0.05 | 2 | 10 | LYM814 | 0.90 | 0.01 | 6 | 21 |
| LYM815 | 0.72 | 0.07 | 7 | 10 | LYM815 | 0.72 | 0.07 | 7 | 6 |
| LYM815 | 0.73 | 0.06 | 7 | 20 | LYM815 | 0.72 | 0.07 | 7 | 18 |
| LYM815 | 0.72 | 0.07 | 7 | 19 | LYM815 | 0.75 | 0.05 | 7 | 17 |
| LYM815 | 0.92 | 0.00 | 2 | 9 | LYM815 | 0.82 | 0.01 | 2 | 3 |
| LYM815 | 0.72 | 0.05 | 2 | 19 | LYM815 | 0.77 | 0.03 | 2 | 4 |
| LYM815 | 0.87 | 0.00 | 2 | 11 | LYM815 | 0.77 | 0.02 | 2 | 5 |
| LYM815 | 0.81 | 0.01 | 2 | 17 | LYM815 | 0.83 | 0.01 | 2 | 14 |
| LYM815 | 0.70 | 0.05 | 2 | 12 | LYM815 | 0.91 | 0.01 | 6 | 18 |
| LYM815 | 0.85 | 0.03 | 6 | 21 | LYM816 | 0.73 | 0.06 | 8 | 3 |
| LYM816 | 0.78 | 0.04 | 8 | 7 | LYM816 | 0.71 | 0.07 | 8 | 8 |
| LYM816 | 0.78 | 0.04 | 1 | 15 | LYM816 | 0.82 | 0.02 | 1 | 6 |
| LYM816 | 0.77 | 0.04 | 1 | 20 | LYM816 | 0.87 | 0.01 | 1 | 18 |
| LYM816 | 0.89 | 0.01 | 1 | 19 | LYM816 | 0.82 | 0.02 | 1 | 4 |
| LYM816 | 0.78 | 0.04 | 1 | 5 | LYM816 | 0.81 | 0.03 | 1 | 17 |
| LYM816 | 0.98 | 0.00 | 1 | 21 | LYM816 | 0.72 | 0.07 | 1 | 13 |
| LYM816 | 0.70 | 0.04 | 3 | 9 | LYM816 | 0.81 | 0.00 | 3 | 10 |
| LYM816 | 0.74 | 0.01 | 3 | 11 | LYM816 | 0.72 | 0.02 | 3 | 5 |
| LYM817 | 0.77 | 0.03 | 5 | 21 | LYM817 | 0.86 | 0.01 | 2 | 6 |
| LYM819 | 0.79 | 0.02 | 5 | 16 | LYM819 | 0.78 | 0.02 | 5 | 20 |
| LYM819 | 0.88 | 0.00 | 5 | 7 | LYM819 | 0.77 | 0.03 | 5 | 12 |
| LYM819 | 0.83 | 0.01 | 5 | 13 | LYM819 | 0.73 | 0.10 | 7 | 9 |
| LYM819 | 0.95 | 0.00 | 1 | 9 | LYM819 | 0.77 | 0.04 | 1 | 11 |
| LYM819 | 0.81 | 0.05 | 6 | 16 | LYM819 | 0.82 | 0.05 | 6 | 20 |
| LYM819 | 0.78 | 0.06 | 6 | 7 | LYM819 | 0.78 | 0.06 | 6 | 17 |
| LYM819 | 0.75 | 0.09 | 6 | 14 | LYM819 | 0.81 | 0.05 | 6 | 12 |
| LYM819 | 0.74 | 0.09 | 6 | 13 | LYM820 | 0.78 | 0.07 | 7 | 9 |
| LYM820 | 0.72 | 0.11 | 8 | 9 | LYM820 | 0.84 | 0.03 | 1 | 9 |
| LYM820 | 0.77 | 0.04 | 1 | 18 | LYM820 | 0.75 | 0.05 | 1 | 4 |
| LYM820 | 0.76 | 0.05 | 1 | 5 | LYM820 | 0.81 | 0.03 | 1 | 21 |
| LYM820 | 0.72 | 0.03 | 4 | 19 | LYM820 | 0.71 | 0.03 | 4 | 21 |
| LYM820 | 0.78 | 0.07 | 6 | 16 | LYM820 | 0.88 | 0.02 | 6 | 10 |
| LYM820 | 0.76 | 0.08 | 6 | 20 | LYM820 | 0.76 | 0.08 | 6 | 7 |
| LYM820 | 0.74 | 0.10 | 6 | 17 | LYM820 | 0.76 | 0.08 | 6 | 12 |
| LYM820 | 0.74 | 0.09 | 6 | 13 | LYM821 | 0.82 | 0.01 | 5 | 18 |
| LYM821 | 0.76 | 0.05 | 7 | 16 | LYM821 | 0.74 | 0.06 | 7 | 15 |
| LYM821 | 0.81 | 0.03 | 7 | 10 | LYM821 | 0.71 | 0.07 | 7 | 20 |
| LYM821 | 0.82 | 0.02 | 7 | 4 | LYM821 | 0.90 | 0.01 | 7 | 5 |
| LYM821 | 0.79 | 0.03 | 7 | 17 | LYM821 | 0.91 | 0.00 | 7 | 14 |
| LYM821 | 0.74 | 0.06 | 7 | 21 | LYM821 | 0.81 | 0.03 | 7 | 12 |
| LYM821 | 0.78 | 0.04 | 8 | 6 | LYM821 | 0.81 | 0.03 | 8 | 18 |
| LYM821 | 0.74 | 0.06 | 8 | 19 | LYM821 | 0.84 | 0.02 | 8 | 4 |
| LYM821 | 0.73 | 0.06 | 8 | 5 | LYM821 | 0.72 | 0.07 | 8 | 17 |
| LYM821 | 0.82 | 0.02 | 8 | 21 | LYM821 | 0.93 | 0.00 | 1 | 16 |
| LYM821 | 0.88 | 0.01 | 1 | 15 | LYM821 | 0.81 | 0.03 | 1 | 10 |
| LYM821 | 0.80 | 0.03 | 1 | 20 | LYM821 | 0.83 | 0.02 | 1 | 7 |
| LYM821 | 0.79 | 0.03 | 1 | 19 | LYM821 | 0.87 | 0.01 | 1 | 4 |
| LYM821 | 0.96 | 0.00 | 1 | 5 | LYM821 | 0.84 | 0.02 | 1 | 17 |
| LYM821 | 0.93 | 0.00 | 1 | 14 | LYM821 | 0.90 | 0.01 | 1 | 12 |
| LYM821 | 0.88 | 0.01 | 1 | 13 | LYM821 | 0.74 | 0.01 | 3 | 20 |
| LYM821 | 0.74 | 0.01 | 3 | 19 | LYM821 | 0.82 | 0.00 | 3 | 5 |
| LYM821 | 0.70 | 0.02 | 3 | 17 | LYM821 | 0.76 | 0.02 | 4 | 16 |
| LYM821 | 0.73 | 0.03 | 4 | 7 | LYM821 | 0.83 | 0.01 | 4 | 14 |
| LYM821 | 0.81 | 0.01 | 4 | 12 | LYM821 | 0.86 | 0.03 | 6 | 18 |

TABLE 30-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM821 | 0.83 | 0.04 | 6 | 8 | LYM823 | 0.91 | 0.01 | 7 | 9 |
| LYM823 | 0.82 | 0.02 | 1 | 6 | LYM823 | 0.74 | 0.06 | 1 | 20 |
| LYM823 | 0.73 | 0.06 | 1 | 18 | LYM823 | 0.76 | 0.05 | 1 | 19 |
| LYM823 | 0.70 | 0.08 | 1 | 17 | LYM823 | 0.74 | 0.06 | 1 | 21 |
| LYM823 | 0.87 | 0.00 | 2 | 9 | LYM823 | 0.71 | 0.05 | 2 | 10 |
| LYM823 | 0.86 | 0.01 | 2 | 3 | LYM823 | 0.77 | 0.02 | 2 | 20 |
| LYM823 | 0.76 | 0.03 | 2 | 19 | LYM823 | 0.89 | 0.00 | 2 | 11 |
| LYM823 | 0.85 | 0.01 | 2 | 17 | LYM823 | 0.72 | 0.05 | 2 | 14 |
| LYM823 | 0.84 | 0.00 | 4 | 6 | LYM823 | 0.86 | 0.03 | 6 | 10 |
| LYM823 | 0.76 | 0.08 | 6 | 5 | LYM824 | 0.78 | 0.04 | 7 | 10 |
| LYM824 | 0.70 | 0.08 | 7 | 5 | LYM824 | 0.80 | 0.03 | 7 | 14 |
| LYM824 | 0.93 | 0.00 | 2 | 9 | LYM824 | 0.78 | 0.02 | 2 | 3 |
| LYM824 | 0.71 | 0.05 | 2 | 4 | LYM824 | 0.88 | 0.00 | 2 | 11 |
| LYM824 | 0.76 | 0.03 | 2 | 17 | LYM824 | 0.74 | 0.04 | 2 | 14 |
| LYM825 | 0.70 | 0.05 | 5 | 18 | LYM825 | 0.70 | 0.08 | 7 | 6 |
| LYM825 | 0.75 | 0.05 | 7 | 18 | LYM825 | 0.74 | 0.06 | 7 | 21 |
| LYM825 | 0.74 | 0.06 | 8 | 6 | LYM825 | 0.74 | 0.06 | 8 | 18 |
| LYM825 | 0.74 | 0.06 | 1 | 15 | LYM825 | 0.74 | 0.06 | 1 | 6 |
| LYM825 | 0.83 | 0.02 | 1 | 18 | LYM825 | 0.84 | 0.02 | 1 | 4 |
| LYM825 | 0.74 | 0.06 | 1 | 21 | LYM825 | 0.78 | 0.01 | 4 | 18 |
| LYM825 | 0.75 | 0.02 | 4 | 8 | LYM825 | 0.86 | 0.03 | 6 | 18 |
| LYM825 | 0.71 | 0.12 | 6 | 8 | LYM825 | 0.93 | 0.01 | 6 | 21 |
| LYM826 | 0.71 | 0.08 | 8 | 6 | LYM826 | 0.76 | 0.05 | 1 | 6 |
| LYM826 | 0.70 | 0.08 | 1 | 20 | LYM826 | 0.74 | 0.06 | 1 | 18 |
| LYM826 | 0.73 | 0.06 | 1 | 19 | LYM826 | 0.76 | 0.05 | 1 | 21 |
| LYM826 | 0.80 | 0.02 | 2 | 19 | LYM826 | 0.72 | 0.04 | 2 | 21 |
| LYM826 | 0.85 | 0.00 | 4 | 6 | LYM826 | 0.72 | 0.03 | 4 | 20 |
| LYM826 | 0.71 | 0.03 | 4 | 18 | LYM826 | 0.78 | 0.01 | 4 | 19 |
| LYM826 | 0.84 | 0.00 | 4 | 21 | LYM827 | 0.71 | 0.05 | 5 | 16 |
| LYM827 | 0.70 | 0.05 | 5 | 13 | LYM827 | 0.76 | 0.08 | 6 | 19 |
| LYM827 | 0.70 | 0.12 | 6 | 13 | LYM828 | 0.80 | 0.03 | 7 | 11 |
| LYM828 | 0.79 | 0.04 | 8 | 16 | LYM828 | 0.70 | 0.08 | 8 | 7 |
| LYM828 | 0.82 | 0.02 | 8 | 8 | LYM828 | 0.70 | 0.08 | 8 | 13 |
| LYM828 | 0.72 | 0.02 | 3 | 2 | LYM828 | 0.79 | 0.06 | 6 | 18 |
| LYM828 | 0.80 | 0.05 | 6 | 8 | LYM829 | 0.70 | 0.05 | 5 | 18 |
| LYM829 | 0.71 | 0.08 | 8 | 4 | LYM829 | 0.80 | 0.03 | 8 | 5 |
| LYM829 | 0.85 | 0.02 | 8 | 14 | LYM829 | 0.72 | 0.07 | 8 | 12 |
| LYM829 | 0.86 | 0.01 | 2 | 9 | LYM829 | 0.79 | 0.02 | 2 | 10 |
| LYM829 | 0.91 | 0.00 | 2 | 3 | LYM829 | 0.88 | 0.00 | 2 | 20 |
| LYM829 | 0.84 | 0.01 | 2 | 19 | LYM829 | 0.89 | 0.00 | 2 | 11 |
| LYM829 | 0.89 | 0.00 | 2 | 17 | LYM829 | 0.78 | 0.02 | 2 | 14 |
| LYM829 | 0.78 | 0.02 | 2 | 12 | LYM829 | 0.73 | 0.10 | 6 | 21 |
| LYM830 | 0.81 | 0.00 | 3 | 2 | LYM831 | 0.96 | 0.00 | 6 | 6 |
| LYM832 | 0.85 | 0.02 | 7 | 6 | LYM832 | 0.86 | 0.01 | 7 | 18 |
| LYM832 | 0.71 | 0.07 | 7 | 19 | LYM832 | 0.76 | 0.05 | 7 | 21 |
| LYM832 | 0.78 | 0.04 | 8 | 6 | LYM832 | 0.88 | 0.01 | 8 | 18 |
| LYM832 | 0.75 | 0.05 | 8 | 19 | LYM832 | 0.80 | 0.03 | 8 | 4 |
| LYM832 | 0.73 | 0.06 | 8 | 5 | LYM832 | 0.74 | 0.06 | 8 | 17 |
| LYM832 | 0.85 | 0.02 | 8 | 21 | LYM832 | 0.75 | 0.05 | 1 | 15 |
| LYM832 | 0.88 | 0.01 | 1 | 6 | LYM832 | 0.79 | 0.03 | 1 | 20 |
| LYM832 | 0.94 | 0.00 | 1 | 18 | LYM832 | 0.85 | 0.02 | 1 | 19 |
| LYM832 | 0.78 | 0.04 | 1 | 4 | LYM832 | 0.74 | 0.05 | 1 | 5 |
| LYM832 | 0.84 | 0.02 | 1 | 17 | LYM832 | 0.88 | 0.01 | 1 | 21 |
| LYM832 | 0.81 | 0.01 | 2 | 9 | LYM832 | 0.83 | 0.01 | 2 | 4 |
| LYM832 | 0.76 | 0.03 | 2 | 5 | LYM832 | 0.72 | 0.02 | 3 | 5 |
| LYM832 | 0.81 | 0.01 | 4 | 6 | LYM832 | 0.81 | 0.01 | 4 | 18 |
| LYM832 | 0.74 | 0.02 | 4 | 19 | LYM832 | 0.82 | 0.01 | 4 | 21 |
| LYM832 | 0.79 | 0.06 | 6 | 6 | LYM833 | 0.95 | 0.00 | 1 | 9 |
| LYM833 | 0.77 | 0.04 | 1 | 11 | LYM833 | 0.85 | 0.03 | 6 | 21 |
| LYM834 | 0.79 | 0.04 | 1 | 5 | LYM835 | 0.71 | 0.05 | 5 | 8 |
| LYM835 | 0.79 | 0.04 | 7 | 4 | LYM835 | 0.76 | 0.05 | 8 | 6 |
| LYM835 | 0.86 | 0.01 | 8 | 18 | LYM835 | 0.78 | 0.04 | 8 | 19 |
| LYM835 | 0.79 | 0.03 | 8 | 8 | LYM835 | 0.81 | 0.03 | 8 | 4 |
| LYM835 | 0.76 | 0.05 | 8 | 5 | LYM835 | 0.73 | 0.06 | 8 | 17 |
| LYM835 | 0.90 | 0.01 | 8 | 21 | LYM835 | 0.73 | 0.04 | 2 | 9 |
| LYM835 | 0.74 | 0.04 | 2 | 16 | LYM835 | 0.71 | 0.05 | 2 | 15 |
| LYM835 | 0.70 | 0.05 | 2 | 7 | LYM835 | 0.74 | 0.04 | 2 | 13 |
| LYM835 | 0.71 | 0.02 | 3 | 8 | LYM836 | 0.83 | 0.02 | 7 | 16 |
| LYM836 | 0.80 | 0.03 | 7 | 15 | LYM836 | 0.85 | 0.01 | 7 | 10 |
| LYM836 | 0.84 | 0.02 | 7 | 20 | LYM836 | 0.74 | 0.06 | 7 | 7 |
| LYM836 | 0.79 | 0.03 | 7 | 19 | LYM836 | 0.86 | 0.01 | 7 | 5 |
| LYM836 | 0.83 | 0.02 | 7 | 17 | LYM836 | 0.78 | 0.04 | 7 | 14 |
| LYM836 | 0.81 | 0.03 | 7 | 12 | LYM836 | 0.82 | 0.02 | 7 | 13 |
| LYM836 | 0.73 | 0.06 | 8 | 10 | LYM836 | 0.70 | 0.08 | 8 | 6 |

TABLE 30-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM836 | 0.82 | 0.03 | 8 | 20 | LYM836 | 0.74 | 0.06 | 8 | 18 |
| LYM836 | 0.82 | 0.02 | 8 | 19 | LYM836 | 0.77 | 0.04 | 8 | 5 |
| LYM836 | 0.79 | 0.04 | 8 | 17 | LYM836 | 0.86 | 0.01 | 8 | 21 |
| LYM836 | 0.72 | 0.07 | 8 | 13 | LYM836 | 0.74 | 0.06 | 1 | 16 |
| LYM836 | 0.83 | 0.02 | 1 | 15 | LYM836 | 0.79 | 0.03 | 1 | 6 |
| LYM836 | 0.85 | 0.01 | 1 | 20 | LYM836 | 0.91 | 0.00 | 1 | 18 |
| LYM836 | 0.91 | 0.00 | 1 | 19 | LYM836 | 0.83 | 0.02 | 1 | 4 |
| LYM836 | 0.86 | 0.01 | 1 | 5 | LYM836 | 0.86 | 0.01 | 1 | 17 |
| LYM836 | 0.94 | 0.00 | 1 | 21 | LYM836 | 0.80 | 0.03 | 1 | 13 |
| LYM836 | 0.84 | 0.01 | 2 | 9 | LYM836 | 0.77 | 0.02 | 2 | 3 |
| LYM836 | 0.76 | 0.03 | 2 | 11 | LYM837 | 0.76 | 0.03 | 5 | 16 |
| LYM837 | 0.82 | 0.01 | 5 | 8 | LYM837 | 0.74 | 0.04 | 5 | 13 |
| LYM837 | 0.76 | 0.05 | 7 | 16 | LYM837 | 0.80 | 0.03 | 7 | 15 |
| LYM837 | 0.75 | 0.05 | 7 | 10 | LYM837 | 0.80 | 0.03 | 7 | 20 |
| LYM837 | 0.74 | 0.06 | 7 | 7 | LYM837 | 0.79 | 0.03 | 7 | 18 |
| LYM837 | 0.79 | 0.04 | 7 | 19 | LYM837 | 0.81 | 0.03 | 7 | 4 |
| LYM837 | 0.85 | 0.02 | 7 | 5 | LYM837 | 0.85 | 0.02 | 7 | 17 |
| LYM837 | 0.76 | 0.05 | 7 | 14 | LYM837 | 0.71 | 0.07 | 7 | 21 |
| LYM837 | 0.71 | 0.07 | 7 | 12 | LYM837 | 0.75 | 0.05 | 7 | 13 |
| LYM837 | 0.81 | 0.03 | 8 | 16 | LYM837 | 0.81 | 0.03 | 8 | 15 |
| LYM837 | 0.76 | 0.05 | 8 | 7 | LYM837 | 0.71 | 0.07 | 8 | 18 |
| LYM837 | 0.87 | 0.01 | 8 | 4 | LYM837 | 0.89 | 0.01 | 8 | 5 |
| LYM837 | 0.74 | 0.06 | 8 | 17 | LYM837 | 0.77 | 0.04 | 8 | 14 |
| LYM837 | 0.74 | 0.06 | 8 | 12 | LYM837 | 0.76 | 0.05 | 8 | 13 |
| LYM837 | 0.81 | 0.03 | 1 | 16 | LYM837 | 0.85 | 0.01 | 1 | 15 |
| LYM837 | 0.79 | 0.03 | 1 | 6 | LYM837 | 0.89 | 0.01 | 1 | 3 |
| LYM837 | 0.87 | 0.01 | 1 | 20 | LYM837 | 0.86 | 0.01 | 1 | 7 |
| LYM837 | 0.70 | 0.08 | 1 | 18 | LYM837 | 0.83 | 0.02 | 1 | 19 |
| LYM837 | 0.79 | 0.03 | 1 | 8 | LYM837 | 0.81 | 0.03 | 1 | 17 |
| LYM837 | 0.81 | 0.03 | 1 | 12 | LYM837 | 0.89 | 0.01 | 1 | 13 |
| LYM838 | 0.75 | 0.05 | 7 | 15 | LYM838 | 0.75 | 0.05 | 7 | 10 |
| LYM838 | 0.84 | 0.02 | 7 | 6 | LYM838 | 0.85 | 0.02 | 7 | 20 |
| LYM838 | 0.86 | 0.01 | 7 | 18 | LYM838 | 0.85 | 0.02 | 7 | 19 |
| LYM838 | 0.80 | 0.03 | 7 | 4 | LYM838 | 0.75 | 0.05 | 7 | 5 |
| LYM838 | 0.83 | 0.02 | 7 | 17 | LYM838 | 0.73 | 0.07 | 7 | 14 |
| LYM838 | 0.80 | 0.03 | 7 | 21 | LYM838 | 0.73 | 0.06 | 7 | 13 |
| LYM838 | 0.74 | 0.06 | 8 | 4 | LYM838 | 0.72 | 0.07 | 8 | 5 |
| LYM838 | 0.81 | 0.03 | 1 | 6 | LYM838 | 0.82 | 0.02 | 1 | 18 |
| LYM838 | 0.84 | 0.02 | 1 | 4 | LYM838 | 0.71 | 0.07 | 1 | 14 |
| LYM838 | 0.82 | 0.01 | 2 | 9 | LYM838 | 0.76 | 0.03 | 2 | 4 |
| LYM838 | 0.72 | 0.05 | 2 | 5 | LYM838 | 0.76 | 0.02 | 4 | 7 |
| LYM838 | 0.82 | 0.05 | 6 | 6 | LYM839 | 0.79 | 0.06 | 7 | 9 |
| LYM839 | 0.81 | 0.03 | 7 | 11 | LYM839 | 0.72 | 0.07 | 8 | 7 |
| LYM839 | 0.82 | 0.02 | 8 | 14 | LYM839 | 0.79 | 0.04 | 8 | 12 |
| LYM839 | 0.80 | 0.05 | 1 | 9 | LYM839 | 0.77 | 0.01 | 3 | 18 |
| LYM839 | 0.79 | 0.06 | 6 | 19 | LYM839 | 0.81 | 0.05 | 6 | 17 |
| LYM839 | 0.76 | 0.08 | 6 | 14 | LYM839 | 0.73 | 0.10 | 6 | 12 |
| LYM840 | 0.75 | 0.05 | 7 | 10 | LYM840 | 0.75 | 0.05 | 8 | 10 |
| LYM840 | 0.71 | 0.12 | 6 | 3 | LYM840 | 0.79 | 0.06 | 6 | 19 |
| LYM840 | 0.82 | 0.04 | 6 | 8 | LYM840 | 0.74 | 0.09 | 6 | 21 |
| LYM840 | 0.82 | 0.05 | 6 | 13 | LYM841 | 0.79 | 0.06 | 7 | 9 |
| LYM841 | 0.75 | 0.09 | 8 | 9 | LYM841 | 0.75 | 0.02 | 3 | 9 |
| LYM841 | 0.77 | 0.01 | 3 | 8 | LYM841 | 0.72 | 0.11 | 6 | 18 |
| LYM841 | 0.71 | 0.12 | 6 | 8 | LYM842 | 0.74 | 0.06 | 1 | 15 |
| LYM842 | 0.85 | 0.01 | 1 | 6 | LYM842 | 0.76 | 0.05 | 1 | 20 |
| LYM842 | 0.91 | 0.00 | 1 | 18 | LYM842 | 0.84 | 0.02 | 1 | 19 |
| LYM842 | 0.75 | 0.05 | 1 | 17 | LYM842 | 0.91 | 0.00 | 1 | 21 |
| LYM842 | 0.71 | 0.07 | 1 | 13 | LYM842 | 0.70 | 0.02 | 3 | 21 |
| LYM842 | 0.80 | 0.01 | 4 | 6 | LYM843 | 0.74 | 0.04 | 5 | 8 |
| LYM843 | 0.86 | 0.01 | 8 | 8 | LYM843 | 0.82 | 0.02 | 1 | 8 |
| LYM843 | 0.70 | 0.02 | 3 | 8 | LYM843 | 0.70 | 0.12 | 6 | 16 |
| LYM843 | 0.74 | 0.09 | 6 | 15 | LYM843 | 0.72 | 0.11 | 6 | 6 |
| LYM843 | 0.83 | 0.04 | 6 | 3 | LYM843 | 0.70 | 0.12 | 6 | 18 |
| LYM843 | 0.93 | 0.01 | 6 | 19 | LYM843 | 0.85 | 0.03 | 6 | 8 |
| LYM843 | 0.71 | 0.12 | 6 | 21 | LYM843 | 0.81 | 0.05 | 6 | 13 |
| LYM844 | 0.77 | 0.07 | 6 | 18 | LYM845 | 0.74 | 0.04 | 5 | 16 |
| LYM845 | 0.75 | 0.03 | 5 | 20 | LYM845 | 0.83 | 0.01 | 5 | 7 |
| LYM845 | 0.84 | 0.01 | 5 | 13 | LYM845 | 0.83 | 0.02 | 7 | 16 |
| LYM845 | 0.83 | 0.02 | 7 | 10 | LYM845 | 0.89 | 0.01 | 7 | 7 |
| LYM845 | 0.73 | 0.06 | 7 | 8 | LYM845 | 0.84 | 0.02 | 7 | 14 |
| LYM845 | 0.91 | 0.00 | 7 | 12 | LYM845 | 0.76 | 0.05 | 7 | 13 |
| LYM845 | 0.74 | 0.09 | 8 | 9 | LYM845 | 0.73 | 0.06 | 1 | 16 |
| LYM845 | 0.75 | 0.05 | 1 | 10 | LYM845 | 0.86 | 0.01 | 1 | 7 |
| LYM845 | 0.80 | 0.03 | 1 | 14 | LYM845 | 0.85 | 0.02 | 1 | 12 |

TABLE 30-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM845 | 0.78 | 0.01 | 3 | 10 | LYM845 | 0.81 | 0.05 | 6 | 16 |
| LYM845 | 0.75 | 0.09 | 6 | 20 | LYM845 | 0.89 | 0.02 | 6 | 7 |
| LYM845 | 0.70 | 0.12 | 6 | 12 | LYM845 | 0.82 | 0.05 | 6 | 13 |
| LYM846 | 0.84 | 0.04 | 6 | 18 | LYM846 | 0.84 | 0.04 | 6 | 8 |
| LYM847 | 0.77 | 0.04 | 8 | 10 | LYM847 | 0.72 | 0.07 | 1 | 18 |
| LYM847 | 0.70 | 0.08 | 1 | 21 | LYM847 | 0.72 | 0.05 | 2 | 9 |
| LYM847 | 0.73 | 0.04 | 2 | 3 | LYM849 | 0.78 | 0.04 | 7 | 6 |
| LYM849 | 0.76 | 0.05 | 7 | 18 | LYM849 | 0.73 | 0.06 | 8 | 15 |
| LYM849 | 0.94 | 0.00 | 8 | 6 | LYM849 | 0.84 | 0.02 | 8 | 1 |
| LYM849 | 0.79 | 0.04 | 8 | 20 | LYM849 | 0.95 | 0.00 | 8 | 18 |
| LYM849 | 0.84 | 0.02 | 8 | 19 | LYM849 | 0.80 | 0.03 | 8 | 17 |
| LYM849 | 0.87 | 0.01 | 8 | 21 | LYM849 | 0.71 | 0.07 | 1 | 6 |
| LYM849 | 0.72 | 0.07 | 1 | 18 | LYM849 | 0.72 | 0.07 | 1 | 21 |
| LYM849 | 0.74 | 0.02 | 4 | 6 | LYM849 | 0.84 | 0.04 | 6 | 11 |
| LYM850 | 0.82 | 0.05 | 1 | 9 | LYM851 | 0.75 | 0.05 | 5 | 9 |
| LYM851 | 0.79 | 0.02 | 5 | 4 | LYM851 | 0.71 | 0.05 | 5 | 17 |
| LYM852 | 0.72 | 0.07 | 1 | 20 | LYM852 | 0.78 | 0.04 | 1 | 19 |
| LYM852 | 0.80 | 0.03 | 1 | 21 | LYM852 | 0.72 | 0.05 | 2 | 20 |
| LYM852 | 0.70 | 0.04 | 4 | 20 | LYM852 | 0.70 | 0.03 | 4 | 19 |
| LYM852 | 0.84 | 0.04 | 6 | 10 | LYM852 | 0.74 | 0.09 | 6 | 5 |
| LYM855 | 0.88 | 0.01 | 1 | 6 | LYM855 | 0.88 | 0.01 | 1 | 3 |
| LYM855 | 0.75 | 0.05 | 1 | 20 | LYM855 | 0.79 | 0.03 | 1 | 18 |
| LYM855 | 0.77 | 0.04 | 1 | 19 | LYM855 | 0.77 | 0.04 | 1 | 17 |
| LYM855 | 0.73 | 0.06 | 1 | 21 | LYM855 | 0.72 | 0.11 | 6 | 21 |
| LYM856 | 0.73 | 0.06 | 1 | 15 | LYM856 | 0.72 | 0.07 | 1 | 3 |
| LYM856 | 0.73 | 0.06 | 1 | 20 | LYM856 | 0.81 | 0.03 | 1 | 19 |
| LYM856 | 0.76 | 0.05 | 1 | 4 | LYM856 | 0.71 | 0.07 | 1 | 5 |
| LYM856 | 0.75 | 0.05 | 1 | 17 | LYM856 | 0.83 | 0.02 | 1 | 21 |
| LYM857 | 0.73 | 0.04 | 5 | 10 | LYM857 | 0.85 | 0.01 | 5 | 11 |
| LYM857 | 0.79 | 0.03 | 8 | 16 | LYM857 | 0.75 | 0.05 | 8 | 5 |
| LYM857 | 0.72 | 0.07 | 8 | 13 | LYM857 | 0.82 | 0.01 | 4 | 9 |
| LYM857 | 0.80 | 0.01 | 4 | 11 | LYM858 | 0.79 | 0.04 | 7 | 15 |
| LYM858 | 0.78 | 0.04 | 7 | 6 | LYM858 | 0.73 | 0.06 | 7 | 20 |
| LYM858 | 0.90 | 0.01 | 7 | 18 | LYM858 | 0.85 | 0.02 | 7 | 19 |
| LYM858 | 0.90 | 0.01 | 7 | 4 | LYM858 | 0.86 | 0.01 | 7 | 5 |
| LYM858 | 0.80 | 0.03 | 7 | 17 | LYM858 | 0.94 | 0.00 | 7 | 21 |
| LYM858 | 0.70 | 0.08 | 7 | 13 | LYM858 | 0.72 | 0.07 | 1 | 16 |
| LYM858 | 0.70 | 0.08 | 1 | 15 | LYM858 | 0.87 | 0.01 | 1 | 10 |
| LYM858 | 0.72 | 0.07 | 1 | 20 | LYM858 | 0.77 | 0.04 | 1 | 11 |
| LYM858 | 0.80 | 0.03 | 1 | 5 | LYM858 | 0.76 | 0.05 | 1 | 17 |
| LYM858 | 0.74 | 0.06 | 1 | 14 | LYM858 | 0.71 | 0.08 | 1 | 12 |
| LYM858 | 0.79 | 0.02 | 2 | 9 | LYM858 | 0.71 | 0.05 | 2 | 11 |
| LYM858 | 0.75 | 0.03 | 4 | 9 | LYM858 | 0.93 | 0.00 | 4 | 10 |
| LYM858 | 0.71 | 0.03 | 4 | 3 | LYM858 | 0.71 | 0.03 | 4 | 5 |
| LYM859 | 0.87 | 0.01 | 5 | 16 | LYM859 | 0.83 | 0.01 | 5 | 15 |
| LYM859 | 0.75 | 0.03 | 5 | 20 | LYM859 | 0.81 | 0.01 | 5 | 7 |
| LYM859 | 0.72 | 0.04 | 5 | 19 | LYM859 | 0.81 | 0.01 | 5 | 8 |
| LYM859 | 0.76 | 0.03 | 5 | 17 | LYM859 | 0.72 | 0.04 | 5 | 14 |
| LYM859 | 0.87 | 0.01 | 5 | 12 | LYM859 | 0.88 | 0.00 | 5 | 13 |
| LYM859 | 0.77 | 0.03 | 2 | 9 | LYM859 | 0.77 | 0.07 | 6 | 21 |
| LYM860 | 0.70 | 0.08 | 7 | 16 | LYM860 | 0.82 | 0.02 | 7 | 15 |
| LYM860 | 0.72 | 0.07 | 7 | 10 | LYM860 | 0.83 | 0.02 | 7 | 6 |
| LYM860 | 0.71 | 0.08 | 7 | 3 | LYM860 | 0.86 | 0.01 | 7 | 20 |
| LYM860 | 0.89 | 0.01 | 7 | 18 | LYM860 | 0.89 | 0.01 | 7 | 19 |
| LYM860 | 0.85 | 0.02 | 7 | 4 | LYM860 | 0.86 | 0.01 | 7 | 5 |
| LYM860 | 0.91 | 0.00 | 7 | 17 | LYM860 | 0.71 | 0.07 | 7 | 14 |
| LYM860 | 0.87 | 0.01 | 7 | 21 | LYM860 | 0.76 | 0.05 | 7 | 13 |
| LYM860 | 0.87 | 0.01 | 8 | 16 | LYM860 | 0.84 | 0.02 | 8 | 15 |
| LYM860 | 0.72 | 0.07 | 8 | 20 | LYM860 | 0.74 | 0.06 | 8 | 7 |
| LYM860 | 0.74 | 0.06 | 8 | 19 | LYM860 | 0.82 | 0.02 | 8 | 4 |
| LYM860 | 0.87 | 0.01 | 8 | 5 | LYM860 | 0.75 | 0.05 | 8 | 17 |
| LYM860 | 0.73 | 0.06 | 8 | 14 | LYM860 | 0.71 | 0.08 | 8 | 21 |
| LYM860 | 0.74 | 0.05 | 8 | 12 | LYM860 | 0.83 | 0.02 | 8 | 13 |
| LYM860 | 0.76 | 0.01 | 3 | 2 | LYM861 | 0.70 | 0.08 | 7 | 16 |
| LYM861 | 0.82 | 0.02 | 7 | 15 | LYM861 | 0.72 | 0.07 | 7 | 10 |
| LYM861 | 0.83 | 0.02 | 7 | 6 | LYM861 | 0.71 | 0.08 | 7 | 3 |
| LYM861 | 0.86 | 0.01 | 7 | 20 | LYM861 | 0.89 | 0.01 | 7 | 18 |
| LYM861 | 0.89 | 0.01 | 7 | 19 | LYM861 | 0.85 | 0.02 | 7 | 4 |
| LYM861 | 0.86 | 0.01 | 7 | 5 | LYM861 | 0.91 | 0.00 | 7 | 17 |
| LYM861 | 0.71 | 0.07 | 7 | 14 | LYM861 | 0.87 | 0.01 | 7 | 21 |
| LYM861 | 0.76 | 0.05 | 7 | 13 | LYM861 | 0.87 | 0.01 | 8 | 16 |
| LYM861 | 0.84 | 0.02 | 8 | 15 | LYM861 | 0.72 | 0.07 | 8 | 20 |
| LYM861 | 0.74 | 0.06 | 8 | 7 | LYM861 | 0.74 | 0.06 | 8 | 19 |
| LYM861 | 0.82 | 0.02 | 8 | 4 | LYM861 | 0.87 | 0.01 | 8 | 5 |

TABLE 30-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM861 | 0.75 | 0.05 | 8 | 17 | LYM861 | 0.73 | 0.06 | 8 | 14 |
| LYM861 | 0.71 | 0.08 | 8 | 21 | LYM861 | 0.74 | 0.05 | 8 | 12 |
| LYM861 | 0.83 | 0.02 | 8 | 13 | LYM861 | 0.76 | 0.01 | 3 | 2 |
| LYM862 | 0.70 | 0.08 | 7 | 16 | LYM862 | 0.82 | 0.02 | 7 | 15 |
| LYM862 | 0.72 | 0.07 | 7 | 10 | LYM862 | 0.83 | 0.02 | 7 | 6 |
| LYM862 | 0.71 | 0.08 | 7 | 3 | LYM862 | 0.86 | 0.01 | 7 | 20 |
| LYM862 | 0.89 | 0.01 | 7 | 18 | LYM862 | 0.89 | 0.01 | 7 | 19 |
| LYM862 | 0.85 | 0.02 | 7 | 4 | LYM862 | 0.86 | 0.01 | 7 | 5 |
| LYM862 | 0.91 | 0.00 | 7 | 17 | LYM862 | 0.71 | 0.07 | 7 | 14 |
| LYM862 | 0.87 | 0.01 | 7 | 21 | LYM862 | 0.76 | 0.05 | 7 | 13 |
| LYM862 | 0.87 | 0.01 | 8 | 16 | LYM862 | 0.84 | 0.02 | 8 | 15 |
| LYM862 | 0.72 | 0.07 | 8 | 20 | LYM862 | 0.74 | 0.06 | 8 | 7 |
| LYM862 | 0.74 | 0.06 | 8 | 19 | LYM862 | 0.82 | 0.02 | 8 | 4 |
| LYM862 | 0.87 | 0.01 | 8 | 5 | LYM862 | 0.75 | 0.05 | 8 | 17 |
| LYM862 | 0.73 | 0.06 | 8 | 14 | LYM862 | 0.71 | 0.08 | 8 | 21 |
| LYM862 | 0.74 | 0.05 | 8 | 12 | LYM862 | 0.83 | 0.02 | 8 | 13 |
| LYM862 | 0.76 | 0.01 | 3 | 2 | LYM901_H1 | 0.78 | 0.007 | 3 | 1 |
| LYM964_H1 | 0.75 | 2.12E−02 | 4 | 5 | LYM964_H1 | 0.72 | 3.03E−02 | 4 | 12 |
| LYM817_H1 | 0.77 | 2.56E−02 | 5 | 21 | LYM817_H1 | 0.86 | 6.53E−03 | 2 | 6 |
| LYM830_H4 | 0.72 | 4.29E−02 | 2 | 6 | LYM830_H4 | 0.80 | 5.73E−02 | 6 | 21 |
| LYM964_H1 | 0.74 | 2.31E−02 | 4 | 16 | LYM964_H1 | 0.72 | 2.85E−02 | 4 | 7 |
| LYM964_H1 | 0.72 | 2.82E−02 | 4 | 4 | | | | | |

Table 30.
Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal conditions across maize varieties.
P = p value.

Example 8

Production of Barley Transcriptom and High Throughput Correlation Analysis Using 60K Barley Oligonucleotide Micro-Array In order to produce a high throughput correlation analysis comparing between plant phenotype and gene expression level, the present inventors utilized a Barley oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60K Barley genes and transcripts. In order to define correlations between the levels of RNA expression and yield or vigor related parameters, various plant characteristics of 15 different Barley accessions were analyzed. Among them, 10 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Barley tissues—Four tissues at different developmental stages [leaf, meristem, root tip and adventitious root], representing different plant characteristics, were sampled and RNA was extracted as described above. Each micro-array expression information tissue type has received a Set ID as summarized in Tables 31 and 32 below.

TABLE 31

Barley transcriptom expression sets (set 1)

| Expression Set | Set ID |
|---|---|
| root low N | 1 |
| root normal | 2 |
| leaf T3 low N | 3 |

TABLE 31-continued

Barley transcriptom expression sets (set 1)

| Expression Set | Set ID |
|---|---|
| leaf normal | 4 |
| root tip low N | 5 |
| root tip normal | 6 |

Table 31.

TABLE 32

Barley transcriptom expression sets (set 2)

| Expression Set | Set ID |
|---|---|
| booting spike drought reproductive | 1 |
| leaf drought reproductive | 2 |
| leaf drought vegetative | 3 |
| meristems drought vegetative | 4 |
| root tip drought vegetative | 5 |
| root tip recovery-drought vegetative | 6 |

Table 32.

Barley yield components and vigor related parameters assessment—15 Barley accessions in 5 repetitive blocks, each containing 5 plants per pot were grown at net house. Three different treatments were applied: plants were regularly fertilized and watered during plant growth until harvesting (as recommended for commercial growth) or under low Nitrogen (80% percent less Nitrogen) or drought stress. Plants were phenotyped on a daily basis following the standard descriptor of barley (Tables 33 and 34, below). Harvest was conducted while all the spikes were dry. All material was oven dried and the seeds were threshed manually from the spikes prior to measurement of the seed characteristics (weight and size) using scanning and image analysis. The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

Grains number—The total number of grains from all spikes that were manually threshed was counted. Number of grains per plot were counted.

Grain weight (gr.)—At the end of the experiment all spikes of the pots were collected. The total grains from all spikes that were manually threshed were weighted. The grain yield was calculated by per plot.

Spike length and width analysis—At the end of the experiment the length and width of five chosen spikes per plant were measured using measuring tape excluding the awns.

Spike number analysis—The spikes per plant were counted.

Plant height—Each of the plants was measured for its height using measuring tape. Height was measured from ground level to top of the longest spike excluding awns at two time points at the Vegetative growth (30 days after sowing) and at harvest.

Spike weight—The biomass and spikes weight of each plot was separated, measured and divided by the number of plants.

Dry weight=total weight of the vegetative portion above ground (excluding roots) after drying at 70° C. in oven for 48 hours at two time points at the Vegetative growth (30 days after sowing) and at harvest.

Root dry weight=total weight of the root portion underground after drying at 70° C. in oven for 48 hours at harvest.

Root/Shoot Ratio—The Root/Shoot Ratio is calculated using Formula X.

Formula X: Root/Shoot Ratio=total weight of the root at harvest/total weight of the vegetative portion above ground at harvest (RBiH/BiH)).

Total No of tillers—all tillers were counted per plot at two time points at the Vegetative growth (30 days after sowing) and at harvest.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Root FW (gr.), root length (cm) and No. of lateral roots—3 plants per plot were selected for measurement of root weight, root length and for counting the number of lateral roots formed.

Shoot FW—weights of 3 plants per plot were recorded at different time-points.

Relative water content—Fresh weight (FW) of three leaves from three plants each from different seed id is immediately recorded; then leaves are soaked for 8 hours in distilled water at room temperature in the dark, and the turgid weight (TW) is recorded. Total dry weight (DW) is recorded after drying the leaves at 60° C. to a constant weight. Relative water content (RWC) is calculated according to Formula I above.

Harvest Index (for barley)—The harvest index is calculated using Formula XI.

Harvest Index=Average grain weight per plant/(Average vegetative dry weight per plant+Average grain weight per plant)  Formula XI:

Relative growth rate: the relative growth rate (RGR) of Plant Height, Spad and number of tillers are calculated as follows:

Relative growth rate of Plant height=Regression coefficient of Plant height along time course.  Formula XII:

Relative growth rate of SPAD=Regression coefficient of SPAD measurements along time course.  Formula XIII:

Relative growth rate of Number of tillers=Regression coefficient of Number of tillers along time course.  Formula XIV:

TABLE 33

Barley correlated parameters (vectors for set 1)

| Correlated parameter with | Correlation ID |
|---|---|
| SPAD, Low N, TP2 | 1 |
| Root FW (gr.), Low N, TP2 | 2 |
| shoot FW (gr.), Low N, TP2 | 3 |
| Number of tillers, Low N, TP2 | 4 |
| Seed Yield (gr.), Low N | 5 |
| Spike Width (cm), Low N | 6 |
| Root length (cm), Low N, TP2 | 7 |
| Plant Height (cm), Low N | 8 |
| Spike Length (cm), Low N | 9 |
| Plant Height (cm), Low N, TP2 | 10 |
| Leaf Number, TP4, Low N | 11 |
| No of lateral roots, Low N, TP2 | 12 |
| Max Width (mm), TP4, Low N | 13 |
| Max Length (mm), TP4, Low N | 14 |
| Seed Number (per plot), Low N | 15 |
| Total No of Spikes per plot, Low N | 16 |
| Total Leaf Area (mm$^2$), TP4, Low N | 17 |
| Total Number of tillers per plot, Low N | 18 |
| Spike total weight (per plot) (gr.), Low N | 19 |
| Seed Yield (gr.), Normal | 20 |
| Seed Yield (gr.) | 21 |
| Number of Seeds | 22 |
| Plant Height (cm) | 23 |
| Number of Spikes | 24 |
| Spike Length (cm) | 25 |
| Spike Width (cm) | 26 |
| Spike weight (gr.) | 27 |
| Total Tillers (number) | 28 |
| Root Length (cm) | 29 |
| Lateral Roots (number) | 30 |
| Root FW (gr.) | 31 |
| Number of Tillers | 32 |
| SPAD | 33 |
| Shoot FW (gr.) | 34 |
| Number of Leaves | 35 |
| Leaf Area (mm$^2$) | 36 |
| Max Width (cm) | 37 |
| Max Length (cm) | 38 |

Table 33.
Provided are the barley correlated parameters. TP means time point; DW = dry weight; FW = fresh weight; Low N = Low Nitrogen.

TABLE 34

Barley correlated parameters (vectors for set 2)

| Correlated parameter with | Correlation ID |
|---|---|
| Harvest index | 1 |
| Dry weight vegetative growth (gr.) | 2 |
| Relative water content | 3 |
| Heading date | 4 |
| RBiH/BiH (root/shoot ratio, Formula X hereinabove) | 5 |
| Height Relative growth rate | 6 |
| SPAD Relative growth rate | 7 |
| Number of tillers Relative growth rate | 8 |
| Grain number | 9 |
| Grain weight (gr.) | 10 |
| Plant height (cm) | 11 |
| Spike number | 12 |
| Spike length (cm) | 13 |
| Spike width (cm) | 14 |
| Spike weight per plant (gr.) | 15 |
| Tillers number | 16 |
| Dry weight harvest (gr.) | 17 |
| Root dry weight (gr.) | 18 |
| Root length (cm) | 19 |
| Lateral root number | 20 |
| Root fresh weight (gr.) | 21 |

TABLE 34-continued

Barley correlated parameters (vectors for set 2)

| Correlated parameter with | Correlation ID |
|---|---|
| Chlorophyll levels | 22 |
| Fresh weight (gr.) | 23 |

Table 34.
Provided are the barley correlated parameters. TP means time point; DW = dry weight; FW = fresh weight; Low N = Low Nitrogen.

Experimental Results 15 different Barley accessions were grown and characterized for different parameters as described above. The average for each of the measured parameter was calculated using the JMP software and values are summarized in Tables 35-37 below. Subsequent correlation analysis between the various transcriptom sets and the average to parameters was conducted (Tables 38-39). Follow, results were integrated to the database.

TABLE 35

Measured parameters of correlation IDs in Barley accessions (set 1)

Ecotype

| Treatment | Line-1 | Line-2 | Line-3 | Line-4 | Line-5 | Line-6 | Line-7 | Line-8 | Line-9 | Line-10 |
|---|---|---|---|---|---|---|---|---|---|---|
| 1 | 24.0 | 23.3 | 26.5 | 23.9 | 26.6 | 23.2 | 25.4 | 24.2 | 25.0 | 26.1 |
| 2 | 0.4 | 0.2 | 0.1 | 0.4 | 0.9 | 0.5 | 0.4 | 0.3 | 0.3 | 0.6 |
| 3 | 0.4 | 0.4 | 0.3 | 0.6 | 0.8 | 0.5 | 0.5 | 0.4 | 0.5 | 0.6 |
| 4 | 0.0 | 0.0 | 0.0 | 0.0 | 0.0 | 0.0 | 0.0 | 0.0 | 0.0 | 0.0 |
| 5 | 9.8 | 7.3 | 3.3 | 5.1 | 6.0 | 9.7 | 7.4 | 5.8 | 7.8 | 6.3 |
| 6 | 8.0 | 8.1 | 9.4 | 4.9 | 9.6 | 7.2 | 7.1 | 8.5 | 10.0 | 9.4 |
| 7 | 24.7 | 21.7 | 22.0 | 21.7 | 22.2 | 23.0 | 30.5 | 22.8 | 23.8 | 24.5 |
| 8 | 41.0 | 82.0 | 61.4 | 59.4 | 65.8 | 47.8 | 53.8 | 56.4 | 81.8 | 44.6 |
| 9 | 15.2 | 19.6 | 16.3 | 19.3 | 90.2 | 16.4 | 20.4 | 18.8 | 18.8 | 16.6 |
| 10 | 16.3 | 18.8 | 17.3 | 26.0 | 22.5 | 18.2 | 19.7 | 19.8 | 19.2 | 19.2 |
| 11 | 8.0 | 8.0 | 7.5 | 8.5 | 10.0 | 11.5 | 8.6 | 6.3 | 7.5 | 10.0 |
| 12 | 5.0 | 6.0 | 4.3 | 6.0 | 6.3 | 6.0 | 6.7 | 4.7 | 5.7 | 7.3 |
| 13 | 5.3 | 5.2 | 5.1 | 5.3 | 5.2 | 5.3 | 5.3 | 5.1 | 5.2 | 5.1 |
| 14 | 102.9 | 107.8 | 111.6 | 142.4 | 152.4 | 149.3 | 124.1 | 95.0 | 124.1 | 135.2 |
| 15 | 230.2 | 164.6 | 88.3 | 133.6 | 106.0 | 222.6 | 219.2 | 143.5 | 201.8 | 125.0 |
| 16 | 12.2 | 9.0 | 11.6 | 25.0 | 7.8 | 14.5 | 15.0 | 7.0 | 5.4 | 8.4 |
| 17 | 39.4 | 46.3 | 51.5 | 57.1 | 67.8 | 64.2 | 52.4 | 46.2 | 68.0 | 57.9 |
| 18 | 16.2 | 14.6 | 16.0 | 20.8 | 12.5 | 18.8 | 21.2 | 11.0 | 6.8 | 14.0 |
| 19 | 13.7 | 13.4 | 9.2 | 11.6 | 11.3 | 15.1 | 12.2 | 11.0 | 12.2 | 10.6 |
| 20 | 46.4 | 19.8 | 10.8 | 22.6 | 30.3 | 54.1 | 37.0 | 42.0 | 35.4 | 38.3 |
| 21 | 46.4 | 19.8 | 10.8 | 22.6 | 30.3 | 54.1 | 37.0 | 42.0 | 35.4 | 38.3 |
| 22 | 1090.0 | 510.0 | 242.0 | 582.0 | 621.0 | 1070.0 | 903.0 | 950.0 | 984.0 | 768.0 |
| 23 | 64.7 | 84.0 | 67.4 | 82.0 | 72.0 | 56.6 | 65.8 | 62.8 | 91.6 | 66.2 |
| 24 | 41.5 | 32.0 | 36.0 | 71.4 | 34.2 | 45.6 | 49.8 | 28.0 | 19.3 | 38.0 |
| 25 | 16.5 | 19.2 | 18.3 | 20.4 | 17.2 | 19.1 | 20.3 | 21.7 | 16.5 | 16.1 |
| 26 | 9.5 | 9.1 | 8.3 | 6.6 | 10.5 | 8.8 | 7.4 | 10.4 | 10.2 | 10.3 |
| 27 | 69.4 | 39.4 | 34.9 | 50.3 | 60.8 | 79.1 | 62.7 | 60.0 | 55.9 | 59.7 |
| 28 | 46.7 | 41.6 | 40.0 | 48.8 | 34.6 | 48.6 | 49.2 | 29.0 | 27.5 | 38.8 |
| 29 | 21.3 | 15.0 | 21.8 | 20.3 | 27.2 | 16.0 | 24.0 | 13.5 | 21.5 | 15.2 |
| 30 | 7.0 | 8.7 | 8.3 | 9.7 | 10.7 | 9.7 | 9.7 | 8.7 | 10.0 | 9.7 |
| 31 | 0.3 | 0.3 | 0.3 | 0.4 | 0.6 | 0.3 | 0.4 | 0.3 | 0.2 | 0.3 |
| 32 | 2.0 | 2.0 | 1.0 | 2.3 | 2.3 | 3.3 | 2.3 | 1.3 | 1.3 | 1.7 |
| 33 | 39.1 | 41.4 | 35.2 | 33.7 | 34.2 | 42.8 | 37.0 | 36.9 | 35.0 | 36.8 |
| 34 | 2.2 | 1.9 | 1.3 | 3.0 | 15.6 | 3.0 | 2.6 | 1.8 | 2.2 | 1.8 |
| 23 | 64.7 | 84.0 | 67.4 | 82.0 | 72.0 | 56.6 | 65.8 | 62.8 | 91.6 | 66.2 |
| 35 | 24.2 | 18.2 | 22.7 | 25.5 | 23.2 | 28.3 | 22.2 | 19.0 | 17.3 | 22.0 |
| 36 | 294.0 | 199.0 | 273.0 | 276.0 | 313.0 | 309.0 | 259.0 | 291.0 | 299.0 | 296.0 |
| 37 | 5.8 | 5.5 | 5.8 | 6.0 | 4.6 | 5.3 | 5.8 | 5.4 | 5.8 | 6.0 |
| 38 | 502.0 | 348.0 | 499.0 | 594.0 | 535.0 | 551.0 | 479. | 399.0 | 384.0 | 470.0 |

Table 35.

TABLE 36

Measured parameters of correlation IDs in Barley accessions (set 2)

Ecotype

| Treatment | Line-1 | Line-2 | Line-3 | Line-4 | Line-5 | Line-6 | Line-7 |
|---|---|---|---|---|---|---|---|
| 1 | 0.47 | 0.66 | 0.53 | 0.69 | 0.53 | 0.69 | 0.69 |
| 2 | 0.21 | 0.21 | | | | 0.17 | |
| 3 | 80.60 | 53.40 | 55.87 | | 43.21 | 69.78 | 45.49 |
| 4 | 75.00 | 71.00 | 65.00 | | 66.75 | 90.00 | 90.00 |
| 5 | 0.01 | 0.01 | 0.01 | 0.01 | 0.03 | 0.02 | 0.01 |
| 6 | 0.27 | 0.86 | 0.73 | 0.88 | 0.40 | 0.94 | 0.70 |
| 7 | 0.09 | −0.12 | 0.00 | 0.01 | 0.04 | −0.07 | 0.01 |
| 8 | 0.07 | 0.10 | 0.06 | 0.07 | 0.16 | 0.06 | 0.10 |

TABLE 36-continued

Measured parameters of correlation IDs in Barley accessions (set 2)

| Treatment | Line-1 | Line-2 | Line-3 | Line-4 | Line-5 | Line-6 | Line-7 |
|---|---|---|---|---|---|---|---|
| 9 | 170.00 | 267.50 | 111.00 | 205.33 | 153.60 | 252.50 | 288.40 |
| 10 | 5.55 | 9.80 | 3.55 | 7.20 | 5.28 | 7.75 | 9.92 |
| 11 | 46.00 | 52.80 | 35.00 | 38.00 | 45.20 | 48.00 | 37.67 |
| 12 | 4.20 | 4.36 | 7.60 | 8.44 | 4.92 | 3.43 | 6.90 |
| 13 | 16.70 | 16.85 | 13.27 | 13.55 | 14.19 | 15.64 | 15.66 |
| 14 | 8.64 | 9.07 | 7.82 | 7.32 | 8.74 | 7.62 | 6.98 |
| 15 | 17.72 | 24.24 | 18.20 | 18.00 | 19.50 | 15.00 | 23.40 |
| 16 | 11.68 | 9.04 | 10.92 | 10.16 | 10.32 | 8.78 | 13.00 |
| 17 | 6.15 | 5.05 | 3.20 | 3.28 | 4.76 | 3.55 | 4.52 |
| 18 | 77.52 | 60.19 | 27.13 | 18.62 | 117.42 | 70.72 | 37.34 |
| 19 | 21.67 | 20.33 | 22.00 | 24.00 | 20.67 | 18.33 | 21.00 |
| 20 | 8.33 | 8.67 | 7.33 | 7.67 | 6.67 | 6.67 | 7.67 |
| 21 | 2.07 | 1.48 | 1.12 | 1.87 | 1.67 | 1.68 | 1.62 |
| 16 | 11.68 | 9.04 | 10.92 | 10.16 | 10.32 | 8.78 | 13.00 |
| 22 | 41.33 | 33.57 | 36.57 | 40.50 | 45.07 | 39.73 | 38.33 |
| 11 | 46.00 | 52.80 | 35.00 | 38.00 | 45.20 | 48.00 | 37.67 |
| 23 | 1.90 | 1.52 | 1.17 | 1.95 | 1.90 | 1.22 | 1.75 |

Table 36.

TABLE 37

Measured parameters of correlation IDs in Barley accessions (set 2) additional lines

| Treatment | Line-8 | Line-9 | Line-10 | Line-11 | Line-12 | Line-13 | Line-14 | Line-15 |
|---|---|---|---|---|---|---|---|---|
| 1 | 0.75 | 0.60 | 0.81 | 0.87 | 0.29 | 0.44 | 0.78 | 0.41 |
| 2 |  | 0.25 |  |  | 0.13 | 0.19 | 0.22 |  |
| 3 | 76.51 | 87.41 |  |  | 58.32 | 80.58 | 73.09 |  |
| 4 |  | 90.00 |  |  | 90.00 | 81.60 | 90.00 |  |
| 5 | 0.01 | 0.01 | 0.01 | 0.02 | 0.02 | 0.01 | 0.01 | 0.03 |
| 6 | 0.71 | 0.77 | 0.80 | 0.92 | 0.39 | 0.88 | −0.13 | 0.20 |
| 7 | 0.00 | −0.06 | 0.04 | 0.05 | 0.00 | −0.07 | 0.03 | −0.06 |
| 8 | 0.05 | 0.10 | 0.06 | 0.06 | 0.18 | 0.15 | 0.02 | 0.44 |
| 9 | 274.50 | 348.50 | 358.00 | 521.39 | 71.50 | 160.13 | 376.67 | 105.00 |
| 10 | 10.25 | 8.50 | 14.03 | 17.52 | 2.05 | 5.38 | 11.00 | 2.56 |
| 11 | 41.20 | 40.80 | 49.86 | 43.00 | 47.40 | 64.80 | 52.60 | 32.00 |
| 12 | 5.80 | 8.55 | 9.67 | 5.42 | 3.05 | 4.07 | 3.72 | 3.21 |
| 13 | 17.49 | 16.00 | 18.31 | 17.42 | 14.23 | 14.81 | 16.54 | 12.72 |
| 14 | 8.05 | 6.06 | 6.73 | 9.55 | 7.84 | 7.81 | 8.35 | 5.47 |
| 15 | 28.16 | 21.96 | 33.03 | 34.80 | 11.73 | 18.78 | 21.00 | 9.88 |
| 16 | 7.44 | 13.92 | 11.00 | 6.78 | 8.45 | 9.15 | 5.12 | 16.13 |
| 17 | 3.38 | 5.67 | 3.31 | 2.65 | 5.12 | 6.86 | 3.11 | 3.74 |
| 18 | 25.56 | 66.18 | 22.13 | 41.12 | 116.95 | 84.10 | 37.46 | 98.86 |
| 19 | 20.33 | 21.67 | 19.67 | 16.67 | 17.00 | 15.17 | 27.00 | 15.00 |
| 20 | 6.67 | 6.00 | 8.67 | 7.67 | 6.33 | 7.00 | 7.00 | 6.67 |
| 21 | 0.85 | 1.45 | 1.38 | 0.82 | 0.58 | 0.63 | 1.07 | 0.70 |
| 16 | 7.44 | 13.92 | 11.00 | 6.78 | 8.45 | 9.15 | 5.12 | 16.13 |
| 22 | 36.17 | 42.13 | 31.77 | 33.47 | 42.37 | 42.27 | 36.77 | 40.63 |
| 11 | 41.20 | 40.80 | 49.86 | 43.00 | 47.40 | 64.80 | 52.60 | 32.00 |
| 23 | 1.58 | 1.88 | 1.73 | 1.00 | 0.90 | 0.90 | 1.43 | 0.83 |

Table 37.

TABLE 38

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LYM755 | 0.84 | 0.00 | 1 | 9 | LYM755 | 0.72 | 0.03 | 1 | 2 |
| LYM755 | 0.78 | 0.01 | 1 | 7 | LYM755 | 0.70 | 0.04 | 1 | 1 |
| LYM755 | 0.80 | 0.01 | 1 | 3 | LYM755 | 0.72 | 0.03 | 3 | 19 |

TABLE 38-continued

Correlation between the expression level of selected genes of some embodiments of the invention in various tissues and the phenotypic performance under low nitrogen, normal or drought stress conditions across Barley accessions (set 1)

| Gene Name | R | P value | Exp. set | Corr. Set ID | Gene Name | R | P value | Exp. set | Corr. Set ID |
|---|---|---|---|---|---|---|---|---|---|
| LYM756 | 0.90 | 0.00 | 5 | 11 | LYM756 | 0.70 | 0.03 | 3 | 11 |
| LYM757 | 0.79 | 0.02 | 6 | 37 | LYM757 | 0.72 | 0.03 | 1 | 11 |
| LYM757 | 0.70 | 0.05 | 4 | 28 | LYM757 | 0.74 | 0.04 | 4 | 24 |
| LYM758 | 0.73 | 0.04 | 4 | 38 | LYM758 | 0.75 | 0.02 | 3 | 15 |
| LYM759 | 0.72 | 0.03 | 2 | 29 | LYM760 | 0.70 | 0.04 | 2 | 22 |
| LYM760 | 0.71 | 0.03 | 3 | 13 | LYM761 | 0.81 | 0.02 | 6 | 33 |
| LYM761 | 0.74 | 0.04 | 6 | 32 | LYM761 | 0.73 | 0.03 | 2 | 33 |
| LYM761 | 0.72 | 0.03 | 2 | 21 | LYM761 | 0.91 | 0.00 | 3 | 9 |
| LYM761 | 0.78 | 0.01 | 3 | 2 | LYM761 | 0.76 | 0.02 | 3 | 3 |
| LYM762 | 0.73 | 0.02 | 5 | 8 | LYM762 | 0.71 | 0.03 | 2 | 34 |
| LYM762 | 0.75 | 0.02 | 2 | 31 | LYM763 | 0.72 | 0.05 | 4 | 28 |

Table 38
Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal, low nitrogen and drought conditions across barley varieties.
P = p value.

TABLE 39

Correlation between the expression level of selected genes of some embodiments of the invention in various tissues and the phenotypic performance under low nitrogen, normal or drought stress conditions across Barley accessions (set 2)

| Gene Name | R | P value | Exp. set | Corr. Set ID | Gene Name | R | P value | Exp. set | Corr. Set ID |
|---|---|---|---|---|---|---|---|---|---|
| LYM755 | 0.77 | 0.07 | 1 | 1 | LYM755 | 0.73 | 0.10 | 1 | 13 |
| LYM755 | 0.73 | 0.10 | 1 | 10 | LYM755 | 0.92 | 0.01 | 1 | 11 |
| LYM755 | 0.84 | 0.04 | 1 | 15 | LYM755 | 0.77 | 0.02 | 3 | 1 |
| LYM755 | 0.82 | 0.01 | 6 | 21 | LYM755 | 0.72 | 0.07 | 2 | 19 |
| LYM755 | 0.79 | 0.02 | 5 | 1 | LYM755 | 0.86 | 0.01 | 5 | 13 |
| LYM755 | 0.78 | 0.02 | 5 | 9 | LYM755 | 0.75 | 0.03 | 5 | 10 |
| LYM755 | 0.77 | 0.07 | 5 | 4 | LYM755 | 0.77 | 0.03 | 5 | 23 |
| LYM756 | 0.76 | 0.02 | 6 | 12 | LYM756 | 0.73 | 0.06 | 2 | 17 |
| LYM756 | 0.71 | 0.11 | 5 | 3 | LYM757 | 0.73 | 0.04 | 3 | 14 |
| LYM757 | 0.84 | 0.02 | 2 | 19 | LYM757 | 0.75 | 0.05 | 2 | 22 |
| LYM757 | 0.95 | 0.00 | 5 | 4 | LYM757 | 0.77 | 0.04 | 4 | 4 |
| LYM758 | 0.83 | 0.02 | 2 | 1 | LYM758 | 0.76 | 0.05 | 2 | 7 |
| LYM758 | 0.82 | 0.01 | 5 | 8 | LYM758 | 0.86 | 0.01 | 5 | 11 |
| LYM758 | 0.74 | 0.03 | 5 | 17 | LYM759 | 0.71 | 0.11 | 1 | 20 |
| LYM759 | 0.79 | 0.06 | 1 | 10 | LYM759 | 0.90 | 0.01 | 1 | 11 |
| LYM759 | 0.83 | 0.04 | 1 | 15 | LYM759 | 0.72 | 0.03 | 6 | 19 |
| LYM759 | 0.71 | 0.03 | 6 | 7 | LYM759 | 0.72 | 0.07 | 2 | 20 |
| LYM759 | 0.85 | 0.02 | 2 | 11 | LYM759 | 0.70 | 0.05 | 5 | 12 |
| LYM759 | 0.92 | 0.00 | 5 | 7 | LYM760 | 0.81 | 0.05 | 1 | 13 |
| LYM760 | 0.71 | 0.12 | 1 | 10 | LYM760 | 0.85 | 0.03 | 1 | 11 |
| LYM760 | 0.91 | 0.01 | 1 | 15 | LYM760 | 0.73 | 0.04 | 5 | 1 |
| LYM760 | 0.83 | 0.01 | 5 | 13 | LYM760 | 0.83 | 0.01 | 5 | 9 |
| LYM760 | 0.83 | 0.01 | 5 | 10 | LYM760 | 0.82 | 0.05 | 5 | 4 |
| LYM760 | 0.79 | 0.02 | 5 | 15 | LYM760 | 0.72 | 0.03 | 4 | 18 |
| LYM761 | 0.85 | 0.01 | 3 | 1 | LYM761 | 0.78 | 0.02 | 3 | 9 |
| LYM761 | 0.83 | 0.01 | 3 | 10 | LYM761 | 0.86 | 0.01 | 3 | 4 |
| LYM761 | 0.72 | 0.03 | 6 | 13 | LYM762 | 0.89 | 0.02 | 1 | 8 |
| LYM762 | 0.86 | 0.03 | 1 | 16 | LYM762 | 0.76 | 0.08 | 1 | 17 |
| LYM762 | 0.80 | 0.03 | 2 | 9 | LYM762 | 0.81 | 0.03 | 2 | 10 |
| LYM762 | 0.78 | 0.04 | 2 | 5 | LYM762 | 0.72 | 0.07 | 2 | 15 |
| LYM762 | 0.80 | 0.02 | 5 | 8 | LYM762 | 0.81 | 0.02 | 5 | 11 |
| LYM762 | 0.75 | 0.03 | 5 | 17 | LYM762 | 0.85 | 0.01 | 5 | 18 |
| LYM763 | 0.89 | 0.02 | 1 | 19 | LYM763 | 0.77 | 0.03 | 3 | 14 |
| LYM763 | 0.74 | 0.04 | 3 | 17 | LYM763 | 0.73 | 0.06 | 2 | 12 |
| LYM764 | 0.74 | 0.09 | 1 | 20 | LYM764 | 0.74 | 0.10 | 1 | 11 |

Table 39.
Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal, low nitrogen and drought conditions across barley varieties.
P = p value.

Example 9

Production of Brachypodium Transcriptom and High Throughput Correlation Analysis Using 60K Brachypodium Oligonucleotide Micro-Array In order to produce a high throughput correlation analysis comparing between plant phenotype and gene expression level, the present inventors utilized a brachypodium oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60K brachypodium genes and transcripts. In order to define correlations between the levels of RNA expression and yield or vigor related parameters, various plant characteristics of 24 different brachypodium accessions were analyzed. Among them, 22 accessions encompassing the observed variance were selected for RNA expression analysis and comparative genomic hybridization (CGH) analysis.

The correlation between the RNA levels and the characterized parameters was to analyzed using Pearson correlation test [Hypertext Transfer Protocol://World Wide Web (dot) davidmlane (dot) com/hyperstat/A34739 (dot) html].

Additional correlation analysis was done by comparing plant phenotype and gene copy number. The correlation between the normalized copy number hybridization signal and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Brachypodium tissues—two tissues [leaf and spike] were sampled and RNA was extracted as described above. Each micro-array expression information tissue type has received a Set ID as summarized in Table 40 below.

TABLE 40

Brachypodium transcriptome expression sets

| Expression Set | Set ID |
|---|---|
| Leaf at flowering stage under normal growth conditions | 1 |
| Leaf at flowering stage under normal growth conditions | 2 |
| Spike at flowering stage under normal growth conditions | 3 |

Table 40.
From set ID No. 1 the sample was used to extract DNA; from set ID Nos. 2 and 3 the samples were used to extract RNA.

Brachypodium yield components and vigor related parameters assessment—24 brachypodium accessions were grown in 4-6 repetitive plots (8 plant per plot), in a green house. The growing protocol was as follows: brachypodium seeds were sown in plots and grown under normal condition. Plants were continuously phenotyped during the growth period and at harvest (Table 42-43, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text to files and processed using the JMP statistical analysis software (SAS institute).

At the end of the growing period the grains were separated from the spikes and the following parameters were measured using digital imaging system and collected:

Number of tillering—all tillers were counted per plant at harvest (mean per plot).

Head number—At the end of the experiment, heads were harvested from each plot and were counted.

Total Grains weight per plot (gr.)—At the end of the experiment (plant 'Heads') heads from plots were collected, the heads were threshed and grains were weighted. In addition, the average grain weight per head was calculated by dividing the total grain weight by number of total heads per plot (based on plot).

Highest number of spikelets—The highest spikelet number per head was calculated per plant (mean per plot).

Mean number of spikelets—The mean spikelet number per head was calculated per plot.

Plant height—Each of the plants was measured for its height using measuring tape. Height was measured from ground level to spike base of the longest spike at harvest.

Spikelets weight (gr.)—The biomass and spikes weight of each plot was separated, measured per plot.

Average head weight—calculated by dividing spikelets weight with head number (gr.).

Harvest Index—The harvest index was calculated using Formula XI (described above).

Spikelets Index—The Spikelets index is calculated using Formula XV.

Spikelets Index=Average Spikelets weight per plant/ (Average vegetative dry weight per plant plus Average Spikelets weight per plant). Formula XV:

Percent Number of heads with spikelets—The number of heads with more than one spikelet per plant were counted and the percent from all heads per plant was calculated.

Total dry mater per plot—Calculated as Vegetative portion above ground plus all the spikelet dry weight per plot.

1000 grain weight—At the end of the experiment all grains from all plots were collected and weighted and the weight of 1000 were calculated.

The following parameters were collected using digital imaging system:

At the end of the growing period the grains were separated from the spikes and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length, perimeter and width (cm)—A sample of ~200 grains was weighted, photographed and images were processed using the below described image processing system. The sum of grain lengths and width (longest axis) was measured from those images and was divided by the number of grains.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

TABLE 41

Brachypodium correlated parameters (vectors)

| Correlated parameter with | Correlation ID |
|---|---|
| % Number of heads with spikelets | 1 or 26 |
| 1000 grain weight (gr.) | 2 or 27 |
| Average head weight (gr.) | 3 or 28 |
| Grain area (cm²) | 4 or 29 |
| Grain length (cm) | 5 or 30 |
| Grain Perimeter (cm) | 6 or 31 |
| Grain width (cm) | 7 or 32 |
| Grains weight per plant (gr.) | 8 or 33 |
| Grains weight per plot (gr.) | 9 or 34 |
| Harvest index | 10 or 35 |
| Heads per plant | 11 or 36 |
| Heads per plot | 12 or 37 |
| Highest number of spikelets per plot | 13 or 38 |
| Mean number of spikelets per plot | 14 or 39 |
| Number of heads with spikelets per plant | 15 or 40 |
| Plant height (cm) | 16 or 41 |
| Plant Vegetative DW (gr.) | 17 or 42 |
| Plants number | 18 or 43 |

TABLE 41-continued

Brachypodium correlated parameters (vectors)

| Correlated parameter with | Correlation ID |
|---|---|
| Spikelets DW per plant (gr.) | 19 or 44 |
| Spikelets weight (gr.) | 20 or 45 |
| Spikes index | 21 or 46 |
| Tillering (number) | 22 |
| Total dry mater per plant (gr.) | 23 or 47 |
| Total dry mater per plot (gr.) | 24 or 48 |
| Vegetative DW (gr.) | 25 or 49 |

Table 41.
Provided are the Brachypodium correlated parameters. Correlation IDs 1-21 are identical to correlation IDs 26-46, respectively, and correlation IDs 23-25 are identical to correlation IDs 47-49, respectively.

Experimental Results 24 different Brachypodium accessions were grown and characterized for different parameters as described above. The average for each of the measured parameter was calculated using the JMP software and values are summarized in Tables 42-43 below. Subsequent correlation analysis between the various transcriptom sets and the average parameters (Table 44) was conducted. Follow, results were integrated to the database.

TABLE 42

Measured parameters of correlation IDs in Brachypodium accessions under normal conditions

| Treatment | Line-1 | Line-2 | Line-3 | Line-4 | Line-5 | Line-6 | Line-7 | Line-8 | Line-9 | Line-10 | Line-11 |
|---|---|---|---|---|---|---|---|---|---|---|---|
| 1 | 27.61 | 35.33 | 21.67 | 52.40 | 20.84 | 47.73 | 17.55 | 16.51 | 5.42 | 15.42 | 14.00 |
| 2 | 3.75 | 3.78 | 3.35 | 3.70 | 3.90 | 4.87 | 4.82 | 4.76 | 5.54 | 4.98 | 4.88 |
| 3 | 0.06 | 0.04 | 0.05 | 0.09 | 0.04 | 0.09 | 0.06 | 0.06 | 0.04 | 0.06 | 0.07 |
| 4 | 0.10 | 0.10 | 0.09 | 0.09 | 0.09 | 0.11 | 0.10 | 0.11 | 0.11 | 0.11 | 0.09 |
| 5 | 0.73 | 0.72 | 0.72 | 0.75 | 0.72 | 0.87 | 0.79 | 0.79 | 0.83 | 0.82 | 0.74 |
| 6 | 1.67 | 1.62 | 1.62 | 1.65 | 1.60 | 1.90 | 1.80 | 1.82 | 1.82 | 1.83 | 1.69 |
| 7 | 0.18 | 0.17 | 0.17 | 0.15 | 0.15 | 0.16 | 0.17 | 0.18 | 0.16 | 0.17 | 0.16 |
| 8 | 0.14 | 0.06 | 0.08 | 0.35 | 0.27 | 0.44 | 0.32 | 0.07 | 0.14 | 0.14 | 0.26 |
| 9 | 1.05 | 0.44 | 0.61 | 2.58 | 2.03 | 3.40 | 2.58 | 0.39 | 1.11 | 1.07 | 1.96 |
| 10 | 0.13 | 0.14 | 0.15 | 0.21 | 0.17 | 0.18 | 0.15 | 0.11 | 0.20 | 0.16 | 0.20 |
| 11 | 16.29 | 7.08 | 6.59 | 16.11 | 21.40 | 17.05 | 25.88 | 8.02 | 10.48 | 9.09 | 11.63 |
| 12 | 121.75 | 56.60 | 52.75 | 123.50 | 156.83 | 135.00 | 207.00 | 48.60 | 82.40 | 70.13 | 83.40 |
| 13 | 3.00 | 2.60 | 3.00 | 2.83 | 2.33 | 4.50 | 2.60 | 2.00 | 2.00 | 2.25 | 2.20 |
| 14 | 2.10 | 2.10 | 1.72 | 2.17 | 1.85 | 2.85 | 1.93 | 1.56 | 1.38 | 1.65 | 1.69 |
| 15 | 5.27 | 2.50 | 2.06 | 9.44 | 5.02 | 7.72 | 4.90 | 1.87 | 0.71 | 1.94 | 2.08 |
| 16 | 31.65 | 23.44 | 22.75 | 45.35 | 29.41 | 46.74 | 38.39 | 29.15 | 34.36 | 28.65 | 31.95 |
| 17 | 0.42 | 0.12 | 0.13 | 0.82 | 0.67 | 1.05 | 0.87 | 0.31 | 0.32 | 0.32 | 0.38 |
| 18 | 7.50 | 8.00 | 8.00 | 7.50 | 7.33 | 7.88 | 8.00 | 6.40 | 7.80 | 7.75 | 7.20 |
| 19 | 0.96 | 0.31 | 0.33 | 1.46 | 0.96 | 1.42 | 1.56 | 0.45 | 0.44 | 0.56 | 0.88 |
| 20 | 7.18 | 2.50 | 2.68 | 11.31 | 7.16 | 11.05 | 12.44 | 2.66 | 3.45 | 4.29 | 6.42 |
| 21 | 0.71 | 0.72 | 0.73 | 0.68 | 0.60 | 0.57 | 0.65 | 0.60 | 0.58 | 0.66 | 0.71 |
| 22 | 16.84 | 7.20 | 7.00 | 16.99 | 23.61 | 18.25 | 27.20 | 8.60 | 10.67 | 9.38 | 11.97 |
| 23 | 1.38 | 0.43 | 0.47 | 2.28 | 1.63 | 2.47 | 2.43 | 0.76 | 0.76 | 0.88 | 1.25 |
| 24 | 10.26 | 3.45 | 3.74 | 17.78 | 12.29 | 19.27 | 19.40 | 4.47 | 6.00 | 6.78 | 9.12 |
| 25 | 3.08 | 0.95 | 1.06 | 6.47 | 5.13 | 8.23 | 6.96 | 1.81 | 2.55 | 2.48 | 2.69 |

Table 42.
Correlation IDs: 1, 2, 3, 4, 5, . . . etc. refer to those described in Table 41 above [Brachypodium correlated parameters (vectors)].

TABLE 43

Measured parameters of correlation IDs in brachypodium accessions under normal conditions

| Treatment | Line-12 | Line-13 | Line-14 | Line-15 | Line-16 | Line-17 | Line-18 | Line-19 | Line-20 | Line-21 | Line-22 |
|---|---|---|---|---|---|---|---|---|---|---|---|
| 1 | 6.40 | 4.51 | 15.52 | 20.34 | 8.11 | 53.21 | 55.41 | 47.81 | 42.81 | 59.01 | 34.92 |
| 2 | 4.83 | 5.54 | 4.73 | 5.24 | 4.96 | 4.00 | 3.84 | 4.26 | 5.99 | 3.76 | 4.34 |
| 3 | 0.05 | 0.04 | 0.05 | 0.05 | 0.06 | 0.10 | 0.08 | 0.08 | 0.08 | 0.09 | 0.06 |

TABLE 43-continued

Measured parameters of correlation IDs in brachypodium accessions under normal conditions

| | Ecotype | | | | | | | | | | |
|---|---|---|---|---|---|---|---|---|---|---|---|
| Treatment | Line-12 | Line-13 | Line-14 | Line-15 | Line-16 | Line-17 | Line-18 | Line-19 | Line-20 | Line-21 | Line-22 |
| 4 | 0.10 | 0.11 | 0.10 | 0.12 | 0.10 | 0.10 | 0.10 | 0.09 | 0.12 | 0.09 | 0.09 |
| 5 | 0.78 | 0.90 | 0.75 | 0.86 | 0.74 | 0.84 | 0.75 | 0.80 | 0.84 | 0.76 | 0.74 |
| 6 | 1.74 | 1.93 | 1.69 | 1.91 | 1.71 | 1.81 | 1.68 | 1.75 | 1.87 | 1.68 | 1.66 |
| 7 | 0.17 | 0.16 | 0.17 | 0.19 | 0.17 | 0.15 | 0.17 | 0.14 | 0.18 | 0.15 | 0.16 |
| 8 | 0.14 | 0.11 | 0.39 | 0.14 | 0.13 | 0.37 | 0.08 | 0.49 | 0.31 | 0.30 | 0.20 |
| 9 | 1.09 | 0.84 | 3.07 | 1.09 | 1.07 | 2.99 | 0.50 | 3.52 | 2.41 | 1.92 | 1.47 |
| 10 | 0.14 | 0.26 | 0.22 | 0.09 | 0.18 | 0.09 | 0.07 | 0.16 | 0.18 | 0.09 | 0.11 |
| 11 | 14.13 | 5.88 | 23.75 | 16.06 | 9.74 | 22.19 | 11.89 | 24.32 | 13.25 | 25.54 | 19.22 |
| 12 | 110.33 | 47.00 | 185.50 | 125.00 | 80.75 | 177.50 | 81.50 | 172.80 | 98.60 | 177.00 | 143.17 |
| 13 | 1.83 | 2.00 | 2.50 | 2.40 | 2.00 | 3.50 | 3.50 | 3.80 | 2.80 | 3.17 | 2.83 |
| 14 | 1.43 | 1.25 | 1.76 | 1.83 | 1.42 | 2.71 | 2.41 | 2.61 | 2.12 | 2.79 | 2.15 |
| 15 | 1.08 | 0.35 | 4.98 | 3.70 | 0.89 | 12.58 | 7.59 | 12.13 | 6.35 | 15.36 | 7.15 |
| 16 | 28.88 | 24.74 | 37.30 | 45.09 | 22.39 | 55.04 | 31.40 | 45.34 | 40.20 | 58.82 | 39.18 |
| 17 | 0.39 | 0.13 | 0.87 | 0.69 | 0.34 | 1.72 | 0.44 | 1.32 | 0.48 | 1.73 | 0.63 |
| 18 | 7.83 | 8.00 | 7.75 | 8.00 | 8.25 | 8.00 | 6.50 | 7.00 | 7.60 | 6.83 | 7.33 |
| 19 | 0.67 | 0.26 | 1.14 | 0.83 | 0.59 | 2.27 | 0.92 | 1.91 | 1.09 | 2.25 | 1.26 |
| 20 | 5.29 | 2.04 | 8.89 | 6.65 | 4.92 | 18.15 | 6.25 | 13.49 | 8.35 | 15.55 | 9.42 |
| 21 | 0.64 | 0.66 | 0.59 | 0.54 | 0.68 | 0.56 | 0.69 | 0.59 | 0.70 | 0.57 | 0.66 |
| 22 | 14.58 | 6.35 | 25.50 | 16.56 | 10.53 | 27.15 | 12.38 | 26.30 | 13.56 | 29.09 | 20.79 |
| 23 | 1.06 | 0.38 | 2.01 | 1.53 | 0.93 | 3.99 | 1.36 | 3.23 | 1.57 | 3.98 | 1.89 |
| 24 | 8.34 | 3.04 | 15.79 | 12.20 | 7.76 | 31.94 | 9.21 | 22.78 | 12.04 | 27.67 | 14.14 |
| 25 | 3.05 | 1.00 | 6.89 | 5.55 | 2.84 | 13.80 | 2.96 | 9.28 | 3.70 | 12.12 | 4.72 |

Table 43.
Correlation IDs: 1, 2, 3, 4, 5, . . . etc. refer to those described in Table 41 above [*Brachypodium* correlated parameters (vectors)].

TABLE 44

Correlation between the expression level of selected genes of some embodiments of the invention in various tissues and the phenotypic performance under normal conditions across brachypodium varieties

| Gene Name | R | P value | Exp. set | Corr. Set ID | Gene Name | R | P value | Exp. set | Corr. Set ID |
|---|---|---|---|---|---|---|---|---|---|
| LYM765 | 0.77 | 5.33E−03 | 2 | 26 | LYM765 | 0.72 | 1.20E−02 | 2 | 40 |
| LYM765 | 0.74 | 9.55E−03 | 2 | 39 | LYM765 | 0.72 | 1.19E−02 | 2 | 28 |
| LYM766 | 0.75 | 7.99E−03 | 2 | 31 | LYM770 | 0.71 | 2.11E−02 | 3 | 44 |
| LYM767 | 0.77 | 5.38E−03 | 2 | 46 | LYM770 | 0.83 | 2.98E−03 | 3 | 33 |
| LYM768 | 0.70 | 1.05E−02 | 1 | 5 | LYM770 | 0.75 | 1.24E−02 | 3 | 26 |
| LYM769 | 0.71 | 9.34E−03 | 1 | 5 | LYM770 | 0.80 | 4.99E−03 | 3 | 39 |
| LYM770 | 0.75 | 1.19E−02 | 3 | 48 | LYM770 | 0.82 | 3.41E−03 | 3 | 28 |
| LYM770 | 0.89 | 6.58E−04 | 3 | 38 | LYM770 | 0.90 | 1.94E−04 | 2 | 38 |
| LYM770 | 0.73 | 1.60E−02 | 3 | 49 | LYM770 | 0.78 | 4.62E−03 | 2 | 26 |
| LYM770 | 0.76 | 1.00E−02 | 3 | 45 | LYM770 | 0.72 | 1.30E−02 | 2 | 41 |
| LYM770 | 0.87 | 1.08E−03 | 3 | 34 | LYM770 | 0.76 | 6.81E−03 | 2 | 28 |
| LYM770 | 0.70 | 2.32E−02 | 3 | 47 | LYM771 | 0.73 | 1.15E−02 | 2 | 41 |
| LYM770 | 0.90 | 1.81E−04 | 2 | 33 | LYM773 | 0.71 | 2.20E−02 | 3 | 32 |
| LYM770 | 0.82 | 1.91E−03 | 2 | 39 | | | | | |
| LYM770 | 0.93 | 4.44E−05 | 2 | 34 | | | | | |
| LYM771 | 0.71 | 1.41E−02 | 2 | 33 | | | | | |
| LYM771 | 0.73 | 1.04E−02 | 2 | 34 | | | | | |
| LYM772 | 0.93 | 1.56E−05 | 1 | 9 | | | | | |
| LYM773 | 0.85 | 2.02E−03 | 3 | 29 | | | | | |

Table 44.
Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal conditions across *brachypodium* varieties.
P = p value.

Example 10

Production of Foxtail Millet Transcriptom and High Throughput Correlation Analysis Using 60K Foxtail Millet Oligonucleotide Micro-Array In order to produce a high throughput correlation analysis comparing between to plant phenotype and gene expression level, the present inventors utilized a foxtail millet oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60K foxtail millet genes and transcripts. In order to define correlations between the levels of RNA expression and yield or vigor related parameters, various plant characteristics of 15 different foxtail millet accessions were analyzed. Among them, 11 accessions encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

Analyzed Foxtail millet tissues—three tissues at different developmental stages [leaf, flower, and stem], representing different plant characteristics, were sampled and RNA was extracted as described above. Each micro-array expression information tissue type has received a Set ID as summarized in Table 45 below.

TABLE 45

Foxtail millet transcriptome expression sets

| Expression Set | Set ID |
|---|---|
| Grain, grain filling stage, normal | 1 |
| Leaf, grain filling stage, normal | 2 |
| Stem, grain filling stage, normal | 3 |
| Flower, flowering stage, normal | 4 |
| Leaf, flowering stage, normal | 5 |

Table 45.

Foxtail millet yield components and vigor related parameters assessment—14 Foxtail millet accessions were grown in 5 repetitive plots, in the field. Foxtail millet seeds were sown in soil and grown under normal condition in the field. Plants were continuously phenotyped during the growth period and at harvest (Table 47-48, below). The image analysis system included a personal desktop computer (Intel P4 3.0 GHz processor) and a public domain program—ImageJ 1.37 (Java based image processing program, which was developed at the U.S. National Institutes of Health and freely available on the internet [Hypertext Transfer Protocol://rsbweb (dot) nih (dot) gov/]. Next, analyzed data was saved to text files and processed using the JMP statistical analysis software (SAS institute).

The following parameters were collected using digital imaging system:

At the end of the growing period the grains were separated from the Plant 'Head' and the following parameters were measured and collected:

(i) Average Grain Area ($cm^2$)—A sample of ~200 grains was weighted, photographed and images were processed using the below described image processing system. The grain area was measured from those images and was divided by the number of grains.

(ii) Average Grain Length and width (cm)—A sample of ~200 grains was weighted, photographed and images were processed using the below described image processing system. The sum of grain lengths and width (longest axis) was measured from those images and was divided by the number of grains.

At the end of the growing period 14 'Heads' were photographed and images were processed using the below described image processing system.

(i) Head Average Area ($cm^2$)—The 'Head' area was measured from those images and was divided by the number of 'Heads'.

(ii) Head Average Length (mm)—The 'Head' length (longest axis) was measured from those images and was divided by the number of 'Heads'.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

Additional parameters were collected either by sampling 5 plants per plot or by measuring the parameter across all the plants within the plot.

Total Grain Weight (gr.)—At the end of the experiment (plant 'Heads') heads from plots were collected, the heads were threshed and grains were weighted. In addition, the average grain weight per head was calculated by dividing the total grain to weight by number of total heads per plot (based on plot).

Head weight and head number—At the end of the experiment, heads were harvested from each plot and were counted and weighted (kg.).

Biomass at harvest—At the end of the experiment the vegetative material from plots was weighted.

Dry weight=total weight of the vegetative portion above ground (excluding roots) after drying at 70° C. in oven for 48 hours at harvest.

Total dry mater per plot—Calculated as Vegetative portion above ground plus all the heads dry weight per plot.

Num days to anthesis—Calculated as the number of days from sowing till 50% of the plot arrive anthesis.

TABLE 46

Foxtail millet correlated parameters (vectors)

| Correlated parameter with | Correlation ID |
|---|---|
| 1000 grain weight | 1 |
| Biomass at harvest (1M) | 2 |
| Grain area | 3 |
| Grain length | 4 |
| Grain width | 5 |
| Grains yield per Head (plot) | 6 |
| Head Area | 7 |
| Head length | 8 |
| Heads num | 9 |
| Num days to Anthesis | 10 |
| Total Grains yield | 11 |
| Total dry matter (1M) | 12 |
| Total heads weight | 13 |

Table 46.
Provided are the foxtail millet correlated parameters.

Experimental Results 14 different foxtail millet accessions were grown and characterized for different parameters as described above. The average for each of the measured parameters was calculated using the JMP software and values are summarized in Tables 47-48 below. Subsequent correlation analysis between the various transcriptom sets and the average parameters was conducted (Table 49). Follow, results were integrated to the database.

TABLE 47

Measured parameters of correlation IDs in foxtail millet accessions under normal conditions

| Treatment | Ecotype | | | | | | |
|---|---|---|---|---|---|---|---|
| | Line-1 | Line-2 | Line-3 | Line-4 | Line-5 | Line-6 | Line-7 |
| 1 | 2.46 | 3.42 | 2.61 | 2.36 | 2.41 | 2.65 | 2.18 |
| 2 | 2.40 | 3.99 | 3.17 | 3.58 | 3.60 | 3.06 | 4.04 |
| 3 | 0.032 | 0.037 | 0.033 | 0.032 | 0.032 | 0.034 | 0.029 |
| 4 | 0.240 | 0.242 | 0.249 | 0.253 | 0.256 | 0.252 | 0.231 |
| 5 | 0.172 | 0.194 | 0.167 | 0.159 | 0.160 | 0.170 | 0.162 |
| 6 | 3.40 | 7.29 | 1.75 | 1.30 | 1.57 | 0.69 | 2.10 |
| 7 | 37.83 | 57.87 | 19.59 | 17.10 | 19.76 | 9.42 | 22.92 |
| 8 | 23.13 | 24.25 | 17.56 | 14.79 | 15.38 | 8.56 | 16.08 |
| 9 | 427.60 | 149.20 | 867.00 | 1204.00 | 1146.40 | 2132.00 | 752.20 |
| 10 | 34.00 | 41.00 | 45.00 | 41.00 | 41.00 | 30.00 | 38.00 |
| 11 | 1449.63 | 1067.88 | 1534.92 | 1567.20 | 1794.80 | 1476.11 | 1582.57 |
| 12 | 0.70 | 0.85 | 0.96 | 0.92 | 0.90 | 0.48 | 0.92 |
| 13 | 3.81 | 5.95 | 6.20 | 5.64 | 6.27 | 6.07 | 6.32 |

Table 47:
Correlation IDs: 1, 2, 3, 4, 5, ... etc. refer to those described in Table 46 above [Foxtail millet correlated parameters (vectors)].

TABLE 48

Measured parameters of correlation IDs in foxtail millet accessions under normal conditions

| Treatment | Ecotype | | | | | | |
|---|---|---|---|---|---|---|---|
| | Line-8 | Line-9 | Line-10 | Line-11 | Line-12 | Line-13 | Line-14 |
| 1 | 1.80 | 2.69 | 1.65 | 3.17 | 2.60 | 3.18 | 2.26 |
| 2 | 1.15 | 3.20 | 3.90 | 3.58 | 3.68 | 2.94 | 1.48 |
| 3 | 0.024 | 0.032 | 0.025 | 0.037 | 0.033 | 0.039 | 0.030 |
| 4 | 0.196 | 0.221 | 0.20 | 0.26 | 0.25 | 0.27 | 0.24 |
| 5 | 0.155 | 0.184 | 0.16 | 0.18 | 0.17 | 0.18 | 0.16 |
| 6 | 3.34 | 11.46 | 7.17 | 4.35 | 2.26 | 0.44 | 1.31 |
| 7 | 40.89 | 45.29 | 49.34 | 27.69 | 24.18 | 7.13 | 14.69 |
| 8 | 21.88 | 20.41 | 23.32 | 20.87 | 17.98 | 6.35 | 9.78 |
| 9 | 394.20 | 186.60 | 131.80 | 434.20 | 646.40 | 2797.80 | 994.60 |
| 10 | 30.00 | 38.00 | 51.00 | 44.00 | 51.00 | 31.00 | 27.00 |
| 11 | 1317.88 | 2131.60 | 937.93 | 1880.21 | 1427.12 | 1216.24 | 1296.69 |
| 12 | 0.45 | 0.59 | 1.00 | 0.91 | 1.03 | 0.62 | 0.46 |
| 13 | 2.82 | 7.25 | 5.24 | 6.58 | 5.85 | 5.62 | 2.73 |

Table 48:
Correlation IDs: 1, 2, 3, 4, 5, ... etc. refer to those described in Table 46 above [Foxtail millet correlated parameters (vectors)].

TABLE 49

Correlation between the expression level of selected genes of some embodiments of the invention in various tissues and the phenotypic performance under normal conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LYM775 | 0.73 | 1.03E−01 | 1 | 4 | LYM775 | 0.99 | 2.13E−04 | 1 | 9 |
| LYM776 | 0.77 | 9.56E−03 | 2 | 2 | LYM776 | 0.79 | 1.89E−02 | 3 | 2 |
| LYM776 | 0.78 | 6.80E−02 | 1 | 13 | LYM777 | 0.81 | 4.68E−02 | 2 | 10 |
| LYM777 | 0.94 | 5.97E−03 | 1 | 1 | LYM777 | 0.74 | 9.27E−02 | 1 | 8 |
| LYM777 | 0.96 | 2.14E−03 | 1 | 3 | LYM777 | 0.81 | 4.99E−02 | 1 | 5 |
| LYM777 | 0.81 | 4.96E−02 | 1 | 7 | LYM778 | 0.72 | 4.26E−02 | 3 | 1 |
| LYM778 | 0.78 | 2.24E−02 | 3 | 6 | LYM778 | 0.87 | 5.21E−03 | 3 | 5 |
| LYM778 | 0.82 | 4.73E−02 | 1 | 1 | LYM778 | 0.93 | 7.63E−03 | 1 | 8 |
| LYM778 | 0.77 | 7.59E−02 | 1 | 3 | LYM778 | 0.82 | 4.38E−02 | 1 | 5 |
| LYM778 | 0.87 | 2.43E−02 | 1 | 7 | LYM779 | 0.72 | 4.19E−02 | 3 | 12 |
| LYM779 | 0.72 | 1.09E−01 | 1 | 13 | LYM779 | 0.96 | 1.83E−03 | 1 | 11 |
| LYM780 | 0.91 | 1.30E−02 | 1 | 8 | LYM780 | 0.74 | 9.16E−02 | 1 | 7 |
| LYM781 | 0.76 | 7.73E−02 | 1 | 5 | LYM781 | 0.78 | 6.61E−02 | 1 | 7 |

TABLE 49-continued

Correlation between the expression level of selected genes of some embodiments of the invention in various tissues and the phenotypic performance under normal conditions across foxtail millet varieties

| Gene Name | R | P value | Exp. set | Corr. Set ID | Gene Name | R | P value | Exp. set | Corr. Set ID |
|---|---|---|---|---|---|---|---|---|---|
| LYM782 | 0.74 | 9.49E−02 | 1 | 13 | LYM783 | 0.81 | 5.01E−02 | 1 | 4 |
| LYM783 | 0.75 | 8.55E−02 | 1 | 3 | LYM783 | 0.97 | 9.69E−04 | 1 | 9 |
| LYM784 | 0.90 | 2.62E−03 | 3 | 1 | LYM784 | 0.88 | 4.24E−03 | 3 | 3 |
| LYM784 | 0.80 | 1.67E−02 | 3 | 5 | LYM784 | 0.77 | 7.54E−02 | 1 | 13 |
| LYM784 | 0.85 | 3.05E−02 | 1 | 11 | LYM785 | 0.72 | 1.08E−01 | 1 | 13 |
| LYM785 | 0.91 | 1.15E−02 | 1 | 6 | LYM785 | 0.77 | 7.03E−02 | 1 | 5 |
| LYM785 | 0.70 | 1.20E−01 | 1 | 7 | LYM786 | 0.94 | 4.62E−03 | 1 | 8 |
| LYM786 | 0.73 | 9.73E−02 | 1 | 5 | LYM786 | 0.82 | 4.57E−02 | 1 | 7 |
| LYM787 | 0.83 | 1.04E−02 | 3 | 11 | LYM787 | 0.76 | 2.95E−02 | 3 | 8 |
| LYM787 | 0.80 | 1.67E−02 | 3 | 6 | LYM787 | 0.80 | 1.72E−02 | 3 | 1 |
| LYM787 | 0.71 | 1.16E−01 | 1 | 11 | LYM787 | 0.70 | 1.20E−01 | 1 | 9 |
| LYM788 | 0.81 | 4.89E−02 | 1 | 4 | LYM789 | 0.79 | 2.02E−02 | 3 | 6 |
| LYM789 | 0.82 | 1.19E−02 | 3 | 5 | LYM789 | 0.81 | 5.03E−02 | 1 | 1 |
| LYM789 | 0.75 | 8.63E−02 | 1 | 8 | LYM789 | 0.92 | 8.85E−03 | 1 | 6 |
| LYM789 | 0.94 | 4.73E−03 | 1 | 5 | LYM789 | 0.92 | 8.93E−03 | 1 | 7 |
| LYM790 | 0.83 | 4.00E−02 | 1 | 13 | LYM790 | 0.84 | 3.85E−02 | 1 | 11 |
| LYM791 | 0.73 | 1.75E−02 | 2 | 10 | LYM791 | 0.79 | 1.86E−02 | 3 | 12 |
| LYM791 | 0.84 | 3.52E−02 | 1 | 6 | LYM791 | 0.84 | 3.73E−02 | 1 | 5 |
| LYM791 | 0.79 | 5.96E−02 | 1 | 7 | LYM792 | 0.83 | 1.16E−02 | 3 | 9 |
| LYM792 | 0.97 | 1.09E−03 | 1 | 11 | LYM793 | 0.73 | 1.66E−02 | 2 | 11 |
| LYM793 | 0.83 | 3.03E−03 | 2 | 12 | LYM793 | 0.80 | 5.53E−03 | 2 | 8 |
| LYM793 | 0.78 | 7.48E−03 | 2 | 10 | LYM794 | 0.73 | 1.03E−01 | 1 | 13 |
| LYM794 | 0.98 | 5.10E−04 | 1 | 11 | LYM795 | 0.94 | 5.28E−03 | 1 | 4 |
| LYM795 | 0.86 | 2.67E−02 | 1 | 9 | LYM796 | 0.74 | 1.45E−02 | 2 | 2 |
| LYM796 | 0.88 | 1.99E−02 | 1 | 11 | LYM797 | 0.78 | 2.28E−02 | 3 | 11 |
| LYM779 | 0.70 | 1.55E−02 | 4 | 8 | LYM779 | 0.73 | 1.12E−02 | 4 | 10 |
| LYM779 | 0.81 | 2.66E−03 | 4 | 6 | LYM779 | 0.71 | 1.48E−02 | 4 | 7 |
| LYM791 | 0.77 | 5.89E−03 | 4 | 11 | LYM791 | 0.77 | 9.40E−03 | 5 | 11 |
| LYM793 | 0.71 | 1.47E−02 | 4 | 3 | LYM793 | 0.77 | 8.83E−03 | 5 | 4 |
| LYM793 | 0.71 | 2.09E−02 | 5 | 9 | | | | | |

Table 49.
Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal, low nitrogen and drought conditions across foxtail millet varieties.
P = p value.

Example 11

Production of Soybean (Glycine Max) Transcriptom and High Throughput Correlation Analysis with Yield Parameters Using 44K B. Soybean Oligonucleotide Micro-Arrays In order to produce a high throughput correlation analysis, the present inventors utilized a Soybean oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 42,000 Soybean genes and transcripts. In order to define correlations between the levels to of RNA expression with yield components or plant architecture related parameters or plant vigor related parameters, various plant characteristics of 29 different Glycine max varieties were analyzed and 12 varieties were further used for RNA expression analysis. The correlation between the RNA levels and the characterized parameters was analyzed using Pearson correlation test.

Correlation of Glycine max Genes' Expression Levels with Phenotypic Characteristics Across Ecotype
 Experimental Procedures
29 Soybean varieties were grown in three repetitive plots, in field. Briefly, the growing protocol was as follows: Soybean seeds were sown in soil and grown under normal conditions until harvest. In order to define correlations between the levels of RNA expression with yield components or plant architecture related parameters or vigor related parameters, 12 different Soybean varieties (out of 29 varieties) were analyzed and used for gene expression analyses. Analysis was performed at two pre-determined time periods: at pod set (when the soybean pods are formed) and at harvest time (when the soybean pods are ready for harvest, with mature seeds).

TABLE 50

Soybean transcriptom expression sets

| Expression Set | Set ID |
|---|---|
| Apical meristem, Before flowering | 1 |
| Leaf, Before flowering: | 2 |
| Leaf, at flowering | 3 |
| Leaf, at pod setting | 4 |
| Root, Before flowering | 5 |
| ecotypes VT/Root, at flowering | 6 |
| Root, pod setting | 7 |
| Stem, Before flowering | 8 |
| Stem, at pod setting | 9 |
| Young flowers, at flowering | 10 |
| Pod, at pod setting | 11 |

Table 50.

RNA extraction—All 12 selected Soybean varieties were sample per treatment. Plant tissues [leaf, root. Stem. Pod, apical meristem. Flower buds] growing under normal conditions were sampled and RNA was extracted as described above. The collected data parameters were as follows:

Main branch base diameter [mm] at pod set—the diameter of the base of the main branch (based diameter) average of three plants per plot.

Fresh weight [gr./plant] at pod set—total weight of the vegetative portion to above ground (excluding roots) before drying at pod set, average of three plants per plot.

Dry weight [gr./plant] at pod set—total weight of the vegetative portion above ground (excluding roots) after drying at 70° C. in oven for 48 hours at pod set, average of three plants per plot.

Total number of nodes with pods on lateral branches [value/plant]—counting of nodes which contain pods in lateral branches at pod set, average of three plants per plot.

Number of lateral branches at pod set [value/plant]—counting number of lateral branches at pod set, average of three plants per plot.

Total weight of lateral branches at pod set [gr./plant]—weight of all lateral branches at pod set, average of three plants per plot.

Total weight of pods on main stem at pod set [gr./plant]—weight of all pods on main stem at pod set, average of three plants per plot.

Total number of nodes on main stem [value/plant]—count of number of nodes on main stem starting from first node above ground, average of three plants per plot.

Total number of pods with 1 seed on lateral branches at pod set [value/plant]—count of the number of pods containing 1 seed in all lateral branches at pod set, average of three plants per plot.

Total number of pods with 2 seeds on lateral branches at pod set [value/plant]—count of the number of pods containing 2 seeds in all lateral branches at pod set, average of three plants per plot.

Total number of pods with 3 seeds on lateral branches at pod set [value/plant]—count of the number of pods containing 3 seeds in all lateral branches at pod set, average of three plants per plot.

Total number of pods with 4 seeds on lateral branches at pod set [value/plant]—count of the number of pods containing 4 seeds in all lateral branches at pod set, average of three plants per plot.

Total number of pods with 1 seed on main stem at pod set [value/plant]—count of the number of pods containing 1 seed in main stem at pod set, average of three plants per plot.

Total number of pods with 2 seeds on main stem at pod set [value/plant]—count of the number of pods containing 2 seeds in main stem at pod set, average of three plants per plot.

Total number of pods with 3 seeds on main stem at pod set [value/plant]—count of the number of pods containing 3 seeds in main stem at pod set, average of three plants per plot.

Total number of pods with 4 seeds on main stem at pod set [value/plant]—count of the number of pods containing 4 seeds in main stem at pod set, average of three plants per plot.

Total number of seeds per plant at pod set [value/plant]—count of number of seeds in lateral branches and main stem at pod set, average of three plants per plot.

Total number of seeds on lateral branches at pod set [value/plant]—count of total number of seeds on lateral branches at pod set, average of three plants per plot.

Total number of seeds on main stem at pod set [value/plant]—count of total number of seeds on main stem at pod set, average of three plants per plot.

Plant height at pod set [cm/plant]—total length from above ground till the tip of the main stem at pod set, average of three plants per plot.

Plant height at harvest [cm/plant]—total length from above ground till the tip of the main stem at harvest, average of three plants per plot.

Total weight of pods on lateral branches at pod set [gr./plant]—weight of all pods on lateral branches at pod set, average of three plants per plot.

Ratio of the number of pods per node on main stem at pod set—calculated in formula XVI, average of three plants per plot.

Total number of pods on main stem/Total number of nodes on main stem, average of three plants per plot. Formula XVI:

Ratio of total number of seeds in main stem to number of seeds on lateral branches—calculated in formula XVII, average of three plants per plot.

Total number of seeds on main stem at pod set/Total number of seeds on lateral branches at pod set. Formula XVII:

Total weight of pods per plant at pod set [gr./plant]—weight of all pods on lateral branches and main stem at pod set, average of three plants per plot.

Days till 50% flowering [days]—number of days till 50% flowering for each plot.

Days till 100% flowering [days]—number of days till 100% flowering for each plot.

Maturity [days]—measure as 95% of the pods in a plot have ripened (turned 100% brown). Delayed leaf drop and green stems are not considered in assigning maturity. Tests are observed 3 days per week, every other day, for maturity. The maturity date is the date that 95% of the pods have reached final color. Maturity is expressed in days after August 31 [according to the accepted definition of maturity in USA, Descriptor list for SOYBEAN, Hypertext Transfer Protocol://World Wide Web (dot) ars-grin (dot) gov/cgi-bin/npgs/html/desclist (dot) pl?51].

Seed quality [ranked 1-5]—measure at harvest; a visual estimate based on several hundred seeds. Parameter is rated according to the following scores considering the amount and degree of wrinkling, defective coat (cracks), greenishness, and moldy or other pigment. Rating is 1-very good, 2-good, 3-fair, 4-poor, 5-very poor.

Lodging [ranked 1-5]—is rated at maturity per plot according to the following scores: 1—most plants in a plot are erected; 2—all plants leaning slightly or a few plants down; 3—all plants leaning moderately, or 25%-50% down; 4—all plants leaning considerably, or 50%-80% down; 5—most plants down. Note: intermediate score such as 1.5 are acceptable.

Seed size [gr.]—weight of 1000 seeds per plot normalized to 13% moisture, measure at harvest.

Total weight of seeds per plant [gr./plant]—calculated at harvest (per 2 inner rows of a trimmed plot) as weight in grams of cleaned seeds adjusted to 13% moisture and divided by the total number of plants in two inner rows of a trimmed plot.

Yield at harvest [bushels/hectare]—calculated at harvest (per 2 inner rows of a trimmed plot) as weight in grams of cleaned seeds, adjusted to 13% moisture, and then expressed as bushels per acre.

Experimental Results

Twelve different Soybean varieties lines 1-12 were grown and characterized for 34 parameters as specified above. The average for each of the measured parameters was calculated using the JMP software and values are summarized in Tables 52-53 below. Subsequent correlation analysis between the various transcriptom sets and the average parameters was conducted (Table 54). Follow, results were integrated to the database.

TABLE 51

Soybean correlated parameters (vectors)

| Correlated parameter with | Correlation ID |
|---|---|
| Base diameter at pod set (mm) | 1 |
| DW at pod set (gr.) | 2 |
| Fresh weight at pod set (kg) | 3 |
| Total number of nodes with pods on lateral branch | 4 |
| Number of lateral branches | 5 |
| Total weight of lateral branches at pod set (gr.) | 6 |
| Total weight of pods on main stem at pod set (gr.) | 7 |
| Total number of nodes on main stem | 8 |
| Total number of pods with 1 seed on lateral branch | 9 |
| Number of pods with 1 seed on main stem at pod set | 10 |
| Total number of pods with 2 seed on lateral branch | 11 |
| Number of pods with 2 seed on main stem | 12 |
| Total number of pods with 3 seed on lateral branch | 13 |
| Number of pods with 3 seed on main stem | 14 |
| Total number of pods with 4 seed on lateral branch | 15 |
| Number of pods with 4 seed on main stem | 16 |
| Total number of seeds per plant | 17 |
| Total Number of Seeds on lateral branches | 18 |
| Total Number of Seeds on main stem at pod set | 19 |
| Plant height at pod set (cm) | 20 |
| Total weight of pods on lateral branches (gr./plant) | 21 |
| Ratio number of pods per node on main stem (value) | 22 |
| Ratio number of seeds per main stem to seeds per lateral branches | 23 |
| Total weight of pods per plant (gr.) | 24 |
| 50 percent flowering | 25 |
| Maturity | 26 |
| 100 percent flowering | 27 |
| Plant height at harvest | 28 |
| Seed quality | 29 |
| Total weight of seeds per plant (gr.) | 30 |
| Seed size | 31 |
| Lodging (score 1-5) | 32 |
| Yield at harvest (gr.) | 33 |

Table 51.

TABLE 52

Measured parameters in Soybean varieties (lines 1-6)

| | Ecotype | | | | | |
|---|---|---|---|---|---|---|
| Treatment | Line-1 | Line-2 | Line-3 | Line-4 | Line-5 | Line-6 |
| 1 | 8.33 | 9.54 | 9.68 | 8.11 | 8.82 | 10.12 |
| 2 | 53.67 | 50.33 | 38.00 | 46.17 | 60.83 | 55.67 |
| 3 | 170.89 | 198.22 | 152.56 | 163.89 | 224.67 | 265.00 |
| 4 | 23.00 | 16.00 | 23.11 | 33.00 | 15.22 | 45.25 |
| 5 | 9.00 | 8.67 | 9.11 | 9.89 | 7.67 | 17.56 |
| 6 | 67.78 | 63.78 | 64.89 | 74.89 | 54.00 | 167.22 |
| 7 | 22.11 | 14.33 | 16.00 | 15.00 | 33.78 | 9.00 |
| 8 | 16.56 | 16.78 | 16.11 | 18.11 | 16.78 | 17.11 |
| 9 | 1.56 | 3.00 | 1.78 | 1.78 | 5.67 | 5.63 |
| 10 | 1.11 | 4.38 | 1.44 | 1.44 | 4.56 | 1.67 |
| 11 | 17.00 | 18.75 | 26.44 | 32.33 | 21.56 | 33.50 |
| 12 | 16.89 | 16.25 | 13.22 | 16.89 | 27.00 | 8.11 |
| 13 | 38.44 | 2.00 | 26.44 | 31.33 | 8.89 | 82.00 |
| 14 | 29.56 | 1.75 | 19.78 | 22.33 | 11.67 | 22.78 |
| 15 | 0.00 | 0.00 | 0.00 | 0.00 | 0.00 | 1.50 |
| 16 | 0.00 | 0.00 | 0.11 | 0.11 | 0.00 | 0.44 |
| 17 | 274.44 | 99.78 | 221.67 | 263.11 | 169.00 | 412.50 |
| 18 | 150.89 | 55.89 | 134.00 | 160.44 | 75.44 | 324.63 |
| 19 | 123.56 | 43.89 | 87.67 | 102.67 | 93.56 | 88.00 |
| 20 | 86.78 | 69.56 | 62.44 | 70.89 | 69.44 | 63.89 |
| 21 | 26.00 | 14.89 | 20.11 | 20.11 | 21.11 | 30.25 |
| 22 | 2.87 | 1.38 | 2.13 | 2.26 | 2.60 | 1.87 |
| 23 | 0.89 | 0.90 | 0.87 | 0.89 | 2.32 | 0.37 |
| 24 | 48.11 | 29.22 | 36.11 | 35.11 | 54.89 | 38.88 |
| 25 | 61.00 | 65.33 | 60.67 | 61.00 | 54.67 | 68.33 |
| 26 | 24.00 | 43.67 | 30.33 | 30.33 | 38.33 | 40.00 |
| 27 | 67.33 | 71.67 | 67.67 | 67.33 | 60.00 | 74.00 |
| 28 | 96.67 | 76.67 | 67.50 | 75.83 | 74.17 | 76.67 |
| 29 | 2.33 | 3.50 | 3.00 | 2.17 | 2.83 | 2.00 |
| 30 | 15.09 | 10.50 | 17.23 | 16.51 | 12.06 | 10.25 |
| 31 | 89.00 | 219.33 | 93.00 | 86.00 | 191.33 | 71.33 |
| 32 | 1.67 | 1.83 | 1.17 | 1.67 | 2.67 | 2.83 |
| 33 | 47.57 | 43.77 | 50.37 | 56.30 | 44.00 | 40.33 |

Table 52

TABLE 53

Measured parameters in Soybean varieties (lines 7-12)

| | Ecotype | | | | | |
|---|---|---|---|---|---|---|
| Treatment | Line-7 | Line-8 | Line-9 | Line-10 | Line-11 | Line-12 |
| 1 | 8.46 | 8.09 | 8.26 | 7.73 | 8.16 | 7.89 |
| 2 | 48.00 | 52.00 | 44.17 | 52.67 | 56.00 | 47.50 |
| 3 | 160.67 | 196.33 | 155.33 | 178.11 | 204.44 | 164.22 |
| 4 | 8.25 | 25.44 | 21.88 | 16.33 | 22.56 | 24.22 |
| 5 | 11.67 | 12.11 | 8.00 | 9.11 | 6.78 | 10.00 |
| 6 | 45.44 | 83.22 | 64.33 | 52.00 | 76.89 | 67.00 |
| 7 | 9.03 | 16.00 | 15.89 | 14.56 | 30.44 | 18.00 |
| 8 | 18.78 | 18.89 | 16.78 | 21.11 | 19.33 | 20.78 |
| 9 | 2.88 | 3.00 | 1.25 | 2.67 | 1.78 | 3.00 |
| 10 | 4.00 | 4.33 | 2.11 | 1.89 | 3.44 | 1.22 |
| 11 | 8.50 | 22.78 | 21.75 | 10.67 | 23.78 | 25.67 |
| 12 | 21.33 | 17.67 | 20.33 | 16.11 | 28.11 | 16.56 |
| 13 | 9.00 | 42.11 | 32.75 | 25.67 | 45.00 | 44.33 |
| 14 | 11.11 | 28.22 | 24.11 | 36.44 | 39.67 | 32.33 |
| 15 | 0.00 | 0.33 | 0.00 | 1.11 | 0.00 | 0.00 |
| 16 | 0.00 | 0.56 | 0.00 | 3.89 | 0.00 | 0.00 |
| 17 | 136.00 | 302.78 | 260.50 | 264.44 | 363.00 | 318.67 |
| 18 | 46.88 | 176.22 | 143.00 | 105.44 | 184.33 | 187.33 |
| 19 | 80.00 | 126.56 | 115.11 | 159.00 | 178.67 | 131.33 |
| 20 | 8.46 | 8.09 | 8.26 | 7.73 | 8.16 | 7.89 |
| 21 | 48.00 | 52.00 | 44.17 | 52.67 | 56.00 | 47.50 |
| 22 | 160.67 | 196.33 | 155.33 | 178.11 | 204.44 | 164.22 |
| 23 | 8.25 | 25.44 | 21.88 | 16.33 | 22.56 | 24.22 |
| 24 | 11.67 | 12.11 | 8.00 | 9.11 | 6.78 | 10.00 |
| 25 | 45.44 | 83.22 | 64.33 | 52.00 | 76.89 | 67.00 |
| 26 | 9.03 | 16.00 | 15.89 | 14.56 | 30.44 | 18.00 |
| 27 | 18.78 | 18.89 | 16.78 | 21.11 | 19.33 | 20.78 |
| 28 | 2.88 | 3.00 | 1.25 | 2.67 | 1.78 | 3.00 |
| 29 | 4.00 | 4.33 | 2.11 | 1.89 | 3.44 | 1.22 |
| 30 | 8.50 | 22.78 | 21.75 | 10.67 | 23.78 | 25.67 |
| 31 | 21.33 | 17.67 | 20.33 | 16.11 | 28.11 | 16.56 |
| 32 | 9.00 | 42.11 | 32.75 | 25.67 | 45.00 | 44.33 |
| 33 | 11.11 | 28.22 | 24.11 | 36.44 | 39.67 | 32.33 |

Table 53.

TABLE 54

Correlation between the expression level of selected genes of some embodiments of the invention in various tissues and the phenotypic performance under normal conditions across soybean varieties

| Gene Name | R | P value | Exp. set | Corr. Set ID | Gene Name | R | P value | Exp. set | Corr. Set ID |
|---|---|---|---|---|---|---|---|---|---|
| LYM980 | 0.79 | 0.01 | 1 | 30 | LYM980 | 0.80 | 0.01 | 1 | 33 |
| LYM980 | 0.78 | 0.01 | 1 | 22 | LYM980 | 0.71 | 0.02 | 5 | 1 |
| LYM980 | 0.72 | 0.02 | 8 | 33 | LYM980 | 0.74 | 0.01 | 4 | 23 |
| LYM981 | 0.86 | 0.00 | 7 | 3 | LYM981 | 0.91 | 0.00 | 7 | 1 |
| LYM981 | 0.79 | 0.01 | 7 | 9 | LYM981 | 0.94 | 0.00 | 5 | 31 |
| LYM981 | 0.79 | 0.02 | 9 | 26 | LYM981 | 0.72 | 0.04 | 9 | 25 |
| LYM981 | 0.71 | 0.05 | 9 | 27 | LYM981 | 0.78 | 0.02 | 9 | 1 |
| LYM981 | 0.75 | 0.00 | 1 | 15 | LYM981 | 0.77 | 0.00 | 1 | 6 |
| LYM982 | 0.73 | 0.02 | 7 | 26 | LYM982 | 0.74 | 0.01 | 5 | 3 |
| LYM982 | 0.76 | 0.01 | 5 | 2 | LYM982 | 0.89 | 0.00 | 5 | 9 |
| LYM982 | 0.89 | 0.00 | 8 | 3 | LYM982 | 0.77 | 0.01 | 8 | 15 |
| LYM982 | 0.74 | 0.01 | 8 | 6 | LYM982 | 0.73 | 0.02 | 8 | 1 |
| LYM982 | 0.83 | 0.00 | 8 | 9 | LYM982 | 0.85 | 0.00 | 4 | 1 |
| LYM982 | 0.75 | 0.01 | 1 | 9 | LYM983 | 0.84 | 0.00 | 7 | 1 |
| LYM983 | 0.75 | 0.01 | 5 | 31 | LYM983 | 0.72 | 0.02 | 8 | 28 |
| LYM983 | 0.84 | 0.01 | 9 | 13 | LYM983 | 0.88 | 0.00 | 9 | 18 |
| LYM983 | 0.86 | 0.01 | 9 | 11 | LYM983 | 0.77 | 0.03 | 9 | 3 |
| LYM983 | 0.88 | 0.00 | 9 | 15 | LYM983 | 0.93 | 0.00 | 9 | 6 |
| LYM983 | 0.72 | 0.04 | 9 | 5 | LYM983 | 0.97 | 0.00 | 9 | 4 |
| LYM983 | 0.71 | 0.05 | 9 | 21 | LYM983 | 0.74 | 0.01 | 10 | 28 |
| LYM984 | 0.79 | 0.01 | 7 | 29 | LYM984 | 0.89 | 0.00 | 5 | 31 |
| LYM984 | 0.74 | 0.02 | 8 | 30 | LYM984 | 0.73 | 0.02 | 8 | 33 |
| LYM984 | 0.76 | 0.03 | 9 | 23 | LYM984 | 0.74 | 0.03 | 9 | 12 |
| LYM984 | 0.84 | 0.00 | 10 | 23 | LYM985 | 0.77 | 0.01 | 5 | 1 |
| LYM985 | 0.75 | 0.01 | 5 | 31 | LYM985 | 0.73 | 0.04 | 9 | 30 |
| LYM985 | 0.73 | 0.01 | 4 | 9 | LYM985 | 0.72 | 0.01 | 1 | 23 |
| LYM985 | 0.75 | 0.00 | 1 | 25 | LYM985 | 0.74 | 0.01 | 1 | 27 |
| LYM985 | 0.71 | 0.01 | 10 | 13 | LYM985 | 0.75 | 0.00 | 10 | 17 |
| LYM986 | 0.79 | 0.02 | 9 | 30 | LYM986 | 0.75 | 0.03 | 9 | 22 |
| LYM986 | 0.88 | 0.00 | 9 | 7 | LYM986 | 0.75 | 0.00 | 10 | 6 |
| LYM987 | 0.72 | 0.02 | 5 | 22 | LYM987 | 0.76 | 0.01 | 8 | 16 |
| LYM987 | 0.79 | 0.01 | 8 | 15 | LYM987 | 0.71 | 0.05 | 9 | 22 |
| LYM987 | 0.81 | 0.01 | 9 | 7 | LYM987 | 0.71 | 0.01 | 10 | 13 |
| LYM987 | 0.72 | 0.01 | 10 | 17 | LYM988 | 0.73 | 0.02 | 5 | 2 |
| LYM988 | 0.78 | 0.01 | 5 | 9 | LYM988 | 0.72 | 0.02 | 8 | 18 |
| LYM988 | 0.87 | 0.00 | 8 | 3 | LYM988 | 0.89 | 0.00 | 8 | 15 |
| LYM988 | 0.88 | 0.00 | 8 | 6 | LYM988 | 0.82 | 0.00 | 8 | 5 |
| LYM988 | 0.79 | 0.01 | 8 | 4 | LYM988 | 0.70 | 0.02 | 8 | 1 |
| LYM988 | 0.82 | 0.00 | 8 | 9 | LYM988 | 0.86 | 0.00 | 1 | 3 |
| LYM988 | 0.72 | 0.01 | 1 | 2 | LYM988 | 0.83 | 0.00 | 1 | 9 |
| LYM988 | 0.84 | 0.00 | 10 | 3 | LYM988 | 0.71 | 0.01 | 10 | 6 |
| LYM988 | 0.80 | 0.00 | 10 | 9 | | | | | |

Table 54.
Provided are the correlations (R) between the expression levels yield improving genes and their homologs in various tissues [Expression (Exp) sets] and the phenotypic performance [yield, biomass, and plant architecture (Correlation vector (Corr.))] under normal conditions across soybean varieties.
P = p value.

Example 12

Production of Tomato Transcriptom and High Throughput Correlation Analysis Using 44K Tomato Oligonucleotide Micro-Array In order to produce a high throughput correlation analysis between NUE related phenotypes and gene expression, the present inventors utilized a Tomato oligonucleotide microarray, produced by Agilent Technologies [Hypertext Transfer Protocol://World Wide Web (dot) chem. (dot) agilent (dot) com/Scripts/PDS (dot) asp?lPage=50879]. The array oligonucleotide represents about 44,000 Tomato genes and transcripts. In order to define correlations between the levels of RNA expression with NUE, ABST, yield components or vigor related parameters various plant characteristics of 18 different Tomato varieties were analyzed. Among them, 10 varieties encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Correlation of Tomato Varieties Across Ecotypes Grown Under Low Nitrogen, Drought and Regular Growth Conditions Experimental Procedures:

10 Tomato varieties were grown in 3 repetitive blocks, each containing 6 plants per plot were grown at net house. Briefly, the growing protocol was as follows:

1. Regular growth conditions: Tomato varieties were grown under normal conditions (4-6 Liters/$m^2$ of water per day and fertilized with NPK as recommended in protocols for commercial tomato production).

2. Low Nitrogen fertilization conditions: Tomato varieties were grown under normal conditions (4-6 Liters/$m^2$ per day and fertilized with NPK as recommended in protocols for commercial tomato production) until flower stage. At this time, Nitrogen fertilization was stopped.

3. Drought stress: Tomato variety was grown under normal conditions (4-6 Liters/m² per day) until flower stage. At this time, irrigation was reduced to 50% compared to normal conditions.

Plants were phenotyped on a daily basis following the standard descriptor of tomato (Table 56). Harvest was conducted while 50% of the fruits were red (mature). Plants were separated to the vegetative part and fruits, of them, 2 nodes were analyzed for additional inflorescent parameters such as size, number of flowers, and inflorescent weight. Fresh weight of all vegetative material was measured. Fruits were separated to colors (red vs. green) and in accordance with the fruit size (small, medium and large). Next, analyzed data was saved to text files and processed using the JMP statistical analysis software (SAS institute). Data parameters collected are summarized in Tables 57-59, herein below.

Analyzed Tomato tissues—Two tissues at different developmental stages [flower and leaf], representing different plant characteristics, were sampled and RNA was extracted as described above. For convenience, each micro-array expression information tissue type has received a Set ID as summarized in Table 55 below.

TABLE 55

Tomato transcriptom expression sets

| Expression Set | Set ID |
| --- | --- |
| Tomato field, under low N conditions, leaf | 1 |
| Tomato field, under Normal conditions, flower | 2 |
| Tomato field, under Normal conditions, leaf | 3 |
| Tomato field, under Drought conditions, leaf | 4 |
| Tomato field, under low N conditions, flower | 5 |
| Tomato field, under Drought conditions, flower | 6 |

Table 55:
Provided are the identification (ID) digits of each of the tomato expression sets.

Table 56 provides the tomato correlated parameters (Vectors). The average for each of the measured parameter was calculated using the JMP software and values are summarized in Tables 57-59 below. Subsequent correlation analysis was conducted (Table 60). Results were integrated to the database.

TABLE 56

Tomato correlated parameters (vectors)

| Correlated parameter with | Correlation ID |
| --- | --- |
| Total Leaf Area [cm²] (Normal) | 1 |
| Leaflet Length [cm] (Normal) | 2 |
| Leaflet Width [cm] (Normal) | 3 |
| 100 weight green fruit [gr.] (Normal) | 4 |
| 100 weight red fruit [gr.] (Normal) | 5 |
| SLA [leaf area/plant biomass] [cm²/gr] (Normal) | 6 |
| Yield/total leaf area [gr./cm²] (Normal) | 7 |
| Yield/SLA [gr./(cm²/gr.)] (Normal) | 8 |
| 100 weight red fruit [gr.] (Low N) | 9 |
| NUE [yield/SPAD] [gr./number] (Normal) | 10 |
| NUpE [biomass/SPAD] [gr./number] (Normal) | 11 |
| HI [yield/yield + biomass] (Normal) | 12 |
| NUE2 [total biomass/SPAD] [gr./number] (Normal) | 13 |
| Fruit Yield/Plant [gr./number] (Low N) | 14 |
| FW/Plant [gr./number] (Low N) | 15 |
| Average red fruit weight [gr.] (Low N) | 16 |
| Fruit NUE [number] (Normal) | 17 |
| FW NUE [gr.] (Normal) | 18 |
| SPAD (Low N) | 19 |
| RWC (Low N) | 20 |
| SPAD 100% RWC (Low N) | 21 |
| SPAD (Low N/Normal) | 22 |

TABLE 56-continued

Tomato correlated parameters (vectors)

| Correlated parameter with | Correlation ID |
| --- | --- |
| SPAD 100% RWC (Low N/Normal) | 23 |
| RWC (Low N/Normal) | 24 |
| No flowers (Low N) | 25 |
| Weight clusters (flowers) (Low N) | 26 |
| Num. Flowers (Low N/Normal) | 27 |
| Cluster Weight (Low N/Normal) | 28 |
| NUE [yield/SPAD] (Low N) | 29 |
| NUpE [biomass/SPAD] (Low N) | 30 |
| HI [yield/yield + biomass] (Low N) | 31 |
| NUE2 [total biomass/SPAD] (Low N) | 32 |
| Total Leaf Area [cm²] (Low N) | 33 |
| Leaflet Length [cm] (Low N) | 34 |
| Leaflet Width [cm] (Low N) | 35 |
| 100 weight green fruit [gr.] (Low N) | 36 |
| SLA [leaf area/plant biomass] [cm²/gr] (Low N) | 37 |
| Yield/total leaf area [gr/cm²] (Low N) | 38 |
| Yield/SLA [gr./(cm²/gr.)] (Low N) | 39 |
| RWC Drought | 40 |
| RWC Drought/Normal | 41 |
| Number of flowers (Drought) | 42 |
| Weight flower clusters [gr.] (Drought) | 43 |
| Number of Flower Drought/Normal | 44 |
| Number of Flower Drought/Low N | 45 |
| Flower cluster weight Drought/Normal | 46 |
| Flower cluster weight Drought/Low N | 47 |
| Fruit Yield/Plant [gr./number] (Drought) | 48 |
| FW/Plant [gr./number] (Drought) | 49 |
| Average red fruit weight [gr.] (Drought) | 50 |
| Fruit Yield (Drought/Normal) | 51 |
| Fruit (Drought/Low N) | 52 |
| FW (Drought/Normal) | 53 |
| Red fruit weight (Drought/Normal) | 54 |
| Total Leaf Area [cm²]) (Drought) | 55 |
| Leaflet Length [cm]) (Drought) | 56 |
| Leaflet Width [cm] (Drought) | 57 |
| 100 weight green fruit [gr.] (Drought) | 58 |
| 100 weight red fruit [gr.] (Drought) | 59 |
| Fruit yield/Plant [gr.] (Normal) | 60 |
| FW/Plant [gr./number] (Normal) | 61 |
| Average red fruit weight [gr.] (Normal) | 62 |
| SPAD (Normal) | 63 |
| RWC (Normal) | 64 |
| SPAD 100% RWC (Normal) | 65 |
| Number of flowers (Normal) | 66 |
| Weight Flower clusters [gr.] (Normal) | 67 |

Table 56.
Provided are the tomato correlated parameters, "gr." = grams; "FW" = fresh weight; "NUE" = nitrogen use efficiency; "RWC" = relative water content; "NUpE" = nitrogen uptake efficiency; "SPAD" = chlorophyll levels; "HI" = harvest index (vegetative weight divided on yield); "SLA" = specific leaf area (leaf area divided by leaf dry weight), Treatment in the parenthesis.

Fruit Weight (grams)—At the end of the experiment [when 50% of the fruits were ripe (red)] all fruits from plots within blocks A-C were collected. The total fruits were counted and weighted. The average fruits weight was calculated by dividing the total fruit weight by the number of fruits.

Plant vegetative Weight (grams)—At the end of the experiment [when 50% of the fruit were ripe (red)] all plants from plots within blocks A-C were collected. Fresh weight was measured (grams).

Inflorescence Weight (grams)—At the end of the experiment [when 50% of the fruits were ripe (red)] two Inflorescence from plots within blocks A-C were collected. The Inflorescence weight (gr.) and number of flowers per inflorescence were counted.

SPAD—Chlorophyll content was determined using a Minolta SPAD 502 chlorophyll meter and measurement was performed at time of flowering. SPAD meter readings were done on young fully developed leaf. Three measurements per leaf were taken per plot.

Water use efficiency (WUE)—can be determined as the biomass produced per unit transpiration. To analyze WUE, leaf relative water content was measured in control and transgenic plants. Fresh weight (FW) was immediately recorded; then leaves were soaked for 8 hours in distilled water at room temperature in the dark, and the turgid weight (TW) was recorded. Total dry weight (DW) was recorded after drying the leaves at 60° C. to a constant weight. Relative water content (RWC) was calculated according to the following Formula I [(FW-DW/TW-DW)×100] as described above.

Plants that maintain high relative water content (RWC) compared to control lines were considered more tolerant to drought than those exhibiting reduced relative water content Experimental Results

TABLE 57

Measured parameters in Tomato accessions (lines 1-6)

| Treatment | Line-1 | Line-2 | Line-3 | Line-4 | Line-5 | Line-6 |
|---|---|---|---|---|---|---|
| 14 | 0.41 | 0.66 | 0.48 | 0.46 | 1.35 | 0.35 |
| 15 | 4.04 | 1.21 | 2.25 | 2.54 | 1.85 | 3.06 |
| 16 | 0.02 | 0.19 | 0.01 | 0.01 | 0.10 | 0.00 |
| 17 | 0.49 | 1.93 | 0.97 | 3.80 | 2.78 | 0.78 |
| 18 | 2.65 | 0.38 | 0.74 | 3.01 | 0.83 | 1.54 |
| 19 | 38.40 | 39.40 | 47.50 | 37.00 | 44.60 | 41.70 |
| 20 | 74.07 | 99.08 | 69.49 | 63.24 | 77.36 | 77.91 |
| 21 | 28.47 | 39.04 | 33.01 | 23.42 | 34.53 | 32.51 |
| 22 | 0.77 | 1.06 | 0.85 | 0.80 | 0.93 | 0.96 |
| 23 | 0.79 | 1.37 | 0.92 | 0.75 | 1.31 | 0.97 |
| 24 | 1.02 | 1.30 | 1.08 | 0.94 | 1.41 | 1.00 |
| 25 | 19.00 | 5.33 | 9.00 | 13.00 | 10.67 | 16.67 |
| 26 | 0.53 | 0.37 | 0.31 | 0.35 | 0.47 | 0.25 |
| 27 | 3.35 | 0.28 | 1.42 | 1.70 | 1.10 | 2.00 |
| 28 | 0.46 | 1.07 | 0.44 | 0.01 | 1.08 | 0.02 |
| 1 |  |  | 426.10 | 582.38 | 291.40 | 593.58 |
| 2 |  | 6.34 | 7.99 | 5.59 | 7.70 |  |
| 3 |  |  | 3.69 | 4.77 | 3.43 | 4.56 |
| 4 |  |  | 0.56 | 3.05 | 0.24 | 2.58 |
| 5 |  |  | 0.82 | 2.46 | 0.50 | 2.76 |
| 6 |  |  | 140.99 | 689.67 | 130.22 | 299.12 |
| 7 |  |  | 0.00 | 0.00 | 0.00 | 0.00 |
| 8 |  |  | 0.00 | 0.00 | 0.00 | 0.00 |
| 29 | 0.01 | 0.02 | 0.01 | 0.02 | 0.04 | 0.01 |
| 30 | 0.14 | 0.03 | 0.07 | 0.11 | 0.05 | 0.09 |
| 31 | 0.09 | 0.35 | 0.18 | 0.15 | 0.42 | 0.10 |
| 32 | 0.16 | 0.05 | 0.08 | 0.13 | 0.09 | 0.11 |
| 33 | 565.93 | 384.77 | 294.83 | 378.00 | 476.39 | 197.08 |
| 34 | 6.40 | 5.92 | 3.69 | 5.43 | 6.95 | 3.73 |
| 35 | 3.47 | 1.97 | 1.79 | 2.55 | 3.52 | 1.73 |
| 36 | 0.87 | 3.66 | 0.57 | 0.37 | 3.40 | 0.68 |
| 37 | 140.04 | 317.12 | 131.29 | 148.82 | 257.51 | 64.34 |
| 38 | 0.00 | 0.00 | 0.00 | 0.00 | 0.00 | 0.00 |
| 39 | 0.00 | 0.00 | 0.00 | 0.00 | 0.01 | 0.01 |
| 40 | 72.12 | 74.51 | 65.33 | 72.22 | 66.13 | 68.33 |
| 41 | 0.99 | 0.97 | 1.02 | 1.08 | 1.21 | 0.88 |
| 42 | 16.67 | 6.50 | 15.67 | 20.33 | 11.67 | 25.33 |
| 43 | 0.37 | 0.41 | 0.33 | 0.29 | 0.55 | 0.31 |
| 44 | 2.94 | 0.34 | 2.47 | 2.65 | 1.21 | 3.04 |
| 45 | 0.88 | 1.22 | 1.74 | 1.56 | 1.09 | 1.52 |
| 46 | 0.32 | 1.19 | 0.47 | 0.01 | 1.25 | 0.03 |
| 47 | 0.69 | 1.11 | 1.06 | 0.82 | 1.16 | 1.25 |
| 48 | 0.47 | 0.48 | 0.63 | 0.35 | 2.04 | 0.25 |
| 49 | 2.62 | 1.09 | 1.85 | 2.22 | 2.63 | 2.71 |
| 50 | 0.01 | 0.19 | 0.21 | 0.00 | 0.10 | 0.00 |
| 51 | 0.57 | 1.41 | 1.27 | 2.88 | 4.20 | 0.55 |
| 52 | 1.15 | 0.73 | 1.32 | 0.76 | 1.51 | 0.71 |
| 53 | 1.72 | 0.34 | 0.61 | 2.63 | 1.18 | 1.36 |
| 54 | 0.19 | 24.37 | 25.38 | 0.02 | 20.26 | 0.04 |
| 10 | 0.02 | 0.01 | 0.01 | 0.00 | 0.01 | 0.01 |
| 11 | 0.03 | 0.09 | 0.05 | 0.02 | 0.05 | 0.05 |
| 12 | 0.35 | 0.10 | 0.14 | 0.12 | 0.18 | 0.19 |
| 13 | 0.05 | 0.09 | 0.06 | 0.02 | 0.06 | 0.06 |
| 9 | 1.06 | 6.87 | 0.65 | 0.53 | 7.17 | 0.44 |

TABLE 57-continued

Measured parameters in Tomato accessions (lines 1-6)

| Treatment | Line-1 | Line-2 | Line-3 | Line-4 | Line-5 | Line-6 |
|---|---|---|---|---|---|---|
| 60 | 0.83 | 0.34 | 0.49 | 0.12 | 0.49 | 0.45 |
| 61 | 1.53 | 3.17 | 3.02 | 0.84 | 2.24 | 1.98 |
| 62 | 0.05 | 0.01 | 0.01 | 0.29 | 0.01 | 0.05 |
| 63 | 49.70 | 37.20 | 55.80 | 46.40 | 48.20 | 43.40 |
| 64 | 72.83 | 76.47 | 64.29 | 67.07 | 54.79 | 77.61 |
| 65 | 36.17 | 28.45 | 35.89 | 31.09 | 26.38 | 33.68 |
| 66 | 5.67 | 19.33 | 6.33 | 7.67 | 9.67 | 8.33 |
| 67 | 1.17 | 0.34 | 0.69 | 56.35 | 0.44 | 11.31 |

Table 57.

TABLE 58

Measured parameters in Tomato accessions (lines 7-12)

| Treatment | Line-7 | Line-8 | Line-9 | Line-10 | Line-11 | Line-12 |
|---|---|---|---|---|---|---|
| 14 | 0.01 | 0.51 | 0.44 | 0.47 | 1.59 | 0.39 |
| 15 | 3.13 | 2.54 | 1.84 | 1.52 | 1.91 | 1.86 |
| 16 | 0.01 | 0.01 | 0.01 | 0.01 | 0.02 | 0.01 |
| 17 | 0.02 | 1.16 | 2.07 | 1.51 | 2.41 | 2.06 |
| 18 | 3.70 | 1.22 | 0.58 | 0.55 | 1.06 | 0.49 |
| 19 | 34.40 | 50.00 | 44.70 | 53.70 | 35.70 | 58.80 |
| 20 | 80.49 | 67.40 | 67.16 | 66.07 | 69.57 | 69.30 |
| 21 | 27.66 | 33.68 | 30.04 | 35.50 | 24.81 | 40.77 |
| 22 | 0.80 | 0.94 | 0.76 | 1.05 | 0.89 | 1.24 |
| 23 | 1.11 | 0.95 | 0.79 | 0.92 | 0.94 | 1.36 |
| 24 | 1.38 | 1.01 | 1.04 | 0.88 | 1.05 | 1.10 |
| 25 | 6.00 | 16.00 | 15.00 | 6.00 | 17.00 | 13.00 |
| 26 | 0.29 | 0.47 | 0.40 | 0.30 | 0.82 | 0.40 |
| 27 | 1.20 | 1.92 | 1.50 | 0.86 | 1.89 | 1.63 |
| 28 | 0.37 | 0.81 | 0.55 | 0.36 | 0.95 | 0.80 |
| 1 | 947.59 | 233.35 | 340.73 | 339.11 | 190.14 | 421.79 |
| 2 | 7.85 | 6.22 | 6.16 | 5.65 | 4.39 | 4.44 |
| 3 | 4.44 | 3.15 | 3.37 | 3.13 | 2.40 | 2.02 |
| 4 | 6.32 | 5.75 | 0.38 | 0.30 | 1.95 | 2.53 |
| 5 | 5.32 | 5.24 | 0.61 | 0.66 | 2.70 | 0.70 |
| 6 | 1117.74 | 111.77 | 106.29 | 123.14 | 104.99 | 111.88 |
| 7 | 0.00 | 0.00 | 0.00 | 0.00 | 0.00 | 0.00 |
| 8 | 0.00 | 0.00 | 0.00 | 0.00 | 0.01 | 0.00 |
| 29 | 0.00 | 0.02 | 0.01 | 0.01 | 0.06 | 0.01 |
| 30 | 0.11 | 0.08 | 0.06 | 0.04 | 0.08 | 0.05 |
| 31 | 0.00 | 0.17 | 0.19 | 0.24 | 0.45 | 0.17 |
| 32 | 0.11 | 0.09 | 0.08 | 0.06 | 0.14 | 0.06 |
| 33 | 453.24 | 625.51 | 748.01 | 453.96 | 164.85 | 338.30 |
| 34 | 4.39 | 6.72 | 6.66 | 4.39 | 3.90 | 5.29 |
| 35 | 1.87 | 3.54 | 3.28 | 2.52 | 2.61 | 2.61 |
| 36 | 0.45 | 0.47 | 0.54 | 0.39 | 0.97 | 0.91 |
| 37 | 144.60 | 246.05 | 405.55 | 299.32 | 86.19 | 182.32 |
| 38 | 0.00 | 0.00 | 0.00 | 0.00 | 0.01 | 0.00 |
| 39 | 0.00 | 0.00 | 0.00 | 0.00 | 0.02 | 0.00 |
| 55 |  |  |  |  |  | 337.63 |
| 56 |  |  |  |  |  | 5.15 |
| 57 |  |  |  |  |  | 2.55 |
| 58 |  |  |  |  |  | 0.80 |
| 59 |  |  |  |  |  | 0.89 |
| 40 | 78.13 | 18.46 | 73.21 | 62.50 | 67.21 | 75.76 |
| 41 | 1.34 | 0.28 | 1.13 | 0.83 | 1.01 | 1.20 |
| 42 | 29.73 | 17.33 | 14.67 | 29.67 | 15.00 | 10.33 |
| 43 | 0.45 | 0.56 | 0.30 | 0.31 | 0.31 | 0.31 |
| 44 | 5.95 | 2.08 | 1.47 | 4.24 | 1.67 | 1.29 |
| 45 | 4.96 | 1.08 | 0.98 | 4.94 | 0.88 | 0.79 |
| 46 | 0.56 | 0.96 | 0.42 | 0.38 | 0.36 | 0.62 |
| 47 | 1.52 | 1.19 | 0.76 | 1.04 | 0.38 | 0.78 |
| 48 | 0.05 | 0.45 | 0.29 | 1.02 | 0.60 | 0.49 |
| 49 | 3.41 | 2.11 | 1.95 | 1.76 | 1.72 | 1.92 |
| 50 | 0.03 | 0.01 | 0.01 | 0.00 | 0.01 | 0.01 |
| 51 | 0.09 | 1.03 | 1.39 | 3.28 | 0.91 | 2.62 |
| 52 | 5.06 | 0.89 | 0.67 | 2.17 | 0.38 | 1.27 |
| 53 | 4.02 | 1.01 | 0.61 | 0.64 | 0.95 | 0.51 |

TABLE 58-continued

Measured parameters in Tomato accessions (lines 7-12)

| Treatment | Line-7 | Line-8 | Line-9 | Line-10 | Line-11 | Line-12 |
|---|---|---|---|---|---|---|
| 54 | 0.15 | 0.02 | 0.86 | 0.74 | 0.09 | 1.72 |
| 10 | 0.01 | 0.01 | 0.00 | 0.01 | 0.02 | 0.00 |
| 11 | 0.02 | 0.04 | 0.05 | 0.05 | 0.05 | 0.08 |
| 12 | 0.38 | 0.17 | 0.06 | 0.10 | 0.27 | 0.05 |
| 13 | 0.03 | 0.05 | 0.06 | 0.06 | 0.06 | 0.08 |
| 9 |  | 0.55 | 0.75 | 0.58 | 1.27 | 1.34 |
| 60 | 0.53 | 0.44 | 0.21 | 0.31 | 0.66 | 0.19 |
| 61 | 0.85 | 2.09 | 3.21 | 2.75 | 1.81 | 3.77 |
| 62 | 0.23 | 0.29 | 0.01 | 0.01 | 0.06 | 0.01 |
| 63 | 42.90 | 53.30 | 58.50 | 51.10 | 40.00 | 47.60 |
| 64 | 58.18 | 66.51 | 64.71 | 75.25 | 66.23 | 63.21 |
| 65 | 24.98 | 35.47 | 37.87 | 38.43 | 26.49 | 30.07 |
| 66 | 5.00 | 8.33 | 10.00 | 7.00 | 9.00 | 8.00 |
| 67 | 0.79 | 0.58 | 0.73 | 0.83 | 0.86 | 0.50 |

Table 58.

TABLE 59

Measured parameters in Tomato accessions (lines 13-18)

| Treatment | Line-13 | Line-14 | Line-15 | Line-16 | Line-17 | Line-18 |
|---|---|---|---|---|---|---|
| 14 | 0.32 | 0.45 | 0.14 | 0.40 | 1.44 | 0.50 |
| 15 | 2.47 | 2.62 | 1.08 | 1.17 | 0.92 | 1.09 |
| 16 | 0.01 | 0.05 | 0.36 | 0.04 | 0.63 |  |
| 17 | 0.38 | 1.64 | 0.41 | 1.21 | 4.59 | 1.70 |
| 18 | 1.31 | 1.36 | 0.51 | 0.71 | 0.31 | 0.47 |
| 19 | 47.50 | 45.20 | 39.00 | 45.00 | 65.30 | 51.90 |
| 20 | 100.00 | 57.66 | 90.79 | 68.00 | 59.65 | 72.17 |
| 21 | 47.47 | 26.06 | 35.38 | 30.60 | 38.97 | 37.46 |
| 22 | 0.82 | 0.94 | 0.89 | 0.83 | 1.57 | 0.88 |
| 23 | 1.44 | 1.50 | 1.05 | 0.56 | 1.48 | 0.84 |
| 24 | 1.76 | 1.60 | 1.17 | 0.68 | 0.94 | 0.96 |
| 25 | 8.67 | 9.33 | 12.67 | 6.67 | 9.33 | 8.00 |
| 26 | 0.35 | 0.43 | 0.35 | 0.45 | 0.28 | 0.47 |
| 27 | 1.63 | 1.17 | 1.65 | 0.74 | 0.88 | 0.89 |
| 28 | 0.34 | 0.61 | 0.94 | 0.68 | 0.40 | 1.44 |
| 1 | 581.33 | 807.51 | 784.06 | 351.80 | 255.78 | 1078.10 |
| 2 | 6.77 | 7.42 | 6.71 | 5.87 | 4.16 | 10.29 |
| 3 | 3.80 | 3.74 | 2.98 | 3.22 | 2.09 | 5.91 |
| 4 | 1.42 | 2.03 | 1.39 | 2.27 | 0.45 | 0.42 |
| 5 | 2.64 | 4.67 | 2.17 | 0.49 | 0.34 | 0.75 |
| 6 | 307.95 | 419.37 | 365.81 | 212.93 | 84.94 | 469.87 |
| 7 | 0.00 | 0.00 | 0.00 | 0.00 | 0.00 | 0.00 |
| 8 | 0.00 | 0.00 | 0.00 | 0.00 | 0.00 | 0.00 |

TABLE 59-continued

Measured parameters in Tomato accessions (lines 13-18)

| Treatment | Line-13 | Line-14 | Line-15 | Line-16 | Line-17 | Line-18 |
|---|---|---|---|---|---|---|
| 29 | 0.01 | 0.02 | 0.00 | 0.01 | 0.04 | 0.01 |
| 30 | 0.05 | 0.10 | 0.03 | 0.04 | 0.02 | 0.03 |
| 31 | 0.12 | 0.15 | 0.12 | 0.25 | 0.61 | 0.31 |
| 32 | 0.06 | 0.12 | 0.03 | 0.05 | 0.06 | 0.04 |
| 33 | 396.00 | 236.15 | 174.58 | 441.78 | 489.18 | 707.80 |
| 34 | 6.32 | 5.11 | 4.72 | 6.83 | 7.10 | 8.21 |
| 35 | 3.58 | 2.56 | 2.48 | 3.43 | 3.30 | 3.69 |
| 36 | 0.36 | 0.35 | 0.57 | 4.38 | 2.02 | 8.13 |
| 37 | 160.18 | 90.10 | 160.99 | 379.03 | 531.08 | 650.68 |
| 38 | 0.00 | 0.00 | 0.00 | 0.00 | 0.00 | 0.00 |
| 39 | 0.00 | 0.00 | 0.00 | 0.00 | 0.00 | 0.00 |
| 55 | 130.78 | 557.93 | 176.67 | 791.86 | 517.05 | 832.27 |
| 56 | 3.38 | 7.14 | 5.48 | 8.62 | 6.35 | 6.77 |
| 57 | 2.04 | 4.17 | 3.09 | 4.69 | 3.87 | 2.91 |
| 58 | 0.28 | 0.38 | 0.63 | 2.86 | 1.16 | 4.40 |
| 59 | 0.35 | 0.63 | 2.27 | 7.40 | 2.94 | 11.60 |
| 40 | 62.82 | 70.69 | 55.75 | 75.22 | 63.68 | 62.31 |
| 41 | 1.11 | 1.97 | 0.72 | 0.75 | 1.01 | 0.83 |
| 42 | 18.33 | 12.00 | 20.33 | 12.67 | 12.67 | 11.33 |
| 43 | 8.36 | 0.29 | 0.34 | 0.44 | 0.27 | 0.43 |
| 44 | 3.44 | 1.50 | 2.65 | 1.41 | 1.19 | 1.26 |
| 45 | 2.12 | 1.29 | 1.61 | 1.90 | 1.36 | 1.42 |
| 46 | 8.20 | 0.41 | 0.91 | 0.67 | 0.38 | 1.31 |
| 47 | 24.12 | 0.67 | 0.97 | 0.99 | 0.95 | 0.91 |
| 48 | 0.27 | 0.68 | 0.14 | 0.53 | 0.55 | 0.41 |
| 49 | 2.21 | 3.73 | 0.75 | 1.76 | 0.63 | 1.11 |
| 50 | 0.00 | 0.01 | 0.30 | 0.14 | 0.04 | 0.09 |
| 51 | 0.32 | 2.48 | 0.41 | 1.62 | 1.76 | 1.42 |
| 52 | 0.84 | 1.51 | 0.98 | 1.34 | 0.38 | 0.84 |
| 53 | 1.17 | 1.94 | 0.35 | 1.06 | 0.21 | 0.48 |
| 54 | 0.17 | 0.02 | 10.50 | 27.89 | 11.79 | 9.98 |
| 10 | 0.01 | 0.01 | 0.01 | 0.01 | 0.01 | 0.00 |
| 11 | 0.03 | 0.04 | 0.05 | 0.03 | 0.07 | 0.04 |
| 12 | 0.31 | 0.12 | 0.14 | 0.17 | 0.09 | 0.11 |
| 13 | 0.05 | 0.05 | 0.06 | 0.04 | 0.08 | 0.04 |
| 9 | 0.52 | 0.57 | 0.94 | 6.17 | 3.67 | 11.33 |
| 60 | 0.85 | 0.27 | 0.35 | 0.33 | 0.31 | 0.29 |
| 61 | 1.89 | 1.93 | 2.14 | 1.65 | 3.01 | 2.29 |
| 62 | 0.03 | 0.26 | 0.03 | 0.00 | 0.00 | 0.01 |
| 63 | 57.90 | 48.30 | 43.60 | 54.50 | 41.60 | 59.10 |
| 64 | 56.77 | 35.96 | 77.62 | 100.00 | 63.16 | 75.13 |
| 65 | 32.89 | 17.35 | 33.82 | 54.47 | 26.25 | 44.43 |
| 66 | 5.33 | 8.00 | 7.67 | 9.00 | 10.67 | 9.00 |
| 67 | 1.02 | 0.70 | 0.38 | 0.66 | 0.70 | 0.33 |

Table 59:
Provided are the values of each of the parameters (as described above) measured in tomato accessions (Seed ID) under all growth conditions. Growth conditions are specified in the experimental procedure section.

TABLE 60

Correlation between the expression level of selected genes of some embodiments of the invention in various tissues and the phenotypic performance under normal and stress conditions across tomato ecotypes

| Gene Name | R | P value | Exp. set | Corr. Set ID | Gene Name | R | P value | Exp. set | Corr. Set ID |
|---|---|---|---|---|---|---|---|---|---|
| LYM990 | 0.84 | 4.34E−03 | 3 | 12 | LYM990 | 0.86 | 3.17E−03 | 3 | 10 |
| LYM990 | 0.72 | 4.26E−02 | 2 | 7 | LYM990 | 0.82 | 3.44E−03 | 2 | 67 |
| LYM990 | 0.72 | 1.80E−02 | 6 | 47 | LYM990 | 0.78 | 7.42E−03 | 6 | 46 |
| LYM990 | 0.73 | 1.71E−02 | 6 | 43 | LYM990 | 0.75 | 1.27E−02 | 5 | 21 |

Table 60
Provided are the correlations (R) between the expression levels yield improving genes and their homologs in various tissues [Expression (Exp) sets] and the phenotypic performance [yield, biomass, growth rate and/or vigor components (Correlation vector (Corr.))] under normal conditions across tomato ecotypes.
P = p value.

Example 13

Production of Maize Transcriptom and High Throughput Correlation Analysis with Yield, NUE, and ABST Related Parameters Measured 1N Semi-Hydroponics Conditions Using 60K Maize Oligonucleotide Micro-Arrays Maize vigor related parameters under low nitrogen, 100 mM NaCl, low temperature (10±2° C.) and normal growth conditions—Twelve Maize hybrids were grown in 5 repetitive plots, each containing 7 plants, at a net house under semi-hydroponics conditions. Briefly, the growing protocol was as follows: Maize seeds to were sown in trays filled with a mix of vermiculite and peat in a 1:1 ratio. Following germination, the trays were transferred to the high salinity solution (100 mM NaCl in addition to the Full Hoagland solution), low temperature (10±2° C. in the presence of Full Hoagland solution), low nitrogen solution (the amount of total nitrogen was reduced in 90% from the full Hoagland solution (i.e., to a final concentration of 10% from full Hoagland solution, final amount of 1.6 mM N) or at Normal growth solution (Full Hoagland containing 16 mM N solution, at 28±2° C.). Plants were grown at 28±2° C.

Full Hoagland solution consists of: $KNO_3$—0.808 grams/liter, $MgSO_4$—0.12 grams/liter, $KH_2PO_4$—0.136 grams/liter and 0.01% (volume/volume) of 'Super coratin' micro elements (Iron-EDDHA [ethylenediamine-N,N'-bis(2-hydroxyphenylacetic acid)]—40.5 grams/liter; Mn—20.2 grams/liter; Zn 10.1 grams/liter; Co 1.5 grams/liter; and Mo 1.1 grams/liter), solution's pH should be 6.5-6.8].

Analyzed *Sorghum* tissues—Ten selected *Sorghum* hybrids were sampled per each treatment. Two tissues [leaves and root tip] growing at 100 mM NaCl, low temperature (10±2° C.), low Nitrogen (1.6 mM N) or under Normal conditions were sampled at the vegetative stage (V4-5) and RNA was extracted as described above. Each micro-array expression information tissue type has received a Set ID as summarized in Table 61-64 below.

TABLE 61

Maize transcriptome expression sets under semi hydroponics conditions

| Expression set | Set Id |
|---|---|
| maize/leaf, under Normal conditions | 1 |
| maize/root tip, under Normal conditions | 2 |

Table 61:
Provided are the Maize transcriptome expression sets at normal conditions.

TABLE 62

Maize transcriptome expression sets under semi hydroponics conditions

| Expression set | Set Id |
|---|---|
| maize/leaf, under Cold conditions | 1 |
| maize/root tip, under Cold conditions | 2 |

Table 62:
Provided are the Maize transcriptome expression sets at cold conditions.

TABLE 63

Maize transcriptome expression sets under semi hydroponics conditions

| Expression set | Set Id |
|---|---|
| maize/leaf, under low Nitrogen (1.6 mM N) | 1 |
| maize/root tip, under low Nitrogen (1.6 mM N) | 2 |

Table 63:
Provided are the Maize transcriptome expression sets at low nitrogen conditions 1.6 Mm Nitrogen.

TABLE 64

Maize transcriptome expression sets under semi hydroponics conditions

| Expression set | Set Id |
|---|---|
| maize/leaf, under salinity stress (NaCl 100 mM) | 1 |
| maize/root tip, under salinity stress (NaCl 100 mM) | 2 |

Table 64:
Provided are the Maize transcriptome expression sets at 100 mM NaCl.

Experimental Results 10 different Maize hybrids were grown and characterized at the vegetative stage (V4-5) for the following parameters: "Leaves DW"=leaves dry weight per plant (average of five plants); "Plant Height growth"=was calculated as regression coefficient of plant height [cm] along time course (average of five plants); "Root DW"—root dry weight per plant, all vegetative tissue above ground (average of four plants); "Shoot DW"—shoot dry weight per plant, all vegetative tissue above ground (average of four plants) after drying at 70° C. in oven for 48 hours; "Shoot FW"—shoot fresh weight per plant, all vegetative tissue above ground (average of four plants); "SPAD"—Chlorophyll content was determined using a Minolta SPAD 502 chlorophyll meter and measurement was performed 30 days post sowing. SPAD meter readings were done on young fully developed leaf. Three measurements per leaf were taken per plot. The average for each of the measured parameter was calculated and values are summarized in Tables 66-73 below. Subsequent correlation analysis was performed (Table 74-77). Results were then integrated to the database.

TABLE 65

Maize correlated parameters (vectors)

| Correlated parameter with | Correlation ID |
|---|---|
| Leaves DW | 1 |
| Plant height growth | 2 |
| Root DW | 3 |
| Shoot DW | 4 |
| Shoot FW | 5 |
| SPAD | 6 |
| Root length | 7 |

Table 65:
Provided are the Maize correlated parameters.

TABLE 66

Maize accessions, measured parameters under low nitrogen growth conditions

| Correlation ID | Ecotype | | | | | | |
| --- | --- | --- | --- | --- | --- | --- | --- |
| | Line-1 | Line-2 | Line-3 | Line-4 | Line-5 | Line-6 | Line-7 |
| 1 | 0.57 | 0.45 | 0.46 | 0.48 | 0.36 | 0.51 | 0.53 |
| 2 | 0.75 | 0.81 | 0.88 | 0.69 | 0.83 | 0.84 | 0.78 |
| 3 | 0.38 | 0.35 | 0.25 | 0.36 | 0.31 | 0.30 | 0.29 |
| 4 | 44.50 | 45.63 | 44.25 | 43.59 | 40.67 | 42.03 | 42.65 |
| 5 | 2.56 | 1.96 | 2.01 | 1.94 | 1.94 | 2.52 | 2.03 |
| 6 | 23.27 | 20.58 | 19.26 | 20.02 | 17.98 | 22.06 | 21.28 |
| 7 | 21.43 | 21.24 | 22.23 | 24.56 | 22.75 | 26.47 | 22.08 |

Table 66:
Provided are the values of each of the parameters (as described above) measured in Maize accessions (Seed ID) under low nitrogen conditions. Growth conditions are specified in the experimental procedure section.

TABLE 67

Maize accessions, measured parameters under low nitrogen growth conditions

| Ecotype | Correlation ID | | | | |
| --- | --- | --- | --- | --- | --- |
| | Line-8 | Line-9 | Line-10 | Line-11 | Line-12 |
| 1 | 0.58 | 0.55 | 0.51 | 0.56 | 0.39 |
| 2 | 0.92 | 0.89 | 0.85 | 0.80 | 0.64 |
| 3 | 0.31 | 0.29 | 0.32 | 0.43 | 0.17 |
| 4 | 45.06 | 45.31 | 42.17 | 41.03 | 37.65 |
| 5 | 2.37 | 2.09 | 2.11 | 2.62 | 1.53 |
| 6 | 22.13 | 20.29 | 19.94 | 22.50 | 15.93 |
| 7 | 25.09 | 23.73 | 25.68 | 25.02 | 19.51 |

Table 67:
Provided are the values of each of the parameters (as described above) measured in Maize accessions (Seed ID) under low nitrogen conditions. Growth conditions are specified in the experimental procedure section.

TABLE 68

Maize accessions, measured parameters under 100 mM NaCl growth conditions

| Correlation ID | Ecotype | | | | | | |
| --- | --- | --- | --- | --- | --- | --- | --- |
| | Line-1 | Line-2 | Line-3 | Line-4 | Line-5 | Line-6 | Line-7 |
| 1 | 0.41 | 0.50 | 0.43 | 0.48 | 0.43 | 0.56 | 0.33 |
| 2 | 0.46 | 0.40 | 0.45 | 0.32 | 0.32 | 0.31 | 0.29 |
| 3 | 0.05 | 0.05 | 0.03 | 0.07 | 0.05 | 0.03 | 0.10 |
| 4 | 2.43 | 2.19 | 2.25 | 2.26 | 1.54 | 1.94 | 1.78 |
| 5 | 19.58 | 20.78 | 18.45 | 19.35 | 15.65 | 16.09 | 12.46 |
| 6 | 36.55 | 39.92 | 37.82 | 41.33 | 40.82 | 44.40 | 37.92 |
| 7 | 10.88 | 11.28 | 11.82 | 10.08 | 8.46 | 10.56 | 10.14 |

Table 68:
Provided are the values of each of the parameters (as described above) measured in Maize accessions (Seed ID) under 100 mM NaCl growth conditions. Growth conditions are specified in the experimental procedure section.

TABLE 69

Maize accessions, measured parameters under 100 mM NaCl growth conditions

| Ecotype | Correlation ID | | | | |
| --- | --- | --- | --- | --- | --- |
| | Line-8 | Line-9 | Line-10 | Line-11 | Line-12 |
| 1 | 0.51 | 0.47 | 0.98 | 0.48 | 0.15 |
| 2 | 0.36 | 0.37 | 0.35 | 0.31 | 0.27 |
| 3 | 0.06 | 0.02 | 0.04 | 0.05 | 0.01 |
| 4 | 1.90 | 1.89 | 2.20 | 1.86 | 0.97 |
| 5 | 16.92 | 16.75 | 17.64 | 15.90 | 9.40 |
| 6 | 43.22 | 39.83 | 38.20 | 38.14 | 37.84 |
| 7 | 11.83 | 10.55 | 11.18 | 10.09 | 8.90 |

Table 69:
Provided are the values of each of the parameters (as described above) measured in Maize accessions (Seed ID) under 100 mM NaCl growth conditions. Growth conditions are specified in the experimental procedure section.

TABLE 70

Maize accessions, measured parameters under cold growth conditions

| Correlation ID | Ecotype | | | | | | |
| --- | --- | --- | --- | --- | --- | --- | --- |
| | Line-1 | Line-2 | Line-3 | Line-4 | Line-5 | Line-6 | Line-7 |
| 1 | 2.15 | 1.93 | 2.12 | 1.80 | 2.32 | 2.15 | 2.49 |
| 2 | 0.05 | 0.07 | 0.10 | 0.08 | 0.07 | 0.07 | 0.14 |
| 3 | 5.74 | 4.86 | 3.98 | 4.22 | 4.63 | 4.93 | 4.82 |
| 4 | 73.79 | 55.46 | 53.26 | 54.92 | 58.95 | 62.36 | 63.65 |
| 5 | 28.88 | 29.11 | 27.08 | 32.38 | 32.68 | 32.89 | 31.58 |
| 6 | 1.19 | 1.17 | 1.02 | 1.18 | 1.04 | 1.23 | 1.13 |

Table 70:
Provided are the values of each of the parameters (as described above) measured in Maize accessions (Seed ID) under cold growth conditions. Growth conditions are specified in the experimental procedure section.

TABLE 71

Maize accessions, measured parameters under cold growth conditions

| Correlation ID | Ecotype | | | | |
| --- | --- | --- | --- | --- | --- |
| | Line-8 | Line-9 | Line-10 | Line-11 | Line-12 |
| 1 | 2.01 | 1.95 | 2.03 | 1.85 | 1.21 |
| 2 | 0.07 | 0.07 | 0.02 | 0.05 | 0.06 |
| 3 | 4.03 | 3.57 | 3.99 | 4.64 | 1.89 |
| 4 | 54.90 | 48.25 | 52.83 | 55.08 | 29.61 |
| 5 | 33.01 | 28.65 | 31.43 | 30.64 | 30.71 |
| 6 | 0.98 | 0.88 | 1.28 | 1.10 | 0.60 |

Table 71:
Provided are the values of each of the parameters (as described above) measured in Maize accessions (Seed ID) under cold growth conditions. Growth conditions are specified in the experimental procedure section.

TABLE 72

Maize accessions, measured parameters under regular growth conditions

| Correlation ID | Ecotype | | | | | | |
| --- | --- | --- | --- | --- | --- | --- | --- |
| | Line-1 | Line-2 | Line-3 | Line-4 | Line-5 | Line-6 | Line-7 |
| 1 | 1.16 | 1.10 | 0.92 | 1.01 | 0.93 | 0.91 | 1.11 |
| 2 | 1.99 | 1.92 | 1.93 | 1.93 | 2.15 | 1.95 | 2.23 |
| 3 | 0.14 | 0.11 | 0.23 | 0.16 | 0.08 | 0.05 | 0.17 |
| 4 | 5.27 | 4.67 | 3.88 | 5.08 | 4.10 | 4.46 | 4.68 |
| 5 | 79.00 | 62.85 | 59.73 | 63.92 | 60.06 | 64.67 | 68.10 |
| 6 | 34.50 | 35.77 | 34.70 | 34.42 | 35.26 | 37.52 | 36.50 |
| 7 | 20.15 | 15.89 | 18.59 | 18.72 | 16.38 | 14.93 | 17.48 |

Table 72:
Provided are the values of each of the parameters (as described above) measured in Maize accessions (Seed ID) under regular growth conditions. Growth conditions are specified in the experimental procedure section.

TABLE 73

Maize accessions, measured parameters under regular growth conditions

| Correlation ID | Line-8 | Line-9 | Line-10 | Line-11 | Line-12 |
|---|---|---|---|---|---|
| 1 | 1.01 | 1.01 | 1.02 | 1.23 | 0.44 |
| 2 | 1.94 | 1.97 | 2.05 | 1.74 | 1.26 |
| 3 | 0.10 | 0.07 | 0.10 | 0.14 | 0.03 |
| 4 | 4.59 | 4.08 | 4.61 | 5.42 | 2.02 |
| 5 | 65.81 | 58.31 | 61.87 | 70.04 | 35.96 |
| 6 | 36.07 | 33.74 | 34.34 | 35.74 | 29.04 |
| 7 | 15.74 | 15.71 | 17.58 | 16.13 | 17.43 |

Table 73:
Provided are the values of each of the parameters (as described above) measured in Maize accessions (Seed ID) under regular growth conditions. Growth conditions are specified in the experimental procedure section.

TABLE 74

Correlation between the expression level of selected genes of some embodiments of the invention in various tissues and the phenotypic performance under normal conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM798 | 0.75 | 1.91E-02 | 2 | 6 | LYM799 | 0.79 | 6.23E-03 | 1 | 5 |
| LYM799 | 0.72 | 1.95E-02 | 1 | 4 | LYM809 | 0.72 | 1.88E-02 | 1 | 1 |
| LYM809 | 0.76 | 1.01E-02 | 1 | 4 | LYM811 | 0.71 | 3.26E-02 | 2 | 5 |
| LYM811 | 0.78 | 1.36E-02 | 2 | 2 | LYM811 | 0.97 | 1.26E-05 | 2 | 6 |
| LYM811 | 0.72 | 3.03E-02 | 2 | 4 | LYM811 | 0.81 | 4.87E-03 | 1 | 2 |
| LYM811 | 0.70 | 2.42E-02 | 1 | 4 | LYM814 | 0.76 | 1.03E-02 | 1 | 7 |
| LYM817 | 0.83 | 2.87E-03 | 1 | 7 | LYM819 | 0.81 | 8.04E-03 | 2 | 1 |
| LYM819 | 0.76 | 1.78E-02 | 2 | 4 | LYM822 | 0.87 | 9.24E-04 | 1 | 2 |
| LYM826 | 0.73 | 2.64E-02 | 2 | 7 | LYM827 | 0.74 | 2.20E-02 | 2 | 6 |
| LYM827 | 0.74 | 1.49E-02 | 1 | 6 | LYM827 | 0.75 | 1.18E-02 | 1 | 1 |
| LYM827 | 0.79 | 6.45E-03 | 1 | 3 | LYM831 | 0.71 | 3.34E-02 | 2 | 2 |
| LYM832 | 0.81 | 8.30E-03 | 2 | 5 | LYM832 | 0.85 | 3.96E-03 | 2 | 1 |
| LYM832 | 0.78 | 1.28E-02 | 2 | 4 | LYM832 | 0.80 | 5.48E-03 | 1 | 7 |
| LYM833 | 0.76 | 1.13E-02 | 1 | 7 | LYM836 | 0.85 | 1.79E-03 | 1 | 5 |
| LYM836 | 0.73 | 1.62E-02 | 1 | 4 | LYM841 | 0.75 | 1.17E-02 | 1 | 5 |
| LYM841 | 0.77 | 9.30E-03 | 1 | 4 | LYM842 | 0.74 | 1.54E-02 | 1 | 6 |
| LYM846 | 0.71 | 3.16E-02 | 2 | 1 | LYM846 | 0.81 | 7.75E-03 | 2 | 3 |
| LYM846 | 0.78 | 1.39E-02 | 2 | 4 | LYM846 | 0.72 | 1.89E-02 | 1 | 4 |
| LYM847 | 0.77 | 1.54E-02 | 2 | 1 | LYM847 | 0.70 | 3.40E-02 | 2 | 4 |
| LYM849 | 0.75 | 1.92E-02 | 2 | 2 | LYM849 | 0.73 | 2.63E-02 | 2 | 6 |
| LYM859 | 0.70 | 2.39E-02 | 1 | 6 | LYM860 | 0.77 | 9.23E-03 | 1 | 5 |
| LYM860 | 0.75 | 1.33E-02 | 1 | 1 | LYM860 | 0.81 | 4.14E-03 | 1 | 3 |
| LYM860 | 0.74 | 1.50E-02 | 1 | 4 | LYM861 | 0.77 | 9.23E-03 | 1 | 5 |
| LYM861 | 0.75 | 1.33E-02 | 1 | 1 | LYM861 | 0.81 | 4.14E-03 | 1 | 3 |
| LYM861 | 0.74 | 1.50E-02 | 1 | 4 | LYM862 | 0.77 | 9.23E-03 | 1 | 5 |
| LYM862 | 0.75 | 1.33E-02 | 1 | 1 | LYM862 | 0.81 | 4.14E-03 | 1 | 3 |
| LYM817_H1 | 0.83 | 2.87E-03 | 1 | 7 | LYM901_H1 | 0.74 | 1.43E-02 | 1 | 6 |
| LYM862 | 0.74 | 1.50E-02 | 1 | 4 | | | | | |

Table 74.
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under normal conditions across Maize accessions.
P = p value.

TABLE 75

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM800 | 0.89 | 1.32E-03 | 2 | 6 | LYM800 | 0.75 | 1.87E-02 | 2 | 2 |
| LYM800 | 0.85 | 3.68E-03 | 2 | 1 | LYM800 | 0.77 | 1.43E-02 | 2 | 5 |
| LYM800 | 0.81 | 8.62E-03 | 2 | 4 | LYM800 | 0.71 | 2.27E-02 | 1 | 7 |
| LYM800 | 0.72 | 1.91E-02 | 1 | 4 | LYM801 | 0.73 | 1.69E-02 | 1 | 3 |
| LYM802 | 0.72 | 2.89E-02 | 2 | 7 | LYM802 | 0.78 | 1.41E-02 | 2 | 3 |
| LYM802 | 0.79 | 6.08E-03 | 1 | 2 | LYM803 | 0.84 | 4.43E-03 | 2 | 7 |
| LYM803 | 0.72 | 1.93E-02 | 1 | 7 | LYM805 | 0.82 | 7.27E-03 | 2 | 7 |
| LYM809 | 0.71 | 3.37E-02 | 2 | 3 | LYM811 | 0.70 | 3.46E-02 | 2 | 6 |
| LYM811 | 0.88 | 1.96E-03 | 2 | 4 | LYM811 | 0.73 | 2.41E-02 | 2 | 7 |
| LYM811 | 0.75 | 2.00E-02 | 2 | 5 | LYM811 | 0.78 | 7.84E-03 | 1 | 2 |
| LYM817 | 0.80 | 1.03E-02 | 2 | 7 | LYM817 | 0.73 | 1.71E-02 | 1 | 2 |
| LYM819 | 0.72 | 2.75E-02 | 2 | 6 | LYM819 | 0.75 | 1.90E-02 | 2 | 2 |
| LYM819 | 0.84 | 4.80E-03 | 2 | 4 | LYM819 | 0.75 | 1.33E-02 | 1 | 4 |

TABLE 75-continued

Correlation between the expression level of selected genes of some embodiments of the invention in various tissues and the phenotypic performance under low nitrogen conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM820 | 0.73 | 2.47E−02 | 2 | 4 | LYM822 | 0.77 | 1.58E−02 | 2 | 3 |
| LYM827 | 0.94 | 1.69E−04 | 2 | 7 | LYM827 | 0.72 | 2.97E−02 | 2 | 3 |
| LYM827 | 0.85 | 1.79E−03 | 1 | 2 | LYM827 | 0.81 | 4.79E−03 | 1 | 7 |
| LYM827 | 0.73 | 1.71E−02 | 1 | 3 | LYM832 | 0.78 | 1.26E−02 | 2 | 6 |
| LYM832 | 0.76 | 1.74E−02 | 2 | 1 | LYM832 | 0.79 | 1.13E−02 | 2 | 3 |
| LYM832 | 0.74 | 2.17E−02 | 2 | 5 | LYM836 | 0.71 | 2.26E−02 | 1 | 3 |
| LYM838 | 0.72 | 2.74E−02 | 2 | 2 | LYM838 | 0.79 | 1.13E−02 | 2 | 7 |
| LYM838 | 0.73 | 1.67E−02 | 1 | 2 | LYM838 | 0.80 | 5.64E−03 | 1 | 7 |
| LYM841 | 0.73 | 2.55E−02 | 2 | 7 | LYM842 | 0.87 | 2.05E−03 | 2 | 2 |
| LYM842 | 0.75 | 1.22E−02 | 1 | 2 | LYM843 | 0.72 | 2.99E−02 | 2 | 2 |
| LYM843 | 0.79 | 1.19E−02 | 2 | 7 | LYM845 | 0.83 | 5.57E−03 | 2 | 2 |
| LYM845 | 0.72 | 2.98E−02 | 2 | 7 | LYM846 | 0.87 | 2.23E−03 | 2 | 3 |
| LYM847 | 0.79 | 1.21E−02 | 2 | 3 | LYM848 | 0.77 | 1.45E−02 | 2 | 3 |
| LYM851 | 0.77 | 1.50E−02 | 2 | 7 | LYM859 | 0.71 | 3.26E−02 | 2 | 7 |
| LYM859 | 0.80 | 5.98E−03 | 1 | 6 | LYM859 | 0.71 | 2.03E−02 | 1 | 1 |
| LYM859 | 0.75 | 1.26E−02 | 1 | 5 | LYM860 | 0.78 | 7.38E−03 | 1 | 7 |
| LYM860 | 0.74 | 1.47E−02 | 1 | 5 | LYM861 | 0.78 | 7.38E−03 | 1 | 7 |
| LYM861 | 0.74 | 1.47E−02 | 1 | 5 | LYM862 | 0.78 | 7.38E−03 | 1 | 7 |
| LYM817_H1 | 0.72 | 1.71E−02 | 1 | 2 | LYM901_H1 | 0.81 | 8.43E−03 | 2 | 3 |
| LYM862 | 0.74 | 1.47E−02 | 1 | 5 | | | | | |

Table 75.
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under low nitrogen conditions across Maize accessions.
P = p value.

TABLE 76

Correlation between the expression level of selected genes of some embodiments of the invention in various tissues and the phenotypic performance under cold conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM798 | 0.75 | 3.07E−02 | 1 | 1 | LYM800 | 0.75 | 3.33E−02 | 1 | 4 |
| LYM800 | 0.73 | 2.69E−02 | 2 | 1 | LYM809 | 0.76 | 1.80E−02 | 2 | 6 |
| LYM809 | 0.72 | 2.73E−02 | 2 | 3 | LYM811 | 0.75 | 3.32E−02 | 1 | 4 |
| LYM811 | 0.75 | 3.36E−02 | 1 | 5 | LYM811 | 0.80 | 1.82E−02 | 1 | 3 |
| LYM811 | 0.77 | 1.52E−02 | 2 | 6 | LYM811 | 0.76 | 1.83E−02 | 2 | 5 |
| LYM813 | 0.78 | 2.29E−02 | 1 | 2 | LYM819 | 0.77 | 2.45E−02 | 1 | 4 |
| LYM819 | 0.72 | 4.25E−02 | 1 | 6 | LYM819 | 0.84 | 9.75E−03 | 1 | 3 |
| LYM819 | 0.79 | 1.10E−02 | 2 | 4 | LYM819 | 0.73 | 2.44E−02 | 2 | 6 |
| LYM819 | 0.79 | 1.10E−02 | 2 | 3 | LYM822 | 0.80 | 9.46E−03 | 2 | 1 |
| LYM827 | 0.70 | 5.12E−02 | 1 | 3 | LYM829 | 0.86 | 6.62E−03 | 1 | 1 |
| LYM832 | 0.71 | 3.13E−02 | 2 | 3 | LYM833 | 0.93 | 2.66E−04 | 2 | 5 |
| LYM837 | 0.71 | 4.98E−02 | 1 | 6 | LYM838 | 0.74 | 3.48E−02 | 1 | 5 |
| LYM839 | 0.74 | 3.45E−02 | 1 | 4 | LYM839 | 0.85 | 8.24E−03 | 1 | 1 |
| LYM839 | 0.71 | 4.85E−02 | 1 | 5 | LYM839 | 0.72 | 4.21E−02 | 1 | 2 |
| LYM841 | 0.80 | 1.65E−02 | 1 | 4 | LYM841 | 0.88 | 3.71E−03 | 1 | 1 |
| LYM843 | 0.73 | 3.80E−02 | 1 | 1 | LYM843 | 0.73 | 3.99E−02 | 1 | 2 |
| LYM846 | 0.72 | 4.54E−02 | 1 | 4 | LYM846 | 0.77 | 2.54E−02 | 1 | 3 |
| LYM846 | 0.75 | 2.06E−02 | 2 | 6 | LYM846 | 0.70 | 3.49E−02 | 2 | 3 |
| LYM848 | 0.77 | 2.45E−02 | 1 | 4 | LYM848 | 0.83 | 1.01E−02 | 1 | 3 |
| LYM849 | 0.76 | 2.87E−02 | 1 | 4 | LYM849 | 0.78 | 2.19E−02 | 1 | 1 |
| LYM849 | 0.84 | 8.97E−03 | 1 | 5 | LYM849 | 0.77 | 1.60E−02 | 2 | 2 |
| LYM855 | 0.92 | 1.24E−03 | 1 | 2 | LYM857 | 0.74 | 3.66E−02 | 1 | 5 |
| LYM858 | 0.74 | 3.40E−02 | 1 | 6 | LYM859 | 0.73 | 2.52E−02 | 2 | 5 |
| LYM860 | 0.80 | 1.76E−02 | 1 | 2 | LYM861 | 0.80 | 1.76E−02 | 1 | 2 |
| LYM901_H1 | 0.71 | 4.63E−02 | 1 | 5 | LYM901_H1 | 0.84 | 8.38E−03 | 1 | 1 |
| LYM862 | 0.80 | 1.76E−02 | 1 | 2 | LYM964_H1 | 0.77 | 2.53E−02 | 1 | 6 |

Table 76.
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under cold conditions (10 ± 2° C.) across Maize accessions.
P = p value.

TABLE 77

Correlation between the expression level of selected genes of some embodiments of the invention in various tissues and the phenotypic performance under salinity conditions across Maize accessions

| Gene Name | R | P value | Exp. set | Corr. Set ID | Gene Name | R | P value | Exp. set | Corr. Set ID |
|---|---|---|---|---|---|---|---|---|---|
| LYM798 | 0.91 | 2.80E−04 | 1 | 6 | LYM799 | 0.70 | 3.55E−02 | 2 | 6 |
| LYM800 | 0.89 | 1.18E−03 | 2 | 2 | LYM800 | 0.81 | 4.64E−03 | 1 | 6 |
| LYM801 | 0.88 | 6.80E−04 | 1 | 6 | LYM802 | 0.80 | 9.03E−03 | 2 | 1 |
| LYM803 | 0.85 | 3.99E−03 | 2 | 6 | LYM803 | 0.84 | 4.20E−03 | 2 | 1 |
| LYM803 | 0.72 | 1.79E−02 | 1 | 6 | LYM805 | 0.75 | 1.88E−02 | 2 | 6 |
| LYM806 | 0.78 | 8.08E−03 | 1 | 2 | LYM813 | 0.73 | 1.64E−02 | 1 | 2 |
| LYM817 | 0.75 | 2.07E−02 | 2 | 1 | LYM822 | 0.79 | 1.19E−02 | 2 | 5 |
| LYM822 | 0.71 | 2.17E−02 | 1 | 5 | LYM827 | 0.77 | 1.44E−02 | 2 | 1 |
| LYM828 | 0.75 | 1.19E−02 | 1 | 2 | LYM833 | 0.74 | 1.36E−02 | 1 | 2 |
| LYM835 | 0.76 | 1.71E−02 | 2 | 2 | LYM835 | 0.86 | 1.27E−03 | 1 | 2 |
| LYM838 | 0.79 | 1.07E−02 | 2 | 6 | LYM838 | 0.78 | 7.84E−03 | 1 | 6 |
| LYM842 | 0.77 | 1.57E−02 | 2 | 1 | LYM843 | 0.71 | 3.16E−02 | 2 | 6 |
| LYM844 | 0.74 | 1.40E−02 | 1 | 5 | LYM848 | 0.78 | 1.23E−02 | 2 | 1 |
| LYM849 | 0.89 | 1.34E−03 | 2 | 5 | LYM849 | 0.75 | 1.98E−02 | 2 | 1 |
| LYM849 | 0.74 | 2.21E−02 | 2 | 4 | | | | | |
| LYM855 | 0.79 | 6.65E−03 | 1 | 2 | LYM855 | 0.72 | 1.79E−02 | 1 | 7 |
| LYM856 | 0.79 | 1.16E−02 | 2 | 2 | LYM858 | 0.91 | 2.52E−04 | 1 | 3 |
| LYM860 | 0.73 | 1.75E−02 | 1 | 5 | LYM860 | 0.84 | 2.56E−03 | 1 | 4 |
| LYM861 | 0.73 | 1.75E−02 | 1 | 5 | LYM861 | 0.84 | 2.56E−03 | 1 | 4 |
| LYM862 | 0.73 | 1.75E−02 | 1 | 5 | LYM862 | 0.84 | 2.56E−03 | 1 | 4 |
| LYM798 | 0.91 | 2.80E−04 | 1 | 6 | LYM799 | 0.70 | 3.55E−02 | 2 | 6 |
| LYM800 | 0.89 | 1.18E−03 | 2 | 2 | LYM800 | 0.81 | 4.64E−03 | 1 | 6 |
| LYM801 | 0.88 | 6.80E−04 | 1 | 6 | LYM802 | 0.80 | 9.03E−03 | 2 | 1 |
| LYM803 | 0.85 | 3.99E−03 | 2 | 6 | LYM803 | 0.84 | 4.20E−03 | 2 | 1 |
| LYM803 | 0.72 | 1.79E−02 | 1 | 6 | LYM805 | 0.75 | 1.88E−02 | 2 | 6 |

Table 77.
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under salinity conditions (100 mM NaCl) across Maize accessions.
P = p value.

Example 14

Production of Sorghum Transcriptom and High Throughput Correlation Analysis Using 60K Sorghum Oligonucleotide Micro-Array In order to produce a high throughput correlation analysis between plant phenotype and gene expression level, the present inventors utilized a *sorghum* oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60,000 *sorghum* genes and transcripts. In order to define correlations between the levels of RNA expression with vigor related parameters, various plant characteristics of 10 different *sorghum* hybrids were analyzed. The correlation between the RNA levels and the characterized parameters was analyzed using Pearson correlation test [Hypertext Transfer Protocol://World Wide Web (dot) davidmlane (dot) com/hyperstat/A34739 (dot) html].
Experimental Procedures
Correlation of *Sorghum* varieties across ecotypes grown in growth chambers under temperature of 30° C. or 14° C. at low light (100 μE) or high light (250 μE) conditions.

Analyzed *Sorghum* tissues—All 10 selected *Sorghum* hybrids were sampled per each condition. Leaf tissue growing under 30° C. and low light (100 μm$^{-2}$ sec$^{-1}$), 14° C. and low light (100 μEm$^{-2}$ sec$^{-1}$), 30° C. and high light (250 μEm$^{-2}$ seq$^{-1}$), 14° C. and high light (250 μEm$^{-2}$ sec$^{-1}$) were sampled at vegetative stage of four-five leaves and RNA was extracted as described above. Each micro-array expression information tissue type has received a Set ID as summarized in Table 78 below.

TABLE 78

Sorghum transcriptome expression sets in field experiments

| | |
|---|---|
| Sorghum/leaf, under 14 Celsius degrees and high light (light on) | 1 |
| Sorghum/leaf, under 14 Celsius degrees and low light (light on) | 2 |
| Sorghum/leaf, under 30 Celsius degrees and high light (light on) | 3 |
| Sorghum/leaf, under 30 Celsius degrees and low light (light on) | 4 |

Table 78:
Provided are the sorghum transcriptome expression sets.

The following parameters were collected by sampling 8-10 plants per plot or by measuring the parameter across all the plants within the plot.

Relative Growth Rate was calculated as regression coefficient of vegetative dry weight along time course.

Leaves number—Plants were characterized for leaf number during growing period. In each measure, plants were measured for their leaf number by counting all the leaves of selected plants per plot.

Shoot FW—shoot fresh weight per plant, measurement of all vegetative tissue above ground.

Shoot DW—shoot dry weight per plant, measurement of all vegetative tissue above ground after drying at 70° C. in oven for 48 hours.

The average for each of the measured parameter was calculated and values are summarized in Tables 80-83 below. Subsequent correlation analysis was performed (Tables 84-87). Results were then integrated to the database.

TABLE 79

Sorghum correlated parameters (vectors)

| Correlated parameter with | Correlation ID |
|---|---|
| RGR (relative growth rate) | 1 |
| Shoot DW (dry weight) (gr.) | 2 |
| Shoot FW (fresh weight) (gr.) | 3 |
| Leaves number | 4 |

Table 79.
Provided are the Sorghum correlated parameters (vectors).

TABLE 80

Measured parameters in Sorghum accessions under 14° C. and low light (100 µE $m^{-2}$ $sec^{-1}$)

| | Ecotype | | | | | | | | | |
|---|---|---|---|---|---|---|---|---|---|---|
| Corr. ID | Line-1 | Line-2 | Line-3 | Line-4 | Line-5 | Line-6 | Line-7 | Line-8 | Line-9 | Line-10 |
| 1 | 3.00 | 3.00 | 2.75 | 2.75 | 2.63 | 3.00 | 3.50 | 2.75 | 2.43 | 2.00 |
| 2 | 0.03 | −0.01 | −0.02 | 0.02 | −0.04 | −0.04 | 0.08 | NA | −0.05 | −0.07 |
| 3 | 0.04 | 0.01 | 0.01 | 0.01 | 0.01 | 0.01 | 0.03 | 0.01 | 0.01 | 0.01 |
| 4 | 0.55 | 0.30 | 0.33 | 0.28 | 0.36 | 0.36 | 0.58 | 0.22 | 0.18 | 0.30 |

Table 80:
Provided are the values of the parameters (as described above) measured in Sorghum accessions (Seed ID) under 14° C. and low light (100 µE $m^{-2}$ $sec^{-1}$).

TABLE 81

Measured parameters in Sorghum accessions under 30° C. and low light (100 µE $m^{-2}$ $sec^{-1}$)

| | Ecotype | | | | | | | | | |
|---|---|---|---|---|---|---|---|---|---|---|
| Corr. ID | Line-1 | Line-2 | Line-3 | Line-4 | Line-5 | Line-6 | Line-7 | Line-8 | Line-9 | Line-10 |
| 2 | 0.10 | 0.10 | 0.09 | 0.12 | 0.11 | 0.08 | 0.11 | 0.12 | 0.04 | 0.04 |
| 3 | 0.11 | 0.08 | 0.07 | 0.06 | 0.09 | 0.08 | 0.04 | 0.05 | 0.04 | 0.05 |
| 4 | 1.35 | 1.05 | 0.88 | 0.95 | 1.29 | 1.13 | 0.71 | 0.79 | 0.67 | 0.82 |
| 1 | 5.27 | 5.00 | 4.75 | 4.00 | 4.00 | 4.00 | 5.25 | 4.50 | 3.75 | 4.00 |

Table 81:
Provided are the values of each of the parameters (as described above) measured in Sorghum accessions (Seed ID) under 30° C. and low light (100 µE $m^{-2}$ $sec^{-1}$).

TABLE 82

Measured parameters in Sorghum accessions under 30° C. and high light (250 µE $m^{-2}$ $sec^{-1}$)

| | Ecotype | | | | | | | | | |
|---|---|---|---|---|---|---|---|---|---|---|
| Corr. ID | Line-1 | Line-2 | Line-3 | Line-4 | Line-5 | Line-6 | Line-7 | Line-8 | Line-9 | Line-10 |
| 1 | 4.00 | 3.70 | 3.50 | 3.33 | 4.00 | 4.00 | 3.60 | 3.40 | 3.30 | 3.40 |
| 2 | 0.10 | 0.10 | 0.09 | 0.07 | 0.09 | 0.12 | 0.10 | 0.10 | 0.11 | 0.12 |
| 3 | 0.08 | 0.05 | 0.05 | 0.04 | 0.07 | 0.08 | 0.05 | 0.04 | 0.04 | 0.06 |
| 4 | 0.77 | 0.52 | 0.49 | 0.38 | 0.71 | 0.86 | 0.49 | 0.45 | 0.44 | 0.67 |

Table 82:
Provided are the values of each of the parameters (as described above) measured in Sorghum accessions (Seed ID) under 30° C. and high light (250 µE $m^{-2}$ $sec^{-1}$).

TABLE 83

Measured parameters in Sorghum accessions under 14° C. and high light (250 µE $m^{-2}$ $sec^{-1}$)

| | Ecotype | | | | | | | | | |
|---|---|---|---|---|---|---|---|---|---|---|
| Corr. ID | Line-1 | Line-2 | Line-3 | Line-4 | Line-5 | Line-6 | Line-7 | Line-8 | Line-9 | Line-10 |
| 2 | 0.05 | 0.05 | 0.03 | 0.04 | 0.06 | 0.06 | 0.05 | 0.06 | 0.07 | 0.06 |
| 3 | 0.04 | 0.03 | 0.02 | 0.02 | 0.04 | 0.04 | 0.02 | 0.02 | 0.02 | 0.03 |
| 4 | 0.37 | 0.25 | 0.22 | 0.25 | 0.43 | 0.37 | 0.24 | 0.23 | 0.24 | 0.27 |

Table 83:
Provided are the values of each of the parameters (as described above) measured in Sorghum accessions (Seed ID) under 14° C. and high light (250 µE $m^{-2}$ $sec^{-1}$).

TABLE 84

Correlation between the expression level of selected genes of some embodiments of the invention in various tissues and the phenotypic performance under 14° C. and low light (100 μE m$^{-2}$ sec$^{-1}$) conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM884 | 0.79 | 1.09E−02 | 2 | 2 | LYM885 | 0.75 | 1.31E−02 | 2 | 4 |
| LYM885 | 0.89 | 1.28E−03 | 2 | 2 | LYM885 | 0.72 | 1.89E−02 | 2 | 1 |
| LYM886 | 0.87 | 2.34E−03 | 2 | 2 | LYM889 | 0.71 | 3.16E−02 | 2 | 2 |
| LYM889 | 0.78 | 7.84E−03 | 2 | 4 | LYM895 | 0.75 | 1.33E−02 | 2 | 3 |
| LYM889 | 0.79 | 6.91E−03 | 2 | 3 | LYM896 | 0.84 | 4.63E−03 | 2 | 2 |
| LYM891 | 0.80 | 8.92E−03 | 2 | 2 | LYM899 | 0.91 | 6.52E−04 | 2 | 2 |
| LYM895 | 0.77 | 1.42E−02 | 2 | 2 | LYM900 | 0.88 | 1.92E−03 | 2 | 2 |
| LYM896 | 0.73 | 1.63E−02 | 2 | 4 | LYM907 | 0.89 | 1.42E−03 | 2 | 2 |
| LYM896 | 0.71 | 2.26E−02 | 2 | 3 | LYM910 | 0.77 | 9.71E−03 | 2 | 4 |
| LYM900 | 0.83 | 3.29E−03 | 2 | 4 | LYM910 | 0.71 | 2.04E−02 | 2 | 3 |
| LYM900 | 0.83 | 2.87E−03 | 2 | 3 | LYM916 | 0.72 | 3.03E−02 | 2 | 2 |
| LYM907 | 0.84 | 2.12E−03 | 2 | 4 | LYM917 | 0.82 | 7.02E−03 | 2 | 2 |
| LYM907 | 0.80 | 5.04E−03 | 2 | 3 | LYM923 | 0.73 | 2.45E−02 | 2 | 2 |
| LYM910 | 0.77 | 1.50E−02 | 2 | 2 | LYM925 | 0.87 | 9.76E−04 | 2 | 4 |
| LYM917 | 0.75 | 1.31E−02 | 2 | 4 | LYM926 | 0.83 | 5.26E−03 | 2 | 2 |
|  |  |  |  |  | LYM929 | 0.92 | 1.83E−04 | 2 | 3 |
| LYM926 | 0.92 | 2.04E−04 | 2 | 4 | LYM934 | 0.83 | 3.15E−03 | 2 | 3 |
| LYM926 | 0.84 | 2.21E−03 | 2 | 3 | LYM939 | 0.84 | 4.44E−03 | 2 | 2 |
| LYM929 | 0.81 | 4.55E−03 | 2 | 4 | LYM944 | 0.72 | 1.86E−02 | 2 | 3 |
| LYM934 | 0.72 | 2.72E−02 | 2 | 2 | LYM946 | 0.90 | 3.36E−04 | 2 | 4 |
| LYM935 | 0.77 | 1.45E−02 | 2 | 2 | LYM948 | 0.91 | 7.14E−04 | 2 | 2 |
| LYM937 | 0.76 | 1.74E−02 | 2 | 2 | LYM948 | 0.72 | 1.80E−02 | 2 | 1 |
| LYM944 | 0.79 | 1.14E−02 | 2 | 2 | LYM951 | 0.81 | 7.82E−03 | 2 | 2 |
| LYM944 | 0.71 | 2.23E−02 | 2 | 1 | LYM952 | 0.75 | 1.18E−02 | 2 | 4 |
| LYM946 | 0.81 | 4.26E−03 | 2 | 3 | LYM957 | 0.75 | 1.26E−02 | 2 | 4 |
| LYM948 | 0.78 | 7.45E−03 | 2 | 4 | LYM957 | 0.80 | 4.97E−03 | 2 | 3 |
| LYM948 | 0.80 | 5.87E−03 | 2 | 3 | LYM959 | 0.92 | 3.60E−04 | 2 | 2 |
| LYM952 | 0.76 | 1.75E−02 | 2 | 2 | LYM961 | 0.82 | 3.54E−03 | 2 | 4 |
| LYM957 | 0.89 | 1.48E−03 | 2 | 2 | LYM967 | 0.84 | 5.08E−03 | 2 | 2 |
| LYM959 | 0.71 | 2.04E−02 | 2 | 4 | LYM969 | 0.84 | 4.92E−03 | 2 | 2 |
| LYM961 | 0.79 | 6.00E−03 | 2 | 3 | LYM972 | 0.88 | 1.75E−03 | 2 | 2 |
| LYM969 | 0.81 | 4.24E−03 | 2 | 4 | LYM974 | 0.76 | 1.14E−02 | 2 | 3 |
| LYM969 | 0.82 | 3.92E−03 | 2 | 3 | LYM976 | 0.71 | 2.23E−02 | 2 | 3 |
| LYM974 | 0.86 | 1.27E−03 | 2 | 4 |  |  |  |  |  |
| LYM976 | 0.91 | 5.44E−04 | 2 | 2 |  |  |  |  |  |

Table 84:
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under 14° C. and low light (100 μE m$^{-2}$ sec$^{-1}$) conditions across sorghum accessions.
P = p value.

TABLE 85

Correlation between the expression level of selected genes of some embodiments of the invention in various tissues and the phenotypic performance under 30° C. and low light (100 μE m$^{-2}$ sec$^{-1}$) conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM892 | 0.76 | 1.13E−02 | 4 | 4 | LYM892 | 0.74 | 1.39E−02 | 4 | 3 |
| LYM902 | 0.76 | 1.12E−02 | 4 | 2 | LYM901 | 0.77 | 8.60E−03 | 4 | 3 |
| LYM909 | 0.72 | 2.01E−02 | 4 | 1 | LYM912 | 0.73 | 1.60E−02 | 4 | 3 |
| LYM913 | 0.79 | 5.99E−03 | 4 | 3 | LYM913 | 0.80 | 5.19E−03 | 4 | 4 |
| LYM923 | 0.78 | 7.39E−03 | 4 | 3 | LYM923 | 0.71 | 2.08E−02 | 4 | 4 |
| LYM926 | 0.73 | 1.57E−02 | 4 | 5 | LYM926 | 0.72 | 1.84E−02 | 4 | 3 |
| LYM941 | 0.77 | 8.52E−03 | 4 | 4 | LYM929 | 0.70 | 2.36E−02 | 4 | 3 |
| LYM945 | 0.73 | 1.73E−02 | 4 | 3 | LYM941 | 0.77 | 9.70E−03 | 4 | 3 |
| LYM952 | 0.75 | 1.30E−02 | 4 | 5 | LYM944 | 0.74 | 1.40E−02 | 4 | 3 |
| LYM956 | 0.73 | 1.61E−02 | 4 | 2 | LYM945 | 0.79 | 6.41E−03 | 4 | 4 |
| LYM964 | 0.79 | 6.51E−03 | 4 | 3 | LYM962 | 0.75 | 1.25E−02 | 4 | 5 |
| LYM965 | 0.81 | 4.55E−03 | 4 | 3 | LYM964 | 0.78 | 7.93E−03 | 4 | 4 |

TABLE 85-continued

Correlation between the expression level of selected genes of some embodiments of the invention in various tissues and the phenotypic performance under 30° C. and low light (100 μE m$^{-2}$ sec$^{-1}$) conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM977 | 0.71 | 2.10E−02 | 4 | 3 | LYM965 | 0.78 | 8.13E−03 | 4 | 4 |
|  |  |  |  |  | LYM978 | 0.73 | 1.62E−02 | 4 | 2 |

Table 85:
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under 30° C. and low light (100 μE m$^{-2}$ sec$^{-1}$) conditions across sorghum accessions.
P = p value.

TABLE 86

Correlation between the expression level of selected genes of some embodiments of the invention in various tissues and the phenotypic performance under 30° C. and high light (250 μE m$^{-2}$ sec$^{-1}$) conditions across Sorghum accessions

| Gene Name | R | P value | Exp. set | Corr. Set ID | Gene Name | R | P value | Exp. set | Corr. Set ID |
|---|---|---|---|---|---|---|---|---|---|
| LYM900 | 0.78 | 6.49E−02 | 3 | 3 | LYM887 | 0.91 | 1.12E−02 | 3 | 2 |
| LYM903 | 0.81 | 5.05E−02 | 3 | 2 | LYM891 | 0.75 | 8.65E−02 | 3 | 3 |
| LYM903 | 0.71 | 1.13E−01 | 3 | 1 | LYM900 | 0.73 | 9.94E−02 | 3 | 4 |
| LYM911 | 0.76 | 7.91E−02 | 3 | 4 | LYM903 | 0.71 | 1.15E−01 | 3 | 4 |
| LYM911 | 0.74 | 9.26E−02 | 3 | 1 | LYM903 | 0.75 | 8.77E−02 | 3 | 3 |
| LYM912 | 0.99 | 2.13E−04 | 3 | 4 | LYM905 | 0.76 | 8.04E−02 | 3 | 3 |
| LYM912 | 0.97 | 1.22E−03 | 3 | 1 | LYM907 | 0.72 | 1.08E−01 | 3 | 3 |
| LYM914 | 0.80 | 5.67E−02 | 3 | 3 | LYM911 | 0.82 | 4.74E−02 | 3 | 3 |
| LYM916 | 0.75 | 8.66E−02 | 3 | 4 | LYM912 | 1.00 | 3.27E−05 | 3 | 3 |
| LYM919 | 0.71 | 1.17E−01 | 3 | 2 | LYM914 | 0.76 | 8.00E−02 | 3 | 4 |
| LYM921 | 0.83 | 4.30E−02 | 3 | 3 | LYM916 | 0.79 | 6.17E−02 | 3 | 3 |
| LYM924 | 0.71 | 1.16E−01 | 3 | 3 |  |  |  |  |  |
| LYM926 | 0.77 | 7.61E−02 | 3 | 3 | LYM921 | 0.77 | 7.16E−02 | 3 | 4 |
| LYM927 | 0.79 | 6.43E−02 | 3 | 3 | LYM926 | 0.70 | 1.18E−01 | 3 | 4 |
| LYM933 | 0.71 | 1.12E−01 | 3 | 3 | LYM927 | 0.72 | 1.05E−01 | 3 | 4 |
| LYM935 | 0.95 | 4.36E−03 | 3 | 3 | LYM935 | 0.94 | 4.57E−03 | 3 | 4 |
| LYM939 | 0.70 | 1.18E−01 | 3 | 4 | LYM935 | 0.98 | 5.52E−04 | 3 | 1 |
| LYM944 | 0.76 | 7.78E−02 | 3 | 2 | LYM939 | 0.76 | 7.77E−02 | 3 | 3 |
| LYM944 | 0.79 | 6.24E−02 | 3 | 1 | LYM944 | 0.86 | 3.00E−02 | 3 | 4 |
| LYM948 | 0.70 | 1.21E−01 | 3 | 3 | LYM944 | 0.89 | 1.84E−02 | 3 | 3 |
| LYM951 | 0.72 | 1.04E−01 | 3 | 4 | LYM951 | 0.78 | 6.57E−02 | 3 | 3 |
| LYM953 | 0.86 | 2.72E−02 | 3 | 3 | LYM953 | 0.80 | 5.50E−02 | 3 | 4 |
| LYM957 | 0.72 | 1.09E−01 | 3 | 4 | LYM953 | 0.74 | 9.19E−02 | 3 | 1 |
| LYM960 | 0.83 | 4.01E−02 | 3 | 2 | LYM957 | 0.78 | 6.88E−02 | 3 | 3 |
| LYM961 | 0.81 | 4.98E−02 | 3 | 3 | LYM961 | 0.76 | 8.10E−02 | 3 | 4 |
| LYM962 | 0.76 | 7.95E−02 | 3 | 3 | LYM968 | 0.89 | 1.60E−02 | 3 | 4 |
| LYM968 | 0.88 | 2.03E−02 | 3 | 3 | LYM968 | 0.79 | 6.24E−02 | 3 | 1 |
| LYM975 | 0.72 | 1.08E−01 | 3 | 4 | LYM975 | 0.78 | 6.96E−02 | 3 | 3 |
| LYM978 | 0.78 | 6.98E−02 | 3 | 2 | LYM979 | 0.89 | 1.80E−02 | 3 | 2 |

Table 86:
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under 30° C. and high light (250 μE m$^{-2}$ sec$^{-1}$) conditions across sorghum accessions.
P = p value.

TABLE 87

Correlation between the expression level of selected genes of some embodiments of the invention in various tissues and the phenotypic performance under 14° C. and high light (250 μE m$^{-2}$ sec$^{-1}$) conditions across Sorghum accessions

| Gene Name | R | P value | Exp. set | Correl. Set ID | Gene Name | R | P value | Exp. set | Correl. Set ID |
|---|---|---|---|---|---|---|---|---|---|
| LYM891 | 0.81 | 4.16E−03 | 1 | 4 | LYM890 | 0.72 | 1.91E−02 | 1 | 3 |
| LYM895 | 0.75 | 1.29E−02 | 1 | 4 | LYM891 | 0.83 | 2.97E−03 | 1 | 3 |
| LYM903 | 0.74 | 1.41E−02 | 1 | 3 | LYM895 | 0.84 | 2.49E−03 | 1 | 3 |
| LYM929 | 0.86 | 1.30E−03 | 1 | 3 | LYM903 | 0.71 | 2.12E−02 | 1 | 4 |
| LYM944 | 0.71 | 2.17E−02 | 1 | 3 | LYM929 | 0.82 | 3.47E−03 | 1 | 4 |

TABLE 87-continued

Correlation between the expression level of selected genes of some embodiments of the invention in various tissues and the phenotypic performance under 14° C. and high light (250 µE m$^{-2}$ sec$^{-1}$) conditions across Sorghum accessions

| Gene Name | R | P value | Exp. set | Correl. Set ID | Gene Name | R | P value | Exp. set | Correl. Set ID |
|---|---|---|---|---|---|---|---|---|---|
| LYM946 | 0.75 | 1.21E−02 | 1 | 3 | LYM934 | 0.76 | 1.04E−02 | 1 | 3 |
| LYM968 | 0.72 | 1.86E−02 | 1 | 4 | LYM946 | 0.71 | 2.13E−02 | 1 | 4 |
|  |  |  |  |  | LYM948 | 0.71 | 2.17E−02 | 1 | 3 |

Table 87:
Provided are the correlations (R) between the expression levels of yield improving genes and their homologues in tissues [Leaves or roots; Expression sets (Exp)] and the phenotypic performance in various biomass, growth rate and/or vigor components [Correlation vector (corr.)] under 14° C. and high light (250 µE m$^{-2}$ sec$^{-1}$) conditions across sorghum accessions.
P = p value.

Example 15

Production of Maize Transcriptom and High Throughput Correlation Analysis when Grown Under Normal and Defoliation Conditions Using 60K Maize Oligonucleotide Micro-Array To produce a high throughput correlation analysis, the present inventors utilized a Maize oligonucleotide microarray, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 60K Maize genes to and transcripts designed based on data from Public databases (Example 1). To define correlations between the levels of RNA expression and yield, biomass components or vigor related parameters, various plant characteristics of 13 different Maize hybrids were analyzed under normal and defoliation conditions. Same hybrids were subjected to RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures 13 maize hybrids lines were grown in 6 repetitive plots, in field. Maize seeds were planted and plants were grown in the field using commercial fertilization and irrigation protocols. After silking 3 plots in every hybrid line underwent the defoliation treatment. In this treatment all the leaves above the ear were removed. After the treatment all the plants were grown according to the same commercial fertilization and irrigation protocols.

Three tissues at flowering developmental (R1) stage including leaf (flowering –R1), stem (flowering –R1), and flowering meristem (flowering –R1) representing different plant characteristics, were sampled from treated and untreated plants. RNA was extracted as described in "GENERAL EXPERIMENTAL AND BIOINFORMATICS METHODS". For convenience, each micro-array expression information tissue type has received a Set ID as summarized in Tables 88-89 below.

TABLE 88

Tissues used for Maize transcriptom expression sets (Under normal conditions)

| Expression Set | Set ID |
|---|---|
| maize/Female meristem, under Normal conditions | 1 |
| maize/leaf, under Normal conditions | 2 |
| maize/stem, under Normal conditions | 3 |

Table 88:
Provided are the identification (ID) numbers of each of the Maize expression sets.

TABLE 89

Tissues used for Maize transcriptom expression sets (Under defoliation conditions)

| Expression Set | Set ID |
|---|---|
| maize/Female meristem, under Defoliation conditions | 1 |
| maize/ /leaf, under Defoliation conditions | 2 |
| maize/stem, under Defoliation conditions | 3 |

Table 89:
Provided are the identification (ID) numbers of each of the Maize expression sets.

The image processing system was used, which consists of a personal desktop computer (Intel P4 3.0 GHz processor) and a public domain program—ImageJ 1.37, Java based image processing software, which was developed at the U.S. National Institutes of Health and is freely available on the internet at Hypertext Transfer Protocol://rsbweb (dot) nih (dot) gov/. Images were captured in resolution of 10 Mega Pixels (3888×2592 pixels) and stored in a low compression JPEG (Joint Photographic Experts Group standard) format. Next, image processing output data for seed area and seed length was saved to text files and analyzed using the JMP statistical analysis software (SAS institute).

The following parameters were collected by imaging.

1000 grain weight—At the end of the experiment all seeds from all plots were collected and weighed and the weight of 1000 was calculated.

Ear Area (cm$^2$)—At the end of the growing period Sears were, photographed and images were processed using the below described image processing system. The Ear area was measured from those images and was divided by the number of ears.

Ear Length and Ear Width (cm)—At the end of the growing period 6 ears were, photographed and images were processed using the below described image processing system. The Ear length and width (longest axis) was measured from those images and was divided by the number of ears.

Grain Area (cm$^2$)—At the end of the growing period the grains were separated from the ear. A sample of ~200 grains were weight, photographed and images were processed using the below described image processing system. The grain area was measured from those images and was divided by the number of grains.

Grain Length and Grain width (cm)—At the end of the growing period the grains were separated from the ear. A sample of ~200 grains were weight, photographed and images were processed using the below described image processing system. The sum of grain lengths/or width (longest axis) was measured from those images and was divided by the number of grains.

Grain Perimeter (cm)—At the end of the growing period the grains were separated from the ear. A sample of ~200 grains were weight, photographed and images were processed using the below described image processing system. The sum of grain perimeter was measured from those images and was divided by the number of grains.

Ear filled grain area (cm²)—At the end of the growing period 5 ears were, photographed and images were processed using the below described image processing system. The Ear area filled with kernels was measured from those images and was divided by the number of Ears.

Filled per Whole Ear—was calculated as the length of the ear with grains out of the total ear.

Additional parameters were collected either by sampling 6 plants per plot or by measuring the parameter across all the plants within the plot.

Cob width [cm]—The diameter of the cob without grains was measured using a ruler.

Ear average weight [kg]—At the end of the experiment (when ears were harvested) total and 6 selected ears per plots were collected. The ears were weighted and the average ear per plant was calculated. The ear weight was normalized using the relative humidity to be 0%.

Plant height and Ear height—Plants were characterized for height at harvesting. In each measure, 6 plants were measured for their height using a measuring tape. Height was measured from ground level to top of the plant below the tassel. Ear height was measured from the ground level to the place were the main ear is located Ear row num—The number of rows per ear was counted.

Ear fresh weight per plant (GF)—During the grain filling period (GF) and total and 6 selected ears per plot were collected separately. The ears were weighted and the average ear weight per plant was calculated.

Ears dry weight—At the end of the experiment (when ears were harvested) total and 6 selected ears per plots were collected and weighted. The ear weight was normalized using the relative humidity to be 0%.

Ears fresh weight—At the end of the experiment (when ears were harvested) total and 6 selected ears per plots were collected and weighted.

Ears per plant—number of ears per plant were counted.

Grains weight (Kg.)—At the end of the experiment all ears were collected. Ears from 6 plants from each plot were separately threshed and grains were weighted.

Grains dry weight (Kg.)—At the end of the experiment all ears were collected. Ears from 6 plants from each plot were separately threshed and grains were weighted. The grain weight was normalized using the relative humidity to be 0%.

Grain weight per ear (Kg.)—At the end of the experiment all ears were collected. 5 ears from each plot were separately threshed and grains were weighted. The average grain weight per ear was calculated by dividing the total grain weight by the number of ears.

Leaves area per plant at GF and HD [LAI, leaf area index]=Total leaf area of 6 plants in a plot his parameter was measured at two time points during the course of the experiment; at heading (HD) and during the grain filling period (GF). Measurement was performed using a Leaf area-meter at two time points in the course of the experiment; during the grain filling period and at the heading stage (VT).

Leaves fresh weight at GF and HD—This parameter was measured at two time points during the course of the experiment; at heading (HD) and during the grain filling period (GF). Leaves used for measurement of the LAI were weighted.

Lower stem fresh weight at GF, HD and H—This parameter was measured at three time points during the course of the experiment: at heading (HD), during the grain filling period (GF) and at harvest (H). Lower internodes from at least 4 plants per plot were separated from the plant and weighted. The average internode weight per plant was calculated by dividing the total grain weight by the number of plants.

Lower stem length at GF, HD and H—This parameter was measured at three time points during the course of the experiment; at heading (HD), during the grain filling period (GF) and at harvest (H). Lower internodes from at least 4 plants per plot were separated from the plant and their length was measured using a ruler. The average internode length per plant was calculated by dividing the total grain weight by the number of plants.

Lower stem width at GF, HD, and H—This parameter was measured at three time points during the course of the experiment: at heading (HD), during the grain filling period (GF) and at harvest (H). Lower internodes from at least 4 plants per plot were separated from the plant and their diameter was measured using a caliber. The average internode width per plant was calculated by dividing the total grain weight by the number of plants.

Plant height growth—the relative growth rate (RGR) of Plant Height was calculated as described in Formula XII above, by Regression coefficient of Plant height along time course.

SPAD—Chlorophyll content was determined using a Minolta SPAD 502 chlorophyll meter and measurement was performed 64 days post sowing. SPAD meter readings were done on young fully developed leaf. Three measurements per leaf were taken per plot. Data were taken after 46 and 54 days after sowing (DPS).

Stem fresh weight at GF and HD—This parameter was measured at two time points during the course of the experiment: at heading (HD) and during the grain filling period (GF). Stems of the plants used for measurement of the LAI were weighted.

Total dry matter—Total dry matter was calculated as follows:

Normalized ear weight per plant+vegetative dry weight. Formula XVIII

Upper stem fresh weight at GF, HD and H—This parameter was measured at three time points during the course of the experiment; at heading (HD), during the grain filling period (GF) and at harvest(H). Upper internodes from at least 4 plants per plot were separated from the plant and weighted. The average internode weight per plant was calculated by dividing the total grain weight by the number of plants.

Upper stem length at GF, HD, and H—This parameter was measured at three time points during the course of the experiment; at heading (HD), during the grain filling period (GF) and at harvest(H). Upper internodes from at least 4 plants per plot were separated from the plant and their length was measured using a ruler. The average internode length per plant was calculated by dividing the total grain weight by the number of plants.

Upper stem width at GF, HD and H (mm)—This parameter was measured at three time points during the course of the experiment; at heading (HD), during the grain filling period (GF) and at harvest(H). Upper internodes from at least 4 plants per plot were separated from the plant and their diameter was measured using a caliber. The average internode width per plant was calculated by dividing the total grain weight by the number of plants.

Vegetative dry weight (Kg.)—total weight of the vegetative portion of 6 plants (above ground excluding roots) after drying at 70° C. in oven for 48 hours weight by the number of plants.

Vegetative fresh weight (Kg.)—total weight of the vegetative portion of 6 plants (above ground excluding roots).

Node number—nodes on the stem were counted at the heading stage of plant development.

TABLE 90

Maize correlated parameters (vectors) under normal conditions and under defoliation

| Normal conditions | | Defoliation | |
|---|---|---|---|
| Correlated parameter with | Correlation ID | Correlated parameter with | Correlation ID |
| 1000 grain weight (gr.) | 1 | 1000 grain weight | 1 |
| Cob width (mm) | 2 | Cob width | 2 |
| Ear Area (cm²) | 3 | Ear Area | 3 |
| Ear average weight (gr.) | 4 | Ear average weight | 4 |
| Ear filled grain area (cm²) | 5 | Ear filled grain area | 5 |
| Ear height (cm) | 6 | Ear height | 6 |
| Ear length (cm) | 7 | Ear length | 7 |
| Ear row number | 8 | Ear row num | 8 |
| Ear Width (cm) | 9 | Ear Width | 9 |
| Ears dry weight (kg) | 10 | Ears dry weight | 10 |
| Ears fresh weight (kg) | 11 | Ears fresh weight | 11 |
| Ear fresh weight per plant (GF) (gr/plant) | 12 | Ears per plant | 12 |
| Ears per plant | 13 | Filled per Whole Ear | 13 |
| Filled per Whole Ear | 14 | Ear Area | 14 |
| Ear Area | 15 | Grain length | 15 |
| Grain length (cm) | 16 | Grain Perimeter | 16 |
| Grain Perimeter (cm) | 17 | Grains dry weight | 19 |
| Grain width (cm) | 19 | Grains weight | 20 |
| Grains dry weight (kg) | 20 | Grain weight per ear | 21 |
| Grains weight (kg) | 21 | Leaves area per plant (hd) | 22 |
| Grain weight per ear (kg) | 22 | Leaves fresh weight (HD) | 23 |
| Leaves area per plant (GF) | 23 | Lower stem fresh weight (H) | 27 |
| Leaves area per plant (HD) | 24 | Lower stem fresh weight (HD) | 28 |
| Leaves fresh weight (GF) (gr.) | 25 | Lower stem length (H) | 29 |
| Leaves fresh weight (HD) (gr.) | 26 | Lower stem length (HD) | 30 |
| Leaves temperature (GF) (° C.) | 29 | Lower stem width (H) | 31 |
| Lower stem fresh weight (GF) (gr.) | 30 | Lower stem width (HD) | 32 |
| Lower stem fresh weight (H) (cm) | 31 | Node number | 33 |
| Lower stem fresh weight (HD) (gr.) | 32 | Plant height | 35 |
| Lower stem length (GF) (cm) | 33 | Plant height growth | 36 |
| Lower stem length (H) (cm) | 34 | SPAD | 41 |
| Lower stem length (HD) (cm) | 35 | Stem fresh weight (HD) | 42 |
| Lower stem width (GF) (mm) | 36 | Total dry matter | 43 |
| Lower stem width (H) (mm) | 37 | Upper stem fresh weight (H) | 44 |
| Lower stem width (HD) (mm) | 38 | Upper stem length (H) | 45 |
| Node_number | 39 | Upper stem width (H) | 46 |
| Plant height (cm) | 41 | Vegetative dry weight | 47 |
| Plant height growth (cm/day) | 42 | Vegetative fresh weight | 48 |
| SPAD (value) | 48 | | |
| Stem fresh weight (GF) (gr.) | 49 | | |

TABLE 90-continued

Maize correlated parameters (vectors) under normal conditions and under defoliation

| Normal conditions | | Defoliation | |
|---|---|---|---|
| Correlated parameter with | Correlation ID | Correlated parameter with | Correlation ID |
| Stem fresh weight (HD) (gr.) | 50 | | |
| Total dry matter (kg) | 51 | | |
| Upper stem fresh weight (GF) (gr.) | 52 | | |
| Upper stem fresh weight (H) (r.) | 53 | | |
| Upper stem length (GF) (cm) | 54 | | |
| Upper stem length (H) (cm) | 55 | | |
| Upper stem width (GF) (mm) | 56 | | |
| Upper stem width (H) (mm) | 57 | | |
| Vegetative dry weight (kg) | 58 | | |
| Vegetative fresh weight (kg) | 59 | | |

Table 90.

Thirteen maize varieties were grown, and characterized for parameters, as described above. The average for each parameter was calculated using the JMP software, and values are summarized in Tables 91-94 below. Subsequent correlation between the various transcriptom sets for all or sub set of lines was done by the bioinformatic unit and results were integrated into the database (Tables 95 and 96 below).

TABLE 91

Measured parameters in Maize Hybrid under normal conditions

| | Ecotype | | | | | |
|---|---|---|---|---|---|---|
| Treatment | Line-2 | Line-4 | Line-6 | Line-8 | Line-10 | Line-12 |
| 1 | 296.50 | 263.25 | 303.61 | 304.70 | 281.18 | 330.45 |
| 2 | 24.63 | 25.11 | 23.21 | 23.69 | 22.81 | 22.40 |
| 3 | 82.30 | 74.63 | 77.00 | 90.15 | 83.80 | 96.63 |
| 4 | 209.50 | 164.63 | 177.44 | 218.53 | 205.58 | 135.77 |
| 5 | 80.89 | 72.42 | 73.43 | 85.96 | 80.64 | 95.03 |
| 6 | 121.67 | 134.24 | 149.64 | 152.14 | 143.83 | 133.65 |
| 7 | 22.09 | 19.62 | 20.02 | 23.21 | 22.63 | 23.74 |
| 8 | 13.00 | 14.94 | 14.56 | 14.56 | 13.56 | 13.06 |
| 9 | 4.66 | 4.79 | 4.96 | 5.00 | 4.65 | 4.80 |
| 10 | 1.26 | 1.09 | 1.06 | 1.31 | 1.23 | 1.35 |
| 11 | 1.69 | 1.46 | 1.41 | 1.70 | 1.52 | 1.74 |
| 12 | 351.26 | 323.08 | 307.87 | 330.60 | 320.51 | 434.60 |
| 13 | 1.00 | 1.11 | 1.00 | 1.00 | 1.00 | 1.06 |
| 14 | 0.98 | 0.97 | 0.95 | 0.95 | 0.95 | 0.94 |
| 15 | 0.72 | 0.67 | 0.71 | 0.72 | 0.67 | 0.75 |
| 16 | 1.12 | 1.12 | 1.13 | 1.17 | 1.08 | 1.16 |
| 17 | 3.30 | 3.23 | 3.28 | 3.34 | 3.18 | 3.38 |
| 19 | 0.81 | 0.75 | 0.79 | 0.78 | 0.79 | 0.82 |
| 20 | 0.91 | 0.80 | 0.77 | 0.92 | 0.83 | 0.99 |
| 21 | 1.04 | 0.91 | 0.87 | 1.06 | 0.95 | 1.12 |
| 22 | 0.15 | 0.13 | 0.13 | 0.15 | 0.14 | 0.16 |
| 23 | 7034.60 | 6402.80 | 6353.07 | 6443.92 | 6835.50 | 6507.33 |
| 24 | 3171.00 | 3527.00 | 3984.75 | 3926.67 | 3942.75 | 4854.00 |
| 25 | 230.13 | 197.64 | 201.03 | 205.53 | 224.81 | 204.49 |
| 26 | 110.97 | 80.57 | 157.21 | 128.83 | 100.57 | 111.80 |
| 29 | 33.11 | 33.52 | 33.87 | 34.18 | 33.78 | 32.85 |
| 30 | 35.40 | 25.03 | 26.51 | 21.74 | 26.13 | 34.44 |
| 31 | 23.52 | 20.34 | 25.08 | 14.18 | 17.53 | 25.74 |
| 32 | 72.99 | 59.90 | 74.72 | 90.48 | 69.52 | 66.91 |
| 33 | 19.35 | 20.40 | 20.93 | 21.38 | 20.03 | 20.31 |
| 34 | 16.76 | 20.02 | 22.59 | 21.68 | 22.34 | 21.39 |
| 35 | 14.50 | 17.75 | 20.00 | 19.35 | 20.33 | 20.75 |
| 36 | 19.86 | 16.84 | 16.14 | 16.37 | 17.01 | 17.53 |

TABLE 91-continued

Measured parameters in Maize Hybrid under normal conditions

| Treatment | Ecotype | | | | | |
|---|---|---|---|---|---|---|
| | Line-2 | Line-4 | Line-6 | Line-8 | Line-10 | Line-12 |
| 37 | 19.42 | 17.19 | 16.09 | 16.92 | 17.52 | 17.88 |
| 38 | 24.14 | 20.53 | 20.97 | 24.43 | 21.70 | 19.49 |
| 39 | 15.22 | 14.56 | 14.61 | 14.83 | 15.00 | 13.83 |
| 41 | 265.11 | 255.94 | 271.11 | 283.89 | 279.72 | 268.78 |
| 42 | 6.30 | 6.52 | 7.14 | 6.98 | 7.41 | 7.50 |
| 48 | 59.77 | 53.17 | 53.21 | 54.95 | 53.99 | 55.24 |
| 49 | 649.03 | 489.32 | 524.06 | 512.66 | 542.16 | 627.76 |
| 50 | 758.61 | 587.88 | 801.32 | 794.80 | 721.87 | 708.38 |
| 51 | 2.57 | 2.06 | 2.32 | 2.44 | 2.36 | 2.57 |
| 52 | 19.61 | 15.54 | 17.82 | 10.79 | 14.41 | 20.31 |
| 53 | 12.94 | 11.21 | 12.98 | 6.50 | 7.99 | 12.08 |
| 54 | 16.63 | 18.75 | 18.38 | 17.92 | 17.60 | 18.79 |
| 55 | 16.93 | 18.76 | 18.72 | 20.01 | 19.40 | 19.65 |
| 56 | 16.00 | 14.11 | 13.50 | 11.89 | 13.08 | 14.34 |
| 57 | 14.93 | 13.00 | 12.44 | 12.04 | 12.89 | 13.28 |
| 58 | 1.31 | 0.97 | 1.25 | 1.13 | 1.13 | 1.21 |
| 59 | 3.16 | 2.25 | 2.61 | 2.60 | 2.42 | 2.64 |

Table 91.

TABLE 92

Measured parameters in Maize Hybrid under normal conditions, additional maize lines

| Treatment | Ecotype | | | | | | |
|---|---|---|---|---|---|---|---|
| | Line-14 | Line-16 | Line-18 | Line-21 | Line-23 | Line-25 | Line-27 |
| 1 | 290.88 | 250.26 | 306.20 | 253.19 | 277.03 | 269.53 | 274.81 |
| 2 | 23.18 | 24.88 | 26.47 | 23.09 | 22.69 | 23.55 | 26.31 |
| 3 | 78.36 | 93.91 | 96.77 | 85.44 | 76.77 | 54.35 | |
| 4 | 147.49 | 207.11 | 228.44 | 215.92 | 198.69 | 188.50 | 254.42 |
| 5 | 74.41 | 92.31 | 95.43 | 83.28 | 74.35 | 45.77 | |
| 6 | 118.39 | 145.24 | 133.78 | 143.71 | 134.17 | 143.00 | 147.78 |
| 7 | 20.31 | 22.60 | 23.84 | 21.74 | 20.04 | 14.05 | |
| 8 | 16.12 | 15.89 | 14.00 | 15.44 | 14.89 | 14.94 | 16.78 |
| 9 | 4.79 | 5.18 | 5.00 | 4.95 | 4.79 | 4.92 | |
| 10 | 1.16 | 1.29 | 1.37 | 1.30 | 1.19 | 1.13 | 1.53 |
| 11 | 1.80 | 1.60 | 1.74 | 1.68 | 1.56 | 1.42 | 1.89 |
| 12 | 325.08 | 327.15 | 363.70 | 405.72 | 338.24 | 345.32 | 369.69 |
| 13 | 1.00 | 1.06 | 1.00 | 1.00 | 1.00 | 1.00 | 1.00 |
| 14 | 0.93 | 0.98 | 0.99 | 0.97 | 0.97 | 0.83 | |
| 15 | 0.66 | 0.65 | 0.70 | 0.68 | 0.67 | 0.65 | 0.72 |
| 16 | 1.14 | 1.12 | 1.15 | 1.16 | 1.12 | 1.09 | 1.21 |
| 17 | 3.25 | 3.18 | 3.29 | 3.27 | 3.22 | 3.15 | 3.38 |
| 19 | 0.74 | 0.73 | 0.77 | 0.74 | 0.76 | 0.76 | 0.76 |
| 20 | 0.82 | 0.92 | 1.02 | 0.94 | 0.85 | 0.81 | 1.14 |
| 21 | 0.94 | 1.05 | 1.15 | 1.08 | 0.97 | 0.92 | 1.29 |
| 22 | 0.14 | 0.15 | 0.17 | 0.16 | 0.14 | 0.14 | 0.19 |
| 23 | 7123.48 | 6075.21 | 6597.67 | 6030.40 | 6307.06 | 6617.65 | 6848.03 |
| 24 | | | | | | | |
| 25 | 212.41 | 181.43 | 199.22 | 206.91 | 168.54 | 199.42 | 200.12 |
| 26 | 116.75 | 106.95 | 85.97 | 102.71 | 105.73 | 102.12 | 143.06 |
| 29 | 33.19 | 33.66 | 33.78 | 32.64 | 33.95 | 33.28 | 33.90 |
| 30 | 27.61 | 25.26 | 26.18 | 34.31 | 25.50 | 23.06 | 25.59 |
| 31 | 20.60 | 16.35 | 18.90 | 27.30 | 22.35 | 19.26 | 22.82 |
| 32 | 60.36 | 63.07 | 55.89 | 82.13 | 60.02 | 58.70 | 116.12 |
| 33 | 18.08 | 20.18 | 19.81 | 22.89 | 19.81 | 19.53 | 21.40 |
| 34 | 17.07 | 20.69 | 18.48 | 23.31 | 19.39 | 19.66 | 19.97 |
| 35 | 15.00 | 18.68 | 20.50 | 22.57 | 19.83 | 14.50 | 20.03 |
| 36 | 18.11 | 17.09 | 16.87 | 17.49 | 16.62 | 17.10 | 17.38 |
| 37 | 17.96 | 18.42 | 17.43 | 18.07 | 17.68 | 17.61 | 18.93 |
| 38 | 23.47 | 20.97 | 21.46 | 21.41 | 22.12 | 23.25 | 24.31 |
| 39 | 14.28 | 14.72 | 15.44 | 14.33 | 14.44 | 14.89 | 14.39 |
| 41 | 244.25 | 273.56 | 273.22 | 295.33 | 259.25 | 257.89 | 277.19 |
| 42 | 5.60 | 6.96 | 7.02 | 7.83 | 6.98 | 6.56 | 7.25 |
| 48 | 55.38 | 56.76 | 55.81 | 58.54 | 51.68 | 55.16 | 54.16 |
| 49 | 507.78 | 549.34 | 509.74 | 662.13 | 527.43 | 474.68 | 544.03 |
| 50 | 660.70 | 724.58 | 618.46 | 837.56 | 612.81 | 728.00 | 950.29 |

TABLE 92-continued

Measured parameters in Maize Hybrid under normal conditions, additional maize lines

| Treatment | Ecotype | | | | | | |
|---|---|---|---|---|---|---|---|
| | Line-14 | Line-16 | Line-18 | Line-21 | Line-23 | Line-25 | Line-27 |
| 51 | 2.23 | 2.73 | 2.33 | 2.40 | 2.20 | 2.08 | 2.84 |
| 52 | 15.85 | 14.39 | 17.85 | 20.42 | 13.93 | 13.05 | 16.45 |
| 53 | 9.72 | 6.98 | 9.40 | 13.58 | 9.20 | 7.69 | 10.17 |
| 54 | 17.07 | 17.52 | 18.15 | 18.61 | 17.69 | 18.15 | 18.64 |
| 55 | 16.42 | 18.34 | 16.63 | 19.38 | 16.71 | 16.27 | 15.92 |
| 56 | 15.04 | 13.63 | 14.73 | 14.61 | 13.17 | 12.77 | 14.15 |
| 57 | 13.10 | 13.48 | 13.42 | 13.27 | 13.14 | 12.53 | 13.79 |
| 58 | 1.07 | 1.44 | 0.96 | 1.10 | 1.01 | 0.95 | 1.31 |
| 59 | 2.22 | 2.90 | 2.22 | 2.83 | 2.29 | 2.15 | 2.90 |

Table 92.

TABLE 93

Measured parameters in Maize Hybrid under defoliation

| Treatment | Ecotype | | | | | |
|---|---|---|---|---|---|---|
| | Line-2 | Line-4 | Line-6 | Line-8 | Line-10 | Line-12 |
| 1 | 280.03 | 251.86 | 294.29 | 295.36 | 288.40 | 308.25 |
| 2 | 19.03 | 22.12 | 16.31 | 21.54 | 19.84 | 18.21 |
| 3 | 53.60 | 45.50 | 38.31 | 58.47 | 53.89 | 63.54 |
| 4 | 89.20 | 100.75 | 73.39 | 129.84 | 129.78 | 115.06 |
| 5 | 51.50 | 42.95 | 34.59 | 55.67 | 51.36 | 61.44 |
| 6 | 119.44 | 131.56 | 145.53 | 156.06 | 145.28 | 129.53 |
| 7 | 16.34 | 13.63 | 12.89 | 15.94 | 15.34 | 17.53 |
| 8 | 12.71 | 14.36 | 13.00 | 14.12 | 13.47 | 13.07 |
| 9 | 4.18 | 4.21 | 3.92 | 4.77 | 4.51 | 4.61 |
| 10 | 0.75 | 0.58 | 0.44 | 0.74 | 0.78 | 0.58 |
| 11 | 0.97 | 0.83 | 0.63 | 0.98 | 1.01 | 0.80 |
| 12 | 1.00 | 0.94 | 1.00 | 0.94 | 1.00 | 0.94 |
| 13 | 0.95 | 0.91 | 0.87 | 0.95 | 0.95 | 0.96 |
| 14 | 0.65 | 0.63 | 0.67 | 0.68 | 0.68 | 0.68 |
| 15 | 1.05 | 1.08 | 1.08 | 1.11 | 1.09 | 1.09 |
| 16 | 3.11 | 3.14 | 3.18 | 3.21 | 3.20 | 3.23 |
| 19 | 0.52 | 0.40 | 0.29 | 0.52 | 0.55 | 0.40 |
| 20 | 0.60 | 0.46 | 0.33 | 0.59 | 0.62 | 0.46 |
| 21 | 0.09 | 0.07 | 0.05 | 0.09 | 0.09 | 0.08 |
| 22 | 3914.00 | 3480.00 | 4276.50 | 4985.50 | 4643.50 | 4223.00 |
| 23 | 112.27 | 94.99 | 125.14 | 144.48 | 112.50 | 116.16 |
| 27 | 23.02 | 26.50 | 26.98 | 15.24 | 18.19 | 37.21 |
| 28 | 64.16 | 53.81 | 56.41 | 80.95 | 71.27 | 66.69 |
| 29 | 16.29 | 21.44 | 20.85 | 22.58 | 22.94 | 21.62 |
| 30 | 15.15 | 18.50 | 16.67 | 18.07 | 18.00 | 19.83 |
| 31 | 19.54 | 16.90 | 15.79 | 17.01 | 17.12 | 18.17 |
| 32 | 24.30 | 20.57 | 21.06 | 24.87 | 20.85 | 20.46 |
| 33 | 15.17 | 14.39 | 15.00 | 15.11 | 14.50 | 14.22 |
| 35 | 251.42 | 248.64 | 268.06 | 285.11 | 278.83 | 261.88 |
| 36 | 6.38 | 6.32 | 6.31 | 6.93 | 6.83 | 7.14 |
| 41 | 61.21 | 57.36 | 58.02 | 62.36 | 60.72 | 62.22 |
| 42 | 713.54 | 538.04 | 705.53 | 803.33 | 703.36 | 664.23 |
| 43 | 1.54 | 1.37 | 1.44 | 1.53 | 1.57 | 1.57 |
| 44 | 8.68 | 11.08 | 14.10 | 4.89 | 6.04 | 13.95 |
| 45 | 16.24 | 18.83 | 17.74 | 19.64 | 20.74 | 20.14 |
| 46 | 14.27 | 12.82 | 12.69 | 11.09 | 12.00 | 13.03 |
| 47 | 0.79 | 0.78 | 1.00 | 0.79 | 0.79 | 1.00 |
| 48 | 2.51 | 1.96 | 2.80 | 2.11 | 2.20 | 2.79 |

Table 93.

TABLE 94

Measured parameters in Maize Hybrid under defoliation, additional maize lines

| Treatment | Ecotype | | | | | | |
|---|---|---|---|---|---|---|---|
| | Line-14 | Line-16 | Line-18 | Line-21 | Line-23 | Line-25 | Line-27 |
| 1 | 230.12 | 271.25 | 259.43 | 243.98 | 262.41 | 248.64 | 244.16 |
| 2 | 19.77 | 22.44 | 20.28 | 19.64 | 22.32 | 23.31 | 27.78 |
| 3 | 39.83 | 47.33 | 65.90 | 43.83 | 43.28 | 52.30 | 58.31 |
| 4 | 85.04 | 33.10 | 161.76 | 89.36 | 87.68 | 88.18 | 124.58 |
| 5 | 36.31 | 43.34 | 64.80 | 39.56 | 40.43 | 49.28 | 55.69 |
| 6 | 123.38 | 135.00 | 136.50 | 136.39 | 130.32 | 139.71 | 143.44 |
| 7 | 13.21 | 14.82 | 17.60 | 13.78 | 13.75 | 15.53 | 14.87 |
| 8 | 14.06 | 13.75 | 13.94 | 12.79 | 13.00 | 14.29 | 15.83 |
| 9 | 4.10 | 4.20 | 4.66 | 4.06 | 4.01 | 4.41 | 4.98 |
| 10 | 0.45 | 0.63 | 0.80 | 0.54 | 0.55 | 0.51 | 0.75 |
| 11 | 0.65 | 0.82 | 1.15 | 0.88 | 0.79 | 0.69 | 0.99 |
| 12 | 0.89 | 1.00 | 0.88 | 1.00 | 1.06 | 0.94 | 1.00 |
| 13 | 0.91 | 0.91 | 0.98 | 0.89 | 0.92 | 0.94 | 0.95 |
| 14 | 0.63 | 0.61 | 0.62 | 0.62 | 0.60 | 0.58 | 0.63 |
| 15 | 1.07 | 1.02 | 1.08 | 1.05 | 1.02 | 1.00 | 1.09 |
| 16 | 3.13 | 3.02 | 3.12 | 3.09 | 3.03 | 2.98 | 3.15 |
| 19 | 0.30 | 0.44 | 0.67 | 0.36 | 0.38 | 0.34 | 0.53 |
| 20 | 0.35 | 0.50 | 0.77 | 0.41 | 0.43 | 0.39 | 0.61 |
| 21 | 0.06 | 0.07 | 0.12 | 0.06 | 0.06 | 0.06 | 0.09 |
| 22 | 3436.00 | 4593.00 | 4315.50 | 4020.50 | 4154.00 | 4851.50 | 3750.00 |
| 23 | 113.78 | 93.74 | 89.86 | 86.98 | 117.27 | 150.68 | 161.65 |
| 27 | 27.88 | 17.33 | 20.51 | 25.36 | 28.41 | 23.16 | 38.80 |
| 28 | 64.19 | 76.23 | 57.85 | 69.98 | 67.30 | 72.90 | 83.58 |
| 29 | 18.76 | 20.88 | 17.83 | 20.70 | 20.43 | 20.11 | 24.13 |
| 30 | 16.10 | 14.83 | 17.50 | 23.67 | 19.00 | 16.45 | 20.60 |
| 31 | 18.21 | 17.23 | 17.88 | 17.12 | 17.53 | 18.63 | 19.87 |
| 32 | 20.96 | 22.47 | 21.23 | 19.85 | 21.29 | 23.58 | 21.37 |
| 33 | 14.39 | 14.67 | 15.61 | 14.39 | 14.06 | 14.61 | 14.00 |
| 35 | 254.64 | 261.94 | 268.88 | 272.71 | 262.50 | 266.33 | 279.14 |
| 36 | 6.48 | 6.28 | 7.04 | 7.20 | 7.34 | 6.94 | 7.27 |
| 41 | 59.65 | 59.99 | 56.76 | 65.70 | 57.94 | 60.31 | 57.71 |
| 42 | 673.24 | 738.37 | 692.23 | 619.79 | 729.23 | 794.64 | 847.52 |
| 43 | 1.34 | 1.47 | 1.66 | 1.48 | 1.31 | 1.48 | 1.71 |
| 44 | 10.93 | 6.48 | 9.01 | 10.69 | 10.38 | 8.49 | 12.29 |
| 45 | 17.18 | 19.12 | 16.74 | 15.96 | 17.31 | 18.19 | 17.77 |
| 46 | 14.25 | 12.77 | 13.52 | 13.08 | 13.43 | 13.21 | 14.72 |
| 47 | 0.88 | 0.84 | 0.86 | 0.94 | 0.76 | 0.96 | 0.97 |
| 48 | 2.54 | 2.48 | 2.35 | 2.59 | 2.41 | 2.70 | 2.72 |

Table 94.

Tables 95 and 96 hereinbelow provide the correlations (R) between the expression levels yield improving genes and their homologs in various tissues [Expression (Exp) sets] and the phenotypic performance [yield, biomass, growth rate and/or vigor components (Correlation vector (Corr.))] under normal and defoliation conditions across maize varieties. P=p value.

TABLE 95

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM798 | 0.83 | 0.00 | 3 | 26 | LYM798 | 0.73 | 0.01 | 3 | 50 |
| LYM798 | 0.79 | 0.00 | 3 | 24 | LYM798 | 0.78 | 0.00 | 3 | 32 |
| LYM798 | 0.79 | 0.00 | 2 | 25 | LYM798 | 0.75 | 0.01 | 1 | 9 |
| LYM799 | 0.78 | 0.00 | 3 | 16 | LYM799 | 0.75 | 0.01 | 3 | 17 |
| LYM799 | 0.73 | 0.01 | 3 | 33 | LYM799 | 0.82 | 0.00 | 1 | 29 |
| LYM800 | 0.75 | 0.00 | 3 | 28 | LYM801 | 0.75 | 0.01 | 2 | 5 |
| LYM801 | 0.77 | 0.01 | 2 | 3 | LYM801 | 0.86 | 0.00 | 2 | 7 |
| LYM802 | 0.77 | 0.01 | 2 | 9 | LYM802 | 0.80 | 0.00 | 1 | 9 |
| LYM803 | 0.73 | 0.01 | 3 | 17 | LYM803 | 0.83 | 0.00 | 3 | 15 |
| LYM803 | 0.73 | 0.01 | 3 | 1 | LYM803 | 0.81 | 0.00 | 3 | 20 |
| LYM803 | 0.74 | 0.01 | 3 | 52 | LYM803 | 0.76 | 0.00 | 3 | 10 |
| LYM803 | 0.81 | 0.00 | 3 | 21 | LYM803 | 0.76 | 0.00 | 3 | 12 |
| LYM803 | 0.81 | 0.00 | 3 | 22 | LYM803 | 0.72 | 0.02 | 2 | 3 |
| LYM803 | 0.73 | 0.01 | 2 | 23 | LYM803 | 0.95 | 0.00 | 2 | 7 |
| LYM803 | 0.73 | 0.01 | 1 | 57 | LYM803 | 0.73 | 0.01 | 1 | 52 |
| LYM804 | 0.81 | 0.00 | 1 | 1 | LYM804 | 0.75 | 0.00 | 1 | 19 |
| LYM805 | 0.85 | 0.00 | 2 | 12 | LYM806 | 0.73 | 0.01 | 1 | 31 |
| LYM808 | 0.74 | 0.01 | 3 | 36 | LYM808 | 0.74 | 0.01 | 3 | 43 |
| LYM808 | 0.71 | 0.01 | 3 | 37 | LYM808 | 0.70 | 0.02 | 2 | 25 |
| LYM808 | 0.79 | 0.00 | 2 | 43 | LYM808 | 0.76 | 0.01 | 1 | 14 |
| LYM808 | 0.75 | 0.01 | 1 | 4 | LYM809 | 0.77 | 0.00 | 1 | 41 |
| LYM809 | 0.88 | 0.00 | 3 | 33 | LYM809 | 0.71 | 0.01 | 2 | 40 |
| LYM809 | 0.83 | 0.00 | 2 | 19 | LYM809 | 0.73 | 0.02 | 2 | 7 |
| | | | | | LYM811 | 0.75 | 0.01 | 2 | 55 |
| LYM811 | 0.91 | 0.00 | 2 | 44 | LYM811 | 0.74 | 0.01 | 2 | 43 |
| LYM812 | 0.73 | 0.01 | 2 | 25 | LYM812 | 0.75 | 0.01 | 2 | 23 |
| LYM812 | 0.73 | 0.01 | 2 | 38 | LYM812 | 0.78 | 0.00 | 1 | 53 |
| LYM812 | 0.71 | 0.01 | 1 | 56 | LYM812 | 0.84 | 0.00 | 1 | 36 |
| LYM812 | 0.75 | 0.01 | 1 | 57 | LYM812 | 0.74 | 0.01 | 1 | 49 |
| LYM812 | 0.77 | 0.00 | 1 | 37 | LYM812 | 0.77 | 0.00 | 1 | 30 |
| LYM813 | 0.71 | 0.01 | 3 | 19 | LYM813 | 0.76 | 0.01 | 3 | 7 |
| LYM813 | 0.70 | 0.02 | 2 | 5 | LYM815 | 0.72 | 0.01 | 1 | 48 |
| LYM815 | 0.71 | 0.01 | 1 | 58 | LYM816 | 0.74 | 0.01 | 2 | 5 |
| LYM816 | 0.78 | 0.01 | 2 | 3 | LYM816 | 0.94 | 0.00 | 2 | 7 |
| LYM817 | 0.74 | 0.01 | 1 | 49 | LYM817 | 0.72 | 0.01 | 1 | 12 |
| LYM817 | 0.70 | 0.01 | 1 | 30 | LYM818 | 0.78 | 0.00 | 3 | 8 |

TABLE 95-continued

Correlation between the expression level of selected genes of some embodiments of the invention in various tissues and the phenotypic performance under normal conditions across maize varieties

| Gene Name | R | P value | Exp. set | Corr. Set ID | Gene Name | R | P value | Exp. set | Corr. Set ID |
|---|---|---|---|---|---|---|---|---|---|
| LYM818 | 0.80 | 0.00 | 2 | 50 | LYM818 | 0.76 | 0.01 | 2 | 32 |
| LYM819 | 0.72 | 0.01 | 2 | 19 | LYM819 | 0.77 | 0.00 | 1 | 12 |
| LYM820 | 0.70 | 0.01 | 3 | 2 | LYM820 | 0.70 | 0.01 | 3 | 20 |
| LYM820 | 0.70 | 0.01 | 3 | 22 | LYM820 | 0.73 | 0.01 | 2 | 1 |
| LYM820 | 0.88 | 0.00 | 2 | 23 | LYM820 | 0.70 | 0.01 | 1 | 31 |
| LYM821 | 0.73 | 0.01 | 3 | 15 | LYM821 | 0.70 | 0.01 | 3 | 1 |
| LYM821 | 0.88 | 0.00 | 3 | 19 | LYM821 | 0.93 | 0.00 | 2 | 19 |
| LYM821 | 0.79 | 0.01 | 2 | 7 | LYM822 | 0.72 | 0.01 | 3 | 55 |
| LYM822 | 0.84 | 0.00 | 2 | 5 | LYM822 | 0.85 | 0.00 | 2 | 3 |
| LYM822 | 0.83 | 0.00 | 2 | 7 | LYM824 | 0.86 | 0.00 | 1 | 40 |
| LYM825 | 0.72 | 0.01 | 2 | 26 | LYM825 | 0.73 | 0.01 | 2 | 44 |
| LYM825 | 0.77 | 0.01 | 2 | 50 | LYM825 | 0.80 | 0.00 | 2 | 48 |
| LYM825 | 0.75 | 0.01 | 2 | 32 | LYM826 | 0.72 | 0.01 | 3 | 28 |
| LYM827 | 0.74 | 0.01 | 3 | 25 | LYM827 | 0.77 | 0.00 | 3 | 36 |
| LYM827 | 0.77 | 0.00 | 3 | 15 | LYM827 | 0.72 | 0.01 | 3 | 43 |
| LYM827 | 0.77 | 0.00 | 3 | 49 | LYM827 | 0.81 | 0.00 | 3 | 19 |
| LYM827 | 0.74 | 0.01 | 3 | 59 | LYM827 | 0.76 | 0.00 | 3 | 30 |
| LYM827 | 0.71 | 0.01 | 2 | 25 | LYM827 | 0.77 | 0.01 | 2 | 36 |
| LYM827 | 0.73 | 0.01 | 1 | 48 | LYM827 | 0.74 | 0.01 | 1 | 43 |
| LYM827 | 0.73 | 0.01 | 1 | 49 | LYM827 | 0.71 | 0.01 | 1 | 52 |
| LYM827 | 0.70 | 0.01 | 1 | 12 | LYM827 | 0.72 | 0.01 | 1 | 30 |
| LYM828 | 0.76 | 0.01 | 2 | 2 | LYM828 | 0.75 | 0.01 | 2 | 14 |
| LYM828 | 0.82 | 0.00 | 2 | 4 | LYM829 | 0.79 | 0.00 | 3 | 12 |
| LYM830 | 0.71 | 0.01 | 3 | 55 | LYM831 | 0.70 | 0.02 | 3 | 9 |
| LYM832 | 0.71 | 0.01 | 2 | 25 | LYM832 | 0.75 | 0.01 | 2 | 23 |
| LYM832 | 0.81 | 0.00 | 1 | 1 | LYM833 | 0.87 | 0.00 | 1 | 1 |
| LYM833 | 0.73 | 0.01 | 1 | 19 | LYM834 | 0.83 | 0.00 | 3 | 14 |
| LYM836 | 0.81 | 0.00 | 1 | 13 | LYM837 | 0.73 | 0.01 | 3 | 24 |
| LYM837 | 0.77 | 0.00 | 3 | 20 | LYM837 | 0.74 | 0.01 | 3 | 10 |
| LYM837 | 0.76 | 0.00 | 3 | 21 | LYM837 | 0.77 | 0.00 | 3 | 22 |
| LYM837 | 0.73 | 0.01 | 1 | 49 | LYM838 | 0.81 | 0.00 | 3 | 55 |
| LYM838 | 0.71 | 0.01 | 3 | 34 | LYM838 | 0.74 | 0.01 | 3 | 54 |
| LYM838 | 0.73 | 0.01 | 3 | 33 | LYM838 | 0.80 | 0.01 | 2 | 5 |
| LYM838 | 0.74 | 0.01 | 2 | 50 | LYM838 | 0.79 | 0.01 | 2 | 3 |
| LYM838 | 0.79 | 0.01 | 2 | 7 | LYM839 | 0.75 | 0.01 | 2 | 5 |
| LYM839 | 0.72 | 0.02 | 2 | 3 | LYM839 | 0.71 | 0.01 | 1 | 8 |
| LYM841 | 0.71 | 0.01 | 3 | 27 | LYM841 | 0.78 | 0.00 | 2 | 55 |
| LYM841 | 0.77 | 0.01 | 2 | 44 | LYM841 | 0.79 | 0.00 | 1 | 36 |
| LYM841 | 0.71 | 0.01 | 1 | 57 | LYM841 | 0.76 | 0.00 | 1 | 20 |
| LYM841 | 0.70 | 0.01 | 1 | 10 | LYM841 | 0.75 | 0.00 | 1 | 21 |
| LYM841 | 0.76 | 0.00 | 1 | 22 | LYM842 | 0.76 | 0.00 | 3 | 13 |
| LYM842 | 0.75 | 0.01 | 2 | 2 | LYM842 | 0.72 | 0.01 | 2 | 51 |
| LYM842 | 0.76 | 0.01 | 2 | 59 | LYM842 | 0.72 | 0.01 | 1 | 8 |
| LYM843 | 0.78 | 0.00 | 2 | 1 | LYM843 | 0.86 | 0.00 | 2 | 19 |
| LYM843 | 0.78 | 0.00 | 2 | 27 | LYM843 | 0.71 | 0.01 | 1 | 15 |
| LYM843 | 0.82 | 0.00 | 1 | 19 | LYM844 | 0.70 | 0.01 | 3 | 39 |
| LYM844 | 0.70 | 0.01 | 3 | 52 | LYM844 | 0.83 | 0.00 | 2 | 39 |
| LYM844 | 0.82 | 0.00 | 2 | 12 | LYM845 | 0.75 | 0.01 | 2 | 1 |
| LYM845 | 0.70 | 0.02 | 2 | 19 | LYM846 | 0.78 | 0.00 | 3 | 45 |
| LYM846 | 0.89 | 0.00 | 3 | 12 | LYM846 | 0.74 | 0.01 | 3 | 46 |
| LYM846 | 0.73 | 0.01 | 2 | 33 | LYM847 | 0.76 | 0.01 | 2 | 39 |
| LYM848 | 0.78 | 0.00 | 3 | 8 | LYM849 | 0.77 | 0.00 | 3 | 50 |
| LYM849 | 0.71 | 0.01 | 2 | 51 | LYM849 | 0.83 | 0.00 | 2 | 59 |
| LYM849 | 0.78 | 0.00 | 2 | 58 | LYM850 | 0.81 | 0.00 | 3 | 46 |
| LYM850 | 0.77 | 0.01 | 2 | 7 | LYM851 | 0.78 | 0.00 | 3 | 28 |
| LYM851 | 0.75 | 0.01 | 3 | 50 | LYM851 | 0.86 | 0.00 | 3 | 32 |
| LYM851 | 0.71 | 0.02 | 2 | 39 | LYM851 | 0.71 | 0.01 | 1 | 28 |
| LYM852 | 0.70 | 0.01 | 3 | 44 | LYM852 | 0.72 | 0.01 | 3 | 45 |
| LYM852 | 0.77 | 0.00 | 3 | 33 | LYM852 | 0.76 | 0.00 | 3 | 6 |
|  |  |  |  |  | LYM857 | 0.71 | 0.01 | 1 | 8 |
| LYM858 | 0.81 | 0.00 | 3 | 16 | LYM858 | 0.79 | 0.00 | 3 | 17 |
| LYM858 | 0.82 | 0.00 | 3 | 36 | LYM858 | 0.72 | 0.01 | 3 | 32 |
| LYM858 | 0.75 | 0.00 | 3 | 20 | LYM858 | 0.75 | 0.01 | 3 | 21 |
| LYM858 | 0.75 | 0.00 | 3 | 22 | LYM859 | 0.70 | 0.02 | 2 | 12 |
| LYM859 | 0.81 | 0.00 | 1 | 28 |  |  |  |  |  |

Table 95.

TABLE 96

Correlation between the expression level of selected genes of some embodiments of the invention in various tissues and the phenotypic performance under normal defoliation across maize varieties

| Gene Name | R | P value | Exp. set | Corr. Set ID | Gene Name | R | P value | Exp. set | Corr. Set ID |
|---|---|---|---|---|---|---|---|---|---|
| LYM798 | 0.76 | 0.00 | 3 | 14 | LYM798 | 0.74 | 0.01 | 3 | 1 |
| LYM799 | 0.79 | 0.00 | 3 | 45 | LYM799 | 0.71 | 0.01 | 1 | 41 |
| LYM799 | 0.74 | 0.01 | 1 | 40 | LYM799 | 0.78 | 0.00 | 1 | 30 |
| LYM799 | 0.71 | 0.01 | 2 | 46 | LYM800 | 0.79 | 0.00 | 3 | 24 |
| LYM800 | 0.72 | 0.01 | 2 | 24 | LYM801 | 0.73 | 0.01 | 1 | 30 |
| LYM801 | 0.78 | 0.00 | 2 | 23 | LYM802 | 0.75 | 0.00 | 1 | 22 |
| LYM803 | 0.79 | 0.00 | 3 | 46 | LYM803 | 0.74 | 0.01 | 3 | 31 |
| LYM803 | 0.79 | 0.00 | 3 | 47 | LYM803 | 0.77 | 0.00 | 3 | 7 |
| LYM803 | 0.76 | 0.00 | 1 | 15 | LYM803 | 0.82 | 0.00 | 1 | 43 |
| LYM803 | 0.70 | 0.01 | 1 | 31 | LYM803 | 0.72 | 0.01 | 2 | 46 |
| LYM804 | 0.83 | 0.00 | 3 | 1 | LYM804 | 0.73 | 0.01 | 3 | 18 |
| LYM804 | 0.70 | 0.01 | 1 | 32 | LYM808 | 0.83 | 0.00 | 3 | 31 |
| LYM808 | 0.70 | 0.01 | 2 | 46 | LYM808 | 0.70 | 0.01 | 2 | 31 |
| LYM809 | 0.83 | 0.00 | 3 | 45 | LYM809 | 0.78 | 0.00 | 2 | 12 |
| | | | | | LYM812 | 0.74 | 0.01 | 3 | 34 |
| LYM812 | 0.76 | 0.00 | 1 | 26 | LYM813 | 0.70 | 0.01 | 3 | 45 |
| LYM813 | 0.74 | 0.01 | 3 | 37 | LYM813 | 0.78 | 0.00 | 3 | 1 |
| LYM813 | 0.76 | 0.00 | 1 | 18 | LYM814 | 0.75 | 0.00 | 2 | 22 |
| LYM815 | 0.80 | 0.00 | 3 | 45 | LYM815 | 0.85 | 0.00 | 2 | 12 |
| LYM816 | 0.74 | 0.01 | 3 | 30 | LYM817 | 0.80 | 0.00 | 3 | 39 |
| LYM818 | 0.74 | 0.01 | 3 | 2 | LYM818 | 0.77 | 0.00 | 3 | 27 |
| LYM818 | 0.73 | 0.01 | 1 | 2 | LYM818 | 0.81 | 0.00 | 2 | 2 |
| LYM820 | 0.70 | 0.01 | 1 | 7 | LYM820 | 0.80 | 0.00 | 2 | 33 |
| LYM820 | 0.72 | 0.01 | 2 | 5 | LYM820 | 0.71 | 0.01 | 2 | 3 |
| LYM820 | 0.75 | 0.01 | 2 | 32 | LYM820 | 0.73 | 0.01 | 2 | 7 |
| LYM821 | 0.74 | 0.01 | 3 | 7 | LYM822 | 0.72 | 0.01 | 3 | 2 |
| LYM822 | 0.74 | 0.01 | 3 | 38 | LYM822 | 0.75 | 0.01 | 3 | 39 |
| LYM822 | 0.71 | 0.01 | 1 | 48 | LYM822 | 0.77 | 0.00 | 1 | 40 |
| LYM822 | 0.72 | 0.01 | 1 | 36 | LYM822 | 0.77 | 0.00 | 1 | 30 |
| LYM823 | 0.74 | 0.01 | 2 | 5 | LYM823 | 0.78 | 0.00 | 2 | 4 |
| LYM823 | 0.74 | 0.01 | 2 | 3 | LYM823 | 0.74 | 0.01 | 2 | 21 |
| LYM824 | 0.87 | 0.00 | 3 | 23 | LYM824 | 0.75 | 0.01 | 3 | 42 |
| LYM824 | 0.71 | 0.01 | 3 | 31 | LYM824 | 0.79 | 0.00 | 1 | 32 |
| LYM824 | 0.79 | 0.00 | 2 | 37 | LYM825 | 0.76 | 0.00 | 3 | 29 |
| LYM825 | 0.75 | 0.01 | 3 | 33 | LYM825 | 0.77 | 0.00 | 3 | 5 |
| LYM825 | 0.75 | 0.01 | 3 | 13 | LYM825 | 0.80 | 0.00 | 3 | 43 |
| LYM825 | 0.77 | 0.00 | 3 | 3 | LYM825 | 0.74 | 0.01 | 3 | 7 |
| LYM825 | 0.75 | 0.00 | 3 | 21 | LYM825 | 0.72 | 0.01 | 1 | 41 |
| LYM825 | 0.75 | 0.00 | 2 | 33 | LYM825 | 0.78 | 0.00 | 2 | 7 |
| LYM827 | 0.71 | 0.01 | 3 | 43 | LYM827 | 0.80 | 0.00 | 3 | 18 |
| LYM827 | 0.77 | 0.00 | 1 | 12 | LYM828 | 0.72 | 0.01 | 3 | 23 |
| LYM828 | 0.79 | 0.00 | 1 | 2 | LYM828 | 0.71 | 0.01 | 2 | 38 |
| LYM828 | 0.78 | 0.00 | 2 | 47 | LYM828 | 0.73 | 0.01 | 2 | 27 |
| LYM829 | 0.71 | 0.01 | 3 | 41 | LYM830 | 0.72 | 0.01 | 3 | 1 |
| LYM830 | 0.71 | 0.01 | 1 | 1 | LYM831 | 0.73 | 0.01 | 1 | 14 |
| LYM831 | 0.75 | 0.01 | 1 | 1 | LYM831 | 0.86 | 0.00 | 1 | 18 |
| LYM831 | 0.74 | 0.01 | 2 | 36 | LYM832 | 0.71 | 0.01 | 3 | 26 |
| LYM832 | 0.71 | 0.01 | 1 | 34 | LYM833 | 0.72 | 0.01 | 2 | 7 |
| LYM835 | 0.72 | 0.01 | 3 | 14 | LYM835 | 0.75 | 0.00 | 3 | 1 |
| LYM835 | 0.72 | 0.01 | 3 | 10 | LYM835 | 0.76 | 0.00 | 2 | 17 |
| LYM836 | 0.87 | 0.00 | 1 | 18 | LYM837 | 0.76 | 0.00 | 1 | 2 |
| LYM837 | 0.72 | 0.01 | 1 | 13 | LYM837 | 0.71 | 0.01 | 1 | 43 |
| LYM837 | 0.76 | 0.00 | 1 | 38 | LYM837 | 0.86 | 0.00 | 1 | 11 |
| LYM837 | 0.78 | 0.00 | 1 | 4 | LYM837 | 0.84 | 0.00 | 1 | 8 |
| LYM837 | 0.89 | 0.00 | 1 | 19 | LYM837 | 0.87 | 0.00 | 1 | 10 |
| LYM837 | 0.88 | 0.00 | 1 | 20 | LYM837 | 0.84 | 0.00 | 1 | 21 |
| LYM838 | 0.75 | 0.00 | 3 | 45 | LYM838 | 0.72 | 0.01 | 3 | 1 |
| LYM839 | 0.72 | 0.01 | 3 | 1 | LYM839 | 0.72 | 0.01 | 3 | 7 |
| LYM839 | 0.71 | 0.01 | 1 | 16 | LYM839 | 0.75 | 0.01 | 1 | 11 |
| LYM839 | 0.74 | 0.01 | 1 | 14 | LYM839 | 0.71 | 0.01 | 1 | 1 |
| LYM839 | 0.78 | 0.00 | 1 | 4 | LYM839 | 0.75 | 0.01 | 1 | 19 |
| LYM839 | 0.75 | 0.01 | 1 | 20 | LYM839 | 0.82 | 0.00 | 1 | 21 |
| LYM840 | 0.75 | 0.01 | 1 | 35 | LYM840 | 0.84 | 0.00 | 1 | 4 |
| LYM840 | 0.72 | 0.01 | 2 | 4 | LYM843 | 0.74 | 0.01 | 1 | 43 |
| LYM843 | 0.75 | 0.01 | 1 | 1 | LYM843 | 0.74 | 0.01 | 1 | 40 |
| LYM843 | 0.74 | 0.01 | 2 | 45 | LYM843 | 0.72 | 0.01 | 2 | 14 |
| LYM843 | 0.85 | 0.00 | 2 | 1 | LYM845 | 0.78 | 0.00 | 3 | 1 |
| LYM845 | 0.77 | 0.00 | 1 | 45 | LYM845 | 0.71 | 0.01 | 1 | 14 |
| LYM845 | 0.77 | 0.00 | 1 | 1 | LYM846 | 0.72 | 0.01 | 3 | 1 |
| LYM846 | 0.76 | 0.00 | 1 | 41 | LYM851 | 0.79 | 0.00 | 3 | 2 |
| LYM851 | 0.71 | 0.01 | 3 | 38 | LYM851 | 0.74 | 0.01 | 3 | 39 |
| LYM851 | 0.70 | 0.01 | 1 | 21 | LYM852 | 0.85 | 0.00 | 2 | 40 |

TABLE 96-continued

Correlation between the expression level of selected genes of some embodiments of the invention in various tissues and the phenotypic performance under normal defoliation across maize varieties

| Gene Name | R | P value | Exp. set | Corr. Set ID | Gene Name | R | P value | Exp. set | Corr. Set ID |
|---|---|---|---|---|---|---|---|---|---|
| LYM852 | 0.85 | 0.00 | 2 | 36 | LYM852 | 0.75 | 0.00 | 2 | 30 |
|  |  |  |  |  | LYM855 | 0.71 | 0.01 | 3 | 14 |
| LYM855 | 0.81 | 0.00 | 1 | 39 | LYM856 | 0.76 | 0.00 | 1 | 41 |
| LYM856 | 0.74 | 0.01 | 2 | 23 | LYM856 | 0.76 | 0.00 | 2 | 31 |
| LYM857 | 0.75 | 0.01 | 3 | 18 | LYM857 | 0.79 | 0.00 | 3 | 24 |
| LYM857 | 0.70 | 0.01 | 3 | 8 | LYM857 | 0.76 | 0.00 | 1 | 41 |
| LYM857 | 0.71 | 0.01 | 2 | 16 | LYM857 | 0.76 | 0.00 | 2 | 14 |
| LYM858 | 0.73 | 0.01 | 1 | 32 | LYM858 | 0.76 | 0.00 | 2 | 23 |
| LYM858 | 0.77 | 0.00 | 2 | 2 | LYM858 | 0.73 | 0.01 | 2 | 31 |
| LYM858 | 0.81 | 0.00 | 2 | 8 | LYM859 | 0.80 | 0.00 | 3 | 22 |
| LYM858 | 0.73 | 0.01 | 1 | 32 | LYM858 | 0.76 | 0.00 | 2 | 23 |
| LYM858 | 0.77 | 0.00 | 2 | 2 | LYM858 | 0.73 | 0.01 | 2 | 31 |
| LYM858 | 0.81 | 0.00 | 2 | 8 | LYM859 | 0.80 | 0.00 | 3 | 22 |
| LYM901_H1 | 0.74 | 0.005 | 1 | 27 | LYM901_H1 | 0.70 | 0.011 | 1 | 7 |
| LYM901_H1 | 0.89 | 0.000 | 1 | 1 | LYM901_H1 | 0.86 | 0.000 | 3 | 45 |
| LYM901_H1 | 0.80 | 0.001 | 3 | 1 | LYM964_H1 | 0.72 | 8.67E−03 | 1 | 30 |
| LYM964_H1 | 0.71 | 9.36E−03 | 1 | 44 | LYM830_H4 | 0.75 | 4.54E−03 | 1 | 33 |
| LYM964_H1 | 0.71 | 9.81E−03 | 1 | 47 | LYM964_H1 | 0.73 | 6.84E−03 | 1 | 48 |
| LYM964_H1 | 0.74 | 5.75E−03 | 1 | 27 |  |  |  |  |  |

Table 96.

Example 16

Gene Cloning and Generation of Binary Vectors for Plant Expression

To validate their role in improving yield, selected genes were over-expressed in plants, as follows.

Cloning Strategy

Selected genes from those presented in Examples 1-14 hereinabove were cloned into binary vectors for the generation of transgenic plants. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from leaves, roots or other plant tissues, growing under normal/limiting or stress conditions. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York.) which are well known to those skilled in the art. PCR products were purified using PCR purification kit (Qiagen).

Usually, 2 sets of primers were prepared for the amplification of each gene, via nested PCR (if required). Both sets of primers were used for amplification on cDNA. In case no product was obtained, a nested PCR reaction was performed. Nested PCR was performed by amplification of the gene using external primers and then using the produced PCR product as a template for a second PCR reaction, where the internal set of primers were used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer to extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc) according to the sites designed in the primers. Each digested PCR product was inserted into a high copy vector pUC19 (New England BioLabs Inc], or into plasmids originating from this vector. In some cases the undigested PCR product was inserted into pCR-Blunt II-TOPO (Invitrogen) or into pJET1.2 (CloneJET PCR Cloning Kit, Thermo Scientific) or directly into the binary vector. The digested products and the linearized plasmid vector were ligated using T4 DNA ligase enzyme (Roche, Switzerland).

Sequencing of the inserted genes was performed, using the ABI 377 sequencer (Applied Biosystems). In some cases, after confirming the sequences of the cloned genes, the cloned cDNA was introduced into a modified pGI binary vector containing the At6669 promoter (e.g., pQFNc) and the NOS terminator (SEQ ID NO: 10586) via digestion with appropriate restriction endonucleases.

Several DNA sequences of the selected genes were synthesized by GeneArt (Life Technologies) [Hypertext Transfer Protocol://World Wide Web (dot) geneart (dot) com/]. Synthetic DNA was designed in silico. Suitable restriction enzymes sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQYN_6669, pQNa_RP, pQFYN or pQXNc) is a modified version of the pGI vector in which the cassette is inverted between the left and right borders so the gene and its corresponding promoter are close to the right border and the NPTII gene is close to the left border.

At6669, the new *Arabidopsis thaliana* promoter sequence (SEQ ID NO:10575) was inserted in the modified pGI binary vector, upstream to the cloned genes, followed by DNA ligation and binary plasmid extraction from positive *E. coli* colonies, as described above. Colonies were analyzed by PCR using the primers covering the insert which were designed to span the introduced promoter and gene. Positive plasmids were identified, isolated and sequenced.

In case genomic DNA was cloned, the genes were amplified by direct PCR on genomic DNA extracted from leaf tissue using the DNAeasy kit (Qiagen Cat. No. 69104).

Selected genes cloned by the present inventors are provided in Table 97 below.

TABLE 97

Cloning of genes of some embodiments of the invention

| Gene Name | High copy plasmid | Organism | Primers used SEQ ID NOs: | Polynucleotide SEQ ID NO: | Polypeptide SEQ ID NO: |
| --- | --- | --- | --- | --- | --- |
| LYM1000 | pQFNc_LYM1000 | WHEAT *Triticum aestivum* L. | 10587, 10815, 10587, 10815 | 557 | 926 |
| LYM1002 | pUC19c_LYM1002 | WHEAT *Triticum aestivum* L. | 10588, 10816, 10588, 10816 | 558 | 927 |
| LYM1003 | pUC19c_LYM1003 | WHEAT *Triticum aestivum* L. | 10589, 10817, 10589, 10817 | 559 | 813 |
| LYM1004 | pQFNc_LYM1004 | WHEAT *Triticum aestivum* L. | 10590, 10818, 10590, 10818 | 560 | 928 |
| LYM1005 | pUC19c_LYM1005 | WHEAT *Triticum aestivum* L. | 10591, 10819, 10591, 10819 | 561 | 929 |
| LYM1006 | pQFNc_LYM1006 | WHEAT *Triticum aestivum* L. | 10592, 10820, 10592, 10820 | 562 | 930 |
| LYM1007_H2 | pMA-RQ_LYM1007_H2_GA | | | 565 | 820 |
| LYM1008 | pQFNc_LYM1008 | RICE *Oryza sativa* L. | 10593, 10821, 11043, 11131 | 563 | 818 |
| LYM1009 | pQFNc_LYM1009 | SORGHUM *Sorghum bicolor* | 10594, 10822, 11044, 11132 | 564 | 819 |
| LYM751 | pQFNc_LYM751 | ARABIDOPSIS *Arabidopsis thalia* | 10595, 10823 | 334 | 574 |
| LYM752 | pQFNc_LYM752 | ARABIDOPSIS *Arabidopsis thalia* | 10596, 10824, 11045, 11133 | 335 | 575 |
| LYM753 | pUC19c_LYM753 | ARABIDOPSIS *Arabidopsis thalia* | 10597, 10825, 11046, 11134 | 336 | 576 |
| LYM754 | pQFNc_LYM754 | ARABIDOPSIS *Arabidopsis thalia* | 10598, 10826, 11047, 11135 | 337 | 577 |
| LYM755 | pUC19c_LYM755 | BARLEY *Hordeum vulgare* L. | 10599, 10827, 11048, 11136 | 338 | 578 |
| LYM756 | pUC19c_LYM756 | BARLEY *Hordeum vulgare* L. | 10600, 10828, 10600, 10828 | 339 | 864 |
| LYM757 | pUC19c_LYM757 | BARLEY *Hordeum vulgare* L. | 10601, 10829, 11049, 11137 | 340 | 580 |
| LYM758 | pUC19c_LYM758 | BARLEY *Hordeum vulgare* L. | 10602, 10830, 10602, 10830 | 341 | 581 |
| LYM759 | pUC19c_LYM759 | BARLEY *Hordeum vulgare* L. | 10603, 10831, 11603, 11138 | 342 | 582 |
| LYM760 | pUC19c_LYM760 | BARLEY *Hordeum vulgare* L. | 10604, 10832, 10604, 11139 | 343 | 583 |
| LYM761 | pUC19c_LYM761 | BARLEY *Hordeum vulgare* L. | 10605, 10833, 10605, 10833 | 344 | 584 |
| LYM762 | pQFNc_LYM762 | BARLEY *Hordeum vulgare* L. | 10606, 10834, 10606, 10834 | 345 | 585 |
| LYM763 | pQFNc_LYM763 | BARLEY *Hordeum vulgare* L. | 10607, 10835, 10607, 10835 | 346 | 586 |
| LYM764 | pQFNc_LYM764 | BARLEY *Hordeum vulgare* L. | 10608, 10836, 11050, 11140 | 347 | 587 |
| LYM765 | pQFNc_LYM765 | BRACHYPODIUM *Brachypodiums dis* | 10609, 10837, 11051, 11141 | 348 | 588 |
| LYM766 | pUC19c_LYM766 | BRACHYPODIUM *Brachypodiums dis* | 10610, 10838, 10610, 10838 | 349 | 589 |
| LYM767 | pUC19c_LYM767 | BRACHYPODIUM *Brachypodiums dis* | 10611, 10839, 11052, 11142 | 350 | 865 |
| LYM768 | pUC19c_LYM768 | BRACHYPODIUM *Brachypodiums dis* | 10612, 10840, 10612, 10840 | 351 | 866 |
| LYM769 | pQFNc_LYM769 | BRACHYPODIUM *Brachypodiums dis* | 10613, 10841, 11053, 11143 | 352 | 592 |
| LYM770 | pUC19c_LYM770 | BRACHYPODIUM *Brachypodiums dis* | 10614, 10842, 11054, 11144 | 353 | 867 |
| LYM771 | pJET_LYM771 | BRACHYPODIUM *Brachypodiums dis* | 10615, 10843, 11055, 11145 | 354 | 868 |
| LYM773 | TopoB_LYM773 | BRACHYPODIUM *Brachypodiums dis* | 10616, 10844, 10616, 10844 | 355 | 596 |
| LYM774 | pUC19c_LYM774 | FOXTAIL *Setaria italica* | 10617, 10845, 10617, 10845 | 356 | 597 |
| LYM775 | pUC19c_LYM775 | FOXTAIL *Setaria italica* | 10618, 10846, 11056, 11146 | 357 | 598 |
| LYM776 | pQFNc_LYM776 | FOXTAIL *Setaria italica* | 10619, 10847, 11057, 11147 | 358 | 869 |
| LYM777 | pUC19c_LYM777 | FOXTAIL *Setaria italica* | 10620, 10848, 10620, 10848 | 359 | 600 |
| LYM778 | pUC19_LYM778 | FOXTAIL *Setaria italica* | 10621, 10849, 10621, 10849 | 360 | 870 |
| LYM779 | pQFNc_LYM779 | FOXTAIL *Setaria italica* | 10622, 10850, 11058, 11148 | 361 | 602 |
| LYM780 | pQFNc_LYM780 | FOXTAIL *Setaria italica* | 10623, 10851, 10623, 10851 | 362 | 603 |
| LYM781 | pUC19c_LYM781 | FOXTAIL *Setaria italica* | 10624, 10852, 11059, 11149 | 363 | 604 |
| LYM782 | pQFNc_LYM782 | FOXTAIL *Setaria italica* | 10625, 10853, 10625, 10853 | 364 | 605 |
| LYM783 | pUC19c_LYM783 | FOXTAIL *Setaria italica* | 10626, 10854, 10626, 10854 | 365 | 606 |
| LYM784 | pQFNc_LYM784 | FOXTAIL *Setaria italica* | 10627, 10855 | 366 | 607 |
| LYM785 | pMA-RQ_LYM785_GA | | | 367 | 608 |
| LYM786 | pUC19c_LYM786 | FOXTAIL *Setaria italica* | 10628, 10856, 10628, 10856 | 368 | 609 |
| LYM787 | pQFNc_LYM787 | FOXTAIL *Setaria italica* | 10629, 10857, 10629, 10857 | 369 | 610 |
| LYM788 | pUC19c_LYM788 | FOXTAIL *Setaria italica* | 10630, 10858, 11060, 11150 | 370 | 611 |
| LYM789 | pUC19c_LYM789 | FOXTAIL *Setaria italica* | 10631, 10859, 10631, 10859 | 371 | 612 |
| LYM790 | pUC19_LYM790 | FOXTAIL *Setaria italica* | 10632, 10860, 10632, 10860 | 372 | 613 |

TABLE 97-continued

Cloning of genes of some embodiments of the invention

| Gene Name | High copy plasmid | Organism | Primers used SEQ ID NOs: | Polynucleotide SEQ ID NO: | Polypeptide SEQ ID NO: |
|---|---|---|---|---|---|
| LYM791 | pUC19c_LYM791 | FOXTAIL *Setaria italica* | 10633, 10861, 11061, 11151 | 373 | 614 |
| LYM792 | pUC19c_LYM792 | FOXTAIL *Setaria italica* | 10634, 10862, 10634, 10862 | 374 | 615 |
| LYM793 | pUC19c_LYM793 | FOXTAIL *Setaria italica* | 10635, 10863, 10635, 10863 | 375 | 616 |
| LYM794 | pUC19c_LYM794 | FOXTAIL *Setaria italica* | 10636, 10864, 10636, 10864 | 376 | 871 |
| LYM795 | pUC19c_LYM795 | FOXTAIL *Setaria italica* | 10637, 10865, 10637, 10865 | 377 | 618 |
| LYM796 | pQFNc_LYM796 | FOXTAIL *Setaria italica* | 10638, 10866, 10638, 10866 | 378 | 619 |
| LYM797 | pUC19c_LYM797 | FOXTAIL *Setaria italica* | 10639, 10867, 11062, 11152 | 379 | 620 |
| LYM798 | pMA_LYM798_GA | | | 380 | 621 |
| LYM799 | pUC19c_LYM799 | MAIZE *Zea mays* L. | 10640, 10868, 11063, 11153 | 381 | 622 |
| LYM800 | pQFNc_LYM800 | MAIZE *Zea mays* L. | 10641, 10869, 10641, 10869 | 382 | 872 |
| LYM801 | pUC19c_LYM801 | MAIZE *Zea mays* L. | 10642, 10870, 10642, 10870 | 383 | 873 |
| LYM802 | pUC19c_LYM802 | MAIZE *Zea mays* L. | 10643, 10871, 10643, 11154 | 384 | 625 |
| LYM803 | pQFNc_LYM803 | MAIZE *Zea mays* L. | 10644, 10872, 11064, 11155 | 385 | 626 |
| LYM804 | pQFNc_LYM804 | MAIZE *Zea mays* L. | 10645, 10873, 10645, 10873 | 386 | 627 |
| LYM805 | pQFNc_LYM805 | MAIZE *Zea mays* L. | 10646, 10874, 10646, 10874 | 387 | 874 |
| LYM806 | pUC19c_LYM806 | MAIZE *Zea mays* L. | 10647, 10875, 10647, 10875 | 388 | 875 |
| LYM807 | pUC19c_LYM807 | MAIZE *Zea mays* L. | 10648, 10876, 10648, 10876 | 389 | 630 |
| LYM808 | pUC19c_LYM808 | MAIZE *Zea mays* L. | 10649, 10877, 10649, 10877 | 390 | 876 |
| LYM809 | pUC19c_LYM809 | MAIZE *Zea mays* L. | 10650, 10878, 10650, 10878 | 391 | 877 |
| LYM811 | pUC19c_LYM811 | MAIZE *Zea mays* L. | 10651, 10879, 11065, 11156 | 392 | 878 |
| LYM812 | pUC19c_LYM812 | MAIZE *Zea mays* L. | 10652, 10880, 10652, 10880 | 393 | 879 |
| LYM813 | TopoB_LYM813 | MAIZE *Zea mays* L. | 10653, 10881, 10653, 10881 | 394 | 880 |
| LYM814 | pUC19c_LYM814 | MAIZE *Zea mays* L. | 10654, 10882, 11066, 11157 | 395 | 881 |
| LYM815 | pQFNc_LYM815 | MAIZE *Zea mays* L. | 10655, 10883, 11067, 11158 | 396 | 637 |
| LYM816 | pQFNc_LYM816 | MAIZE *Zea mays* L. | 10656, 10884, 11068, 11159 | 397 | 882 |
| LYM817_H1 | pMK_LYM817_H1_GA | | | 566 | 821 |
| LYM818 | pQFNc_LYM818 | MAIZE *Zea mays* L. | 10657, 10885, 10657, 10885 | 398 | 640 |
| LYM819 | pUC19c_LYM819 | MAIZE *Zea mays* L. | 10658, 10886, 10658, 10886 | 399 | 883 |
| LYM820 | pQFNc_LYM820 | MAIZE *Zea mays* L. | 10659, 10887, 10659, 10887 | 400 | 884 |
| LYM821 | pUC19c_LYM821 | MAIZE *Zea mays* L. | 10660, 10888 | 401 | 643 |
| LYM823 | pUC19c_LYM823 | MAIZE *Zea mays* L. | 10661, 10889, 11069, 11160 | 402 | 645 |
| LYM824 | pUC19c_LYM824 | MAIZE *Zea mays* L. | 10662, 10890, 10662, 10890 | 403 | 885 |
| LYM825 | pQFNc_LYM825 | MAIZE *Zea mays* L. | 10663, 10891, 11070, 11161 | 404 | 886 |
| LYM826 | pUC19c_LYM826 | MAIZE *Zea mays* L. | 10664, 10892, 10664, 10892 | 405 | 648 |
| LYM827 | pQFNc_LYM827 | MAIZE *Zea mays* L. | 10665, 10893, 10665, 10893 | 406 | 649 |
| LYM828 | pUC19c_LYM828 | MAIZE *Zea mays* L. | 10666, 10894, 10666, 10894 | 407 | 650 |
| LYM829 | pMA-RQ_LYM829_GA | | | 408 | 651 |
| LYM830_H4 | pMA-RQ_LYM830_H4_GA | | | 567 | 822 |
| LYM831 | pUC19c_LYM831 | MAIZE *Zea mays* L. | 10667, 10895, 11071, 11162 | 409 | 887 |
| LYM832 | pUC19c_LYM832 | MAIZE *Zea mays* L. | 10668, 10896, 11072, 11163 | 410 | 888 |
| LYM833 | pQFNc_LYM833 | MAIZE *Zea mays* L. | 10669, 10897, 11073, 11164 | 571 | — |
| LYM834 | pUC19c_LYM834 | MAIZE *Zea mays* L. | 10670, 10898, 11074, 11165 | 411 | 889 |
| LYM835 | pUC19c_LYM835 | MAIZE *Zea mays* L. | 10671, 10899, 10671, 10899 | 412 | 890 |
| LYM836 | pUC19c_LYM836 | MAIZE *Zea mays* L. | 10672, 10900, 10672, 10900 | 413 | 891 |
| LYM837 | pUC19c_LYM837 | MAIZE *Zea mays* L. | 10673, 10901, 10673, 10901 | 414 | 658 |
| LYM838 | TopoB_LYM838 | MAIZE *Zea mays* L. | 10674, 10902, 11075, 11166 | 415 | 892 |
| LYM839 | pUC19c_LYM839 | MAIZE *Zea mays* L. | 10675, 10903, 10675, 10903 | 416 | 660 |
| LYM840 | pQFNc_LYM840 | MAIZE *Zea mays* L. | 10676, 10904, 10676, 10904 | 417 | 661 |
| LYM841 | pUC19c_LYM841 | MAIZE *Zea mays* L. | 10677, 10905, 10677, 10905 | 418 | 893 |
| LYM842 | pUC19c_LYM842 | MAIZE *Zea mays* L. | 10678, 10906, 11076, 11167 | 419 | 663 |
| LYM843 | pQFNc_LYM843 | MAIZE *Zea mays* L. | 10679, 10907, 10679, 10907 | 420 | 894 |
| LYM844 | pQFNc_LYM844 | MAIZE *Zea mays* L. | 10680, 10908, 11077, 11168 | 421 | 895 |
| LYM845 | pQFNc_LYM845 | MAIZE *Zea mays* L. | 10681, 10909, 11078, 11169 | 422 | 896 |
| LYM846 | pQFNc_LYM846 | MAIZE *Zea mays* L. | 10682, 10910, 10682, 10910 | 423 | 897 |
| LYM847 | pUC19c_LYM847 | MAIZE *Zea mays* L. | 10683, 10911, 11079, 11170 | 424 | 898 |
| LYM848 | TopoB_LYM848 | MAIZE *Zea mays* L. | 10684, 10912, 10684, 10912 | 425 | 669 |
| LYM849 | pQFNc_LYM849 | MAIZE *Zea mays* L. | 10685, 10913, 11080, 11171 | 426 | 899 |
| LYM851 | pUC19c_LYM851 | MAIZE *Zea mays* L. | 10686, 10914, 10686, 10914 | 427 | 672 |
| LYM852 | pQFNc_LYM852 | MAIZE *Zea mays* L. | 10687, 10915 | 428 | 900 |
| LYM853 | pUC19c_LYM853 | MAIZE *Zea mays* L. | 10688, 10916, 10688, 10916 | 429 | 674 |
| LYM856 | pQFNc_LYM856 | MAIZE *Zea mays* L. | 10689, 10917, 10689, 10917 | 430 | 675 |
| LYM857 | pUC19c_LYM857 | MAIZE *Zea mays* L. | 10690, 10918, 10690, 10918 | 431 | 901 |
| LYM858 | pUC19c_LYM858 | MAIZE *Zea mays* L. | 10691, 10919, 10691, 10919 | 432 | 677 |
| LYM859 | pQFNc_LYM859 | MAIZE *Zea mays* L. | 10692, 10920, 10692, 10920 | 433 | 902 |
| LYM862 | pQFNc_LYM862 | MAIZE *Zea mays* L. | 10693, 10921, 10693, 10921 | 572 | — |
| LYM863 | pMA-RQ_LYM863_GA | | | 434 | 681 |
| LYM864 | pUC19c_LYM864 | RICE *Oryza sativa* L. | 10694, 10922, 10694, 10922 | 435 | 682 |
| LYM865 | pUC19c_LYM865 | RICE *Oryza sativa* L. | 10695, 10923, 11081, 11172 | 436 | 683 |
| LYM866 | pUC19c_LYM866 | RICE *Oryza sativa* L. | 10696, 10924, 10696, 10924 | 437 | 684 |
| LYM867 | pUC19c_LYM867 | RICE *Oryza sativa* L. | 10697, 10925, 11082, 11173 | 438 | 685 |
| LYM868 | pQFNc_LYM868 | RICE *Oryza sativa* L. | 10698, 10926, 10698, 10926 | 439 | 686 |
| LYM869 | pQFNc_LYM869 | RICE *Oryza sativa* L. | 10699, 10927, 10699, 10927 | 440 | 687 |

TABLE 97-continued

Cloning of genes of some embodiments of the invention

| Gene Name | High copy plasmid | Organism | Primers used SEQ ID NOs: | Polynucleotide SEQ ID NO: | Polypeptide SEQ ID NO: |
|---|---|---|---|---|---|
| LYM870 | pUC19c_LYM870 | RICE *Oryza sativa* L. | 10700, 10928, 11083, 11174 | 441 | 688 |
| LYM871 | pQFNc_LYM871 | RICE *Oryza sativa* L. | 10701, 10929, 10701, 10929 | 442 | 689 |
| LYM872 | pUC19d_LYM872 | RICE *Oryza sativa* L. | 10702, 10930, 11084, 11175 | 443 | 690 |
| LYM873 | pUC19c_LYM873 | RICE *Oryza sativa* L. | 10703, 10931, 11085, 11176 | 444 | 691 |
| LYM874 | pQFNc_LYM874 | RICE *Oryza sativa* L. | 10704, 10932, 11086, 11177 | 445 | 692 |
| LYM875 | pQFNc_LYM875 | RICE *Oryza sativa* L. | 10705, 10933, 10705, 10933 | 446 | 693 |
| LYM876 | pQFNc_LYM876 | RICE *Oryza sativa* L. | 10706, 10934, 11087, 11178 | 447 | 694 |
| LYM877 | pQFNc_LYM877 | RICE *Oryza sativa* L. | 10707, 10935, 10707, 10935 | 448 | 695 |
| LYM878 | pQFNc_LYM878 | RICE *Oryza sativa* L. | 10708, 10936, 10708, 10936 | 449 | 696 |
| LYM879 | pQFNc_LYM879 | RICE *Oryza sativa* L. | 10709, 10937, 10709, 10937 | 450 | 697 |
| LYM880 | pQFNc_LYM880 | RICE *Oryza sativa* L. | 10710, 10938, 10710, 10938 | 451 | 698 |
| LYM881 | pQFNc_LYM881 | SORGHUM *Sorghum bicolor* | 10711, 10939, 10711, 10939 | 452 | 699 |
| LYM882 | pUC19c_LYM882 | SORGHUM *Sorghum bicolor* | 10712, 10940, 10712, 10940 | 453 | 700 |
| LYM883 | pQFNc_LYM883 | SORGHUM *Sorghum bicolor* | 10713, 10941, 10713, 10941 | 454 | 701 |
| LYM884 | pQFNc_LYM884 | SORGHUM *Sorghum bicolor* | 10714, 10942, 11088, 11179 | 455 | 702 |
| LYM885 | pQFNc_LYM885 | SORGHUM *Sorghum bicolor* | 10715, 10943, 10715, 10943 | 456 | 703 |
| LYM886 | pUC19c_LYM886 | SORGHUM *Sorghum bicolor* | 10716, 10944, 10716, 11180 | 457 | 704 |
| LYM887 | pUC19c_LYM887 | SORGHUM *Sorghum bicolor* | 10717, 10945, 10717, 10945 | 458 | 903 |
| LYM888_H1 | TopoB_LYM888_H1 | FOXTAIL *Setaria italica* | 10718, 10946, 11089, 11181 | 568 | 823 |
| LYM889 | pUC19c_LYM889 | SORGHUM *Sorghum bicolor* | 10719, 10947, 11090, 11182 | 459 | 707 |
| LYM890 | pQFNc_LYM890 | SORGHUM *Sorghum bicolor* | 10720, 10948, 10720, 10948 | 460 | 904 |
| LYM891 | pUC19c_LYM891 | SORGHUM *Sorghum bicolor* | 10721, 10949, 10721, 10949 | 461 | 709 |
| LYM892 | TopoB_LYM892 | SORGHUM *Sorghum bicolor* | 10722, 10950, 10722, 11183 | 462 | 710 |
| LYM894 | pUC19c_LYM894 | SORGHUM *Sorghum bicolor* | 10723, 10951, 11091, 11184 | 463 | 712 |
| LYM895 | pUC19c_LYM895 | SORGHUM *Sorghum bicolor* | 10724, 10952, 10724, 10952 | 464 | 905 |
| LYM896 | pQFNc_LYM896 | SORGHUM *Sorghum bicolor* | 10725, 10953, 10725, 10953 | 465 | 714 |
| LYM897 | pUC19c_LYM897 | SORGHUM *Sorghum bicolor* | 10726, 10954, 10726, 10954 | 466 | 715 |
| LYM898 | pQFNc_LYM898 | SORGHUM *Sorghum bicolor* | 10727, 10955, 11092, 11185 | 467 | 716 |
| LYM899 | pQFNc_LYM899 | SORGHUM *Sorghum bicolor* | 10728, 10956, 11093, 11186 | 468 | 717 |
| LYM900 | pUC19c_LYM900 | SORGHUM *Sorghum bicolor* | 10729, 10957, 10729, 10957 | 469 | 718 |
| LYM901_H1 | pMA-RQ_LYM901_H1_GA | | | 569 | 824 |
| LYM902 | pMA-RQ_LYM902_GA | | | 256 | — |
| LYM904 | pUC19c_LYM904 | SORGHUM *Sorghum bicolor* | 10730, 10958, 10730, 10958 | 470 | 721 |
| LYM905 | pUC19c_LYM905 | SORGHUM *Sorghum bicolor* | 10731, 10959, 10731, 10959 | 471 | 722 |
| LYM906 | pUC19c_LYM906 | SORGHUM *Sorghum bicolor* | 10732, 10960, 10732, 10960 | 472 | 723 |
| LYM907 | pJET_LYM907 | SORGHUM *Sorghum bicolor* | 10733, 10961, 10733, 10961 | 473 | 724 |
| LYM908 | pUC19c_LYM908 | SORGHUM *Sorghum bicolor* | 10734, 10962, 10734, 10962 | 474 | 725 |
| LYM909 | pUC19c_LYM909 | SORGHUM *Sorghum bicolor* | 10735, 10963, 11094, 11187 | 475 | 726 |
| LYM910 | pMA_LYM910_GA | | | 476 | 727 |
| LYM911 | pUC19c_LYM911 | SORGHUM *Sorghum bicolor* | 10736, 10964, 11095, 11188 | 477 | 728 |
| LYM912 | pUC19c_LYM912 | SORGHUM *Sorghum bicolor* | 10737, 10965, 11096, 11189 | 478 | 729 |
| LYM913 | pQFNc_LYM913 | SORGHUM *Sorghum bicolor* | 10738, 10966, 10738, 10966 | 479 | 730 |
| LYM914 | pQFNc_LYM914 | SORGHUM *Sorghum bicolor* | 10739, 10967, 11097, 11190 | 480 | 906 |
| LYM915 | pQFNc_LYM915 | SORGHUM *Sorghum bicolor* | 10740, 10968, 10740, 10968 | 481 | 732 |
| LYM916 | pQFNc_LYM916 | SORGHUM *Sorghum bicolor* | 10741, 10969, 10741, 11191 | 482 | 907 |
| LYM917 | pUC19c_LYM917 | SORGHUM *Sorghum bicolor* | 10742, 10970, 10742, 10970 | 483 | 908 |
| LYM919 | pUC19c_LYM919 | SORGHUM *Sorghum bicolor* | 10743, 10971, 10743, 10971 | 484 | 735 |
| LYM920 | pJET_LYM920 | SORGHUM *Sorghum bicolor* | 10744, 10972, 11098, 11192 | 485 | 736 |
| LYM921 | pUC19c_LYM921 | SORGHUM *Sorghum bicolor* | 10745, 10973, 10745, 10973 | 486 | 909 |
| LYM922 | pUC19c_LYM922 | SORGHUM *Sorghum bicolor* | 10746, 10974, 11099, 11193 | 487 | 738 |
| LYM923 | pQFNc_LYM923 | SORGHUM *Sorghum bicolor* | 10747, 10975 | 488 | 739 |
| LYM924 | pUC19c_LYM924 | SORGHUM *Sorghum bicolor* | 10748, 10976, 11100, 11194 | 489 | 740 |
| LYM925 | pUC19c_LYM925 | SORGHUM *Sorghum bicolor* | 10749, 10977, 10749, 10977 | 490 | 741 |
| LYM926 | pMA_LYM926_GA | | | 491 | 742 |
| LYM927 | pUC19c_LYM927 | SORGHUM *Sorghum bicolor* | 10750, 10978, 10750, 10978 | 492 | 743 |
| LYM928 | pUC19c_LYM928 | SORGHUM *Sorghum bicolor* | 10751, 10979, 10751, 10979 | 493 | 744 |
| LYM929 | pUC19c_LYM929 | SORGHUM *Sorghum bicolor* | 10752, 10980, 10752, 10980 | 494 | 745 |
| LYM930 | pUC19c_LYM930 | SORGHUM *Sorghum bicolor* | 10753, 10981, 10753, 10981 | 495 | 746 |
| LYM931 | pUC19c_LYM931 | SORGHUM *Sorghum bicolor* | 10754, 10982, 10754, 10982 | 496 | 747 |
| LYM932 | pUC19c_LYM932 | SORGHUM *Sorghum bicolor* | 10755, 10983, 11101, 11195 | 497 | 748 |
| LYM933 | pUC19c_LYM933 | SORGHUM *Sorghum bicolor* | 10756, 10984, 11102, 11196 | 498 | 749 |
| LYM934 | pUC19c_LYM934 | SORGHUM *Sorghum bicolor* | 10757, 10985, 10757, 10985 | 499 | 750 |
| LYM935 | pUC19c_LYM935 | SORGHUM *Sorghum bicolor* | 10758, 10986, 10758, 10986 | 500 | 751 |
| LYM936 | pUC19c_LYM936 | SORGHUM *Sorghum bicolor* | 10759, 10987, 11103, 11197 | 501 | 752 |
| LYM937 | pQFNc_LYM937 | SORGHUM *Sorghum bicolor* | 10760, 10988, 10760, 10988 | 502 | 753 |
| LYM938 | pQFNc_LYM938 | SORGHUM *Sorghum bicolor* | 10761, 10989, 10761, 10989 | 503 | 754 |
| LYM939 | pQFNc_LYM939 | SORGHUM *Sorghum bicolor* | 10762, 10990, 11104, 11198 | 504 | 755 |
| LYM940 | TopoB_LYM940 | SORGHUM *Sorghum bicolor* | 10763, 10991, 11105, 11199 | 505 | 756 |
| LYM941 | pUC19c_LYM941 | SORGHUM *Sorghum bicolor* | 10764, 10992, 11106, 11200 | 506 | 757 |
| LYM942 | pUC19d_LYM942 | SORGHUM *Sorghum bicolor* | 10765, 10993, 10765, 10993 | 507 | 910 |
| LYM943 | pQFNc_LYM943 | SORGHUM *Sorghum bicolor* | 10766, 10994, 10766, 10994 | 508 | 911 |
| LYM944 | pQFNc_LYM944 | SORGHUM *Sorghum bicolor* | 10767, 10995, 11107, 11201 | 509 | 760 |
| LYM945 | pUC19c_LYM945 | SORGHUM *Sorghum bicolor* | 10768, 10996, 10768, 11202 | 510 | 761 |

TABLE 97-continued

Cloning of genes of some embodiments of the invention

| Gene Name | High copy plasmid | Organism | Primers used SEQ ID NOs: | Polynucleotide SEQ ID NO: | Polypeptide SEQ ID NO: |
|---|---|---|---|---|---|
| LYM946 | pQFNc_LYM946 | SORGHUM *Sorghum bicolor* | 10769, 10997, 11108, 11203 | 511 | 912 |
| LYM947 | pQFNc_LYM947 | SORGHUM *Sorghum bicolor* | 10770, 10998, 11109, 11204 | 512 | 763 |
| LYM948 | pQFNc_LYM948 | SORGHUM *Sorghum bicolor* | 10771, 10999, 11110, 11205 | 513 | 764 |
| LYM949 | pQFNc_LYM949 | SORGHUM *Sorghum bicolor* | 10772, 11000, 11111, 11206 | 514 | 765 |
| LYM950 | pUC19c_LYM950 | SORGHUM *Sorghum bicolor* | 10773, 11001, 10773, 11001 | 515 | 766 |
| LYM952 | pQFNc_LYM952 | SORGHUM *Sorghum bicolor* | 10774, 11002, 10774, 11002 | 516 | 768 |
| LYM953 | pUC19c_LYM953 | SORGHUM *Sorghum bicolor* | 10775, 11003, 11112, 11207 | 517 | 769 |
| LYM954 | pUC19c_LYM954 | SORGHUM *Sorghum bicolor* | 10776, 11004, 11113, 11208 | 518 | 770 |
| LYM955 | pUC19c_LYM955 | SORGHUM *Sorghum bicolor* | 10777, 11005, 11114, 11209 | 519 | 771 |
| LYM956 | pUC19c_LYM956 | SORGHUM *Sorghum bicolor* | 10778, 11006, 10778, 11006 | 520 | 913 |
| LYM957 | pQFNc_LYM957 | SORGHUM *Sorghum bicolor* | 10779, 11007, 10779, 11007 | 521 | 914 |
| LYM958 | pQFNc_LYM958 | SORGHUM *Sorghum bicolor* | 10780, 11008, 10780, 11008 | 522 | 774 |
| LYM959 | pUC19c_LYM959 | SORGHUM *Sorghum bicolor* | 10781, 11009, 10781, 11009 | 523 | 775 |
| LYM960 | pUC19c_LYM960 | SORGHUM *Sorghum bicolor* | 10782, 11010, 10782, 11010 | 524 | 776 |
| LYM961 | pUC19c_LYM961 | SORGHUM *Sorghum bicolor* | 10783, 11011, 10783, 11011 | 525 | 915 |
| LYM962 | pQFNc_LYM962 | SORGHUM *Sorghum bicolor* | 10784, 11012, 10784, 11012 | 526 | 778 |
| LYM963 | TopoB_LYM963 | SORGHUM *Sorghum bicolor* | 10785, 11013, 11115, 11210 | 527 | 779 |
| LYM964_H1 | pMA-RQ_LYM964_H1_GA | | | 570 | 825 |
| LYM965 | pQFNc_LYM965 | SORGHUM *Sorghum bicolor* | 10786, 11014, 10786, 11014 | 528 | 781 |
| LYM966 | pUC19c_LYM966 | SORGHUM *Sorghum bicolor* | 10787, 11015, 10787, 11211 | 529 | 782 |
| LYM967 | pUC19c_LYM967 | SORGHUM *Sorghum bicolor* | 10788, 11016, 10788, 11016 | 530 | 783 |
| LYM970 | pQFNc_LYM970 | SORGHUM *Sorghum bicolor* | 10789, 11017, 10789, 11017 | 573 | — |
| LYM972 | pUC19c_LYM972 | SORGHUM *Sorghum bicolor* | 10790, 11018, 11116, 11212 | 531 | 784 |
| LYM974 | pUC19c_LYM974 | SORGHUM *Sorghum bicolor* | 10791, 11019, 10791, 11019 | 532 | 916 |
| LYM975 | pQFNc_LYM975 | SORGHUM *Sorghum bicolor* | 10792, 11020, 11117, 11213 | 533 | 786 |
| LYM976 | pUC19c_LYM976 | SORGHUM *Sorghum bicolor* | 10793, 11021, 10793, 11021 | 534 | 787 |
| LYM977 | pQFNc_LYM977 | SORGHUM *Sorghum bicolor* | 10794, 11022, 11118, 11214 | 535 | 788 |
| LYM978 | pMA-RQ_LYM978_GA | | | 261 | — |
| LYM979 | pQFNc_LYM979 | SORGHUM *Sorghum bicolor* | 10795, 11023, 11119, 11215 | 536 | 789 |
| LYM980 | pQFNc_LYM980 | SOYBEAN *Glycine max* | 10796, 11024, 11120, 11216 | 537 | 917 |
| LYM981 | pUC19c_LYM981 | SOYBEAN *Glycine max* | 10797, 11025, 10797, 11025 | 538 | 791 |
| LYM982 | pUC19c_LYM982 | SOYBEAN *Glycine max* | 10798, 11026, 10798, 11026 | 539 | 792 |
| LYM983 | pUC19c_LYM983 | SOYBEAN *Glycine max* | 10799, 11027, 11121, 11217 | 540 | 854 |
| LYM984 | pQFNc_LYM984 | SOYBEAN *Glycine max* | 10800, 11028, 11122, 11218 | 541 | 794 |
| LYM985 | pQFNc_LYM985 | SOYBEAN *Glycine max* | 10801, 11029, 11123, 11219 | 542 | 795 |
| LYM986 | pQFNc_LYM986 | SOYBEAN *Glycine max* | 10802, 11030, 11124, 11220 | 543 | 796 |
| LYM987 | pQFNc_LYM987 | SOYBEAN *Glycine max* | 10803, 11031, 10803, 11031 | 544 | 797 |
| LYM988 | pUC19c_LYM988 | SOYBEAN *Glycine max* | 10804, 11032, 11125, 11221 | 545 | 798 |
| LYM989 | pQFNc_LYM989 | TOMATO *Lycopersicum* ND | 10805, 11033, 10805, 11033 | 546 | 799 |
| LYM990 | TopoB_LYM990 | TOMATO *Lycopersicum* ND | 10806, 11034, 10806, 11222 | 547 | 918 |
| LYM991 | pQFNc_LYM991 | WHEAT *Triticum aestivum* L. | 10807, 11035, 11126, 11223 | 548 | 919 |
| LYM992 | pUC19c_LYM992 | WHEAT *Triticum aestivum* L. | 10808, 11036, 10808, 11036 | 549 | 920 |
| LYM993 | pMA-RQ_LYM993_GA | | | 550 | 803 |
| LYM994 | pUC19c_LYM994 | WHEAT *Triticum aestivum* L. | 10809, 11037, 11127, 11224 | 551 | 921 |
| LYM995 | pQFNc_LYM995 | WHEAT *Triticum aestivum* L. | 10810, 11038, 11128, 11225 | 552 | 922 |
| LYM996 | pQFNc_LYM996 | WHEAT *Triticum aestivum* L. | 10811, 11039, 11129, 11226 | 553 | 806 |
| LYM997 | pQFNc_LYM997 | WHEAT *Triticum aestivum* L. | 10812, 11040, 10812, 11040 | 554 | 923 |
| LYM998 | pQFNc_LYM998 | WHEAT *Triticum aestivum* L. | 10813, 11041, 11130, 11227 | 555 | 924 |
| LYM999 | pUC19c_LYM999 | WHEAT *Triticum aestivum* L. | 10814, 11042, 10814, 11042 | 556 | 925 |

Table 97:
Provided are the sequence identifiers of the cloned genes, the primers used for cloning, genes' names, vectors used for cloning, and the plant species from which the genes were cloned.

Example 17

Transforming *Agrobacterium* Tumefaciens Cells with Binary Vectors Harboring Putative Genes Each of the binary vectors described in Example 16 above were used to transform *Agrobacterium* cells. An additional binary construct was used as negative control containing empty vector carrying At6669 promoter.

The binary vectors were introduced to *Agrobacterium tumefaciens* GV301, or LB4404 competent cells (about $10^9$ cells/mL) by electroporation. The electroporation was performed using a MicroPulser electroporator (Biorad), 0.2 cm cuvettes (Biorad) to and EC-2 electroporation program (Biorad). The treated cells were cultured in LB liquid medium at 28° C. for 3 hours, then plated over LB agar supplemented with gentamycin (50 mg/L; for *Agrobacterium* strains GV301) or streptomycin (300 mg/L; for *Agrobacterium* strain LB4404) and kanamycin (50 mg/L) at 28° C. for 48 hours. *Abrobacterium* colonies, which were developed on the selective media, were analyzed by PCR using the primers which are designed to span the inserted sequence in the pPI plasmid. The resulting PCR products were isolated and sequenced as described in Example 16 above, to verify that the correct nucleotide sequences were properly introduced to the *Agrobacterium* cells.

Example 18

Producing Transgenic *Arabidopsis* Plants Expressing Selected Genes According to Some Embodiments of the Invention Materials and Experimental Methods Plant transformation—The *Arabidopsis thaliana* var *Columbia* ($T_0$ plants) were transformed according to the Floral Dip procedure [Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (2000) Female reproductive tissues were the primary targets of *Agrobacterium*-mediated transformation by the *Arabidopsis* floral-dip method. Plant Physiol. 123(3): 895-9041 with minor modifications. Briefly, *Arabidopsis thaliana* Columbia (Col0) $T_0$ plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the yield genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 µM benzylamino purine (Sigma); 112 µg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue is submerged for 3-5 seconds. Each inoculated $T_0$ plant was immediately placed in a plastic tray, then covered with clear plastic dome to maintain humidity and was kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds are harvested from plants and kept at room temperature until sowing.

For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 19

Evaluation of Transgenic *Arabidopsis* for Seed Yield and Plant Growth Rate Under Normal Conditions in Greenhouse Assays (GH-SM Assays)

Assay 1: Seed yield plant biomass and plant growth rate under normal greenhouse conditions—This assay follows seed yield production, the biomass formation and the rosette area growth of plants grown in the greenhouse at non-limiting nitrogen growth conditions. Transgenic *Arabidopsis* seeds were sown in agar media supplemented with ½ MS medium and a selection agent (Kanamycin). The $T_2$ to transgenic seedlings were then transplanted to 1.7 trays filled with peat and perlite in a 1:1 ratio. The trays were irrigated with a solution containing 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until mature seeds. Seeds were harvested, extracted and weighted. The remaining plant biomass (the above ground tissue) was also harvested, and weighted immediately or following drying in oven at 50° C. for 24 hours.

Each construct was validated at its $T_2$ generation. Transgenic plants transformed with a construct conformed by an empty vector carrying the At6669 promoter (SEQ ID NO:10575) and the selectable marker were used as control.

The plants were analyzed for their overall size, growth rate, flowering, seed yield, 1,000-seed weight, dry matter and harvest index (HI-seed yield/dry matter). Transgenic plants performance was compared to control plants grown in parallel under the same (e.g., identical) conditions. Mock-transgenic plants expressing the uidA reporter gene (GUS-Intron) or with no gene at all, under the same promoter were used as controls.

The experiment was planned in nested randomized plot distribution. For each gene of the invention three to five independent transformation events were analyzed from each construct.

Digital Imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubs were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National to Institutes of Health and freely available on the internet at Hypertext Transfer Protocol://rsbweb(dot)nih(dot)gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number [Formula IX (described above)], rosette area (Formula VIII above), plot coverage (Formula XIX below) and harvest index (Formula IV above) was calculated with the indicated formulas.

RGR plot coverage  Formula XIX:

Relative growth rate of plot coverage=Regression coefficient of plot coverage along time course.

Seeds average weight—At the end of the experiment all seeds were collected. The seeds were scattered on a glass tray and a picture was taken. Using the digital analysis, the number of seeds in each sample was calculated.

Dry weight and seed yield—On about day 80 from sowing, the plants were harvested and left to dry at 30° C. in a drying chamber. The biomass and seed weight of each plot were measured and divided by the number of plants in each plot.

Dry weight=total weight of the vegetative portion above ground (excluding roots) after drying at 30° C. in a drying chamber;

Seed yield per plant=total seed weight per plant (gr.).

1000 seed weight (the weight of 1000 seeds) (gr.).

Oil percentage in seeds—At the end of the experiment all seeds from each plot are collected. Seeds from 3 plots were mixed grounded and then mounted onto the extraction chamber. 210 ml of n-Hexane (Cat No. 080951 Biolab Ltd.) are used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingier's) 1879, 232, 461) was used to create a calibration curve for to the Low Resonance NMR. The content of oil of all seed samples was determined using the Low Resonance NMR (MARAN Ultra—Oxford Instrument) and its MultiQuant software package.

Silique length analysis—On day 50 from sowing, 30 siliques from different plants in each plot were sampled in block A. The chosen siliques are green-yellow in color and were collected from the bottom parts of a grown plant's stem. A digital photograph was taken to determine silique's length.

Statistical analyses—To identify outperforming genes and constructs, results from the independent transformation events tested were analyzed separately. Data was analyzed using Student's t-test and results were considered significant if the p value was less than 0.1. The JMP statistics software package was used (Version 5.2.1, SAS Institute Inc., Cary, N.C., USA).

Tables 98-102 summarize the observed phenotypes of transgenic plants exogenously expressing the gene constructs using the seed maturation (GH-SM) assays under normal conditions. The evaluation of each gene was performed by testing the performance of different number of events. Event with p-value <0.1 was considered statistically significant.

TABLE 98

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM998 | 74217.1 | 1165.6 | 0.22 | 13 | — | — | — | — | — | — |
| LYM998 | 74217.4 | 1207.5 | L | 17 | — | — | — | — | — | — |
| LYM998 | 74219.3 | 1192.5 | 0.19 | 15 | — | — | — | — | — | — |
| LYM979 | 74244.3 | 1124.4 | 0.07 | 9 | — | — | — | — | — | — |
| LYM967 | 74506.1 | 1266.9 | 0.09 | 22 | — | — | — | — | — | — |
| LYM967 | 74508.2 | 1148.8 | 0.03 | 11 | — | — | — | — | — | — |
| LYM966 | 74523.1 | 1116.2 | 0.11 | 8 | — | — | — | — | — | — |
| LYM966 | 74524.1 | 1115.0 | 0.13 | 8 | 26.1 | L | −5 | 20.2 | L | −6 |
| LYM956 | 74498.2 | 1084.4 | 0.28 | 5 | — | — | — | — | — | — |
| LYM956 | 74498.3 | 1129.4 | 0.05 | 9 | — | — | — | — | — | — |
| LYM956 | 74502.1 | 1131.6 | 0.05 | 9 | — | — | — | — | — | — |
| LYM956 | 74502.2 | 1121.9 | 0.06 | 8 | — | — | — | — | — | — |
| LYM954 | 74496.2 | 1118.1 | 0.15 | 8 | — | — | — | 21.0 | 0.09 | −2 |
| LYM954 | 74497.1 | 1228.8 | L | 19 | — | — | — | 20.6 | L | −4 |
| LYM942 | 74661.5 | 1206.9 | L | 17 | — | — | — | — | — | — |
| LYM942 | 74665.4 | 1296.3 | 0.02 | 25 | — | — | — | — | — | — |
| LYM927 | 73767.1 | 1106.9 | 0.12 | 7 | — | — | — | 20.7 | 0.18 | −4 |
| LYM927 | 73769.1 | 1117.8 | 0.11 | 8 | — | — | — | — | — | — |
| LYM927 | 73770.2 | 1162.5 | 0.02 | 12 | — | — | — | 20.5 | L | −5 |
| LYM927 | 73771.1 | 1175.0 | 0.09 | 13 | — | — | — | — | — | — |
| LYM927 | 73771.2 | 1177.5 | L | 14 | 26.1 | L | −4 | 20.4 | 0.03 | −5 |
| LYM917 | 74456.1 | 1273.1 | L | 23 | — | — | — | — | — | — |
| LYM917 | 74456.3 | 1093.1 | 0.18 | 6 | — | — | — | — | — | — |
| LYM886 | 74446.4 | 1349.4 | 0.04 | 30 | — | — | — | — | — | — |
| LYM886 | 74446.6 | 1086.9 | 0.23 | 5 | — | — | — | — | — | — |
| LYM886 | 74447.6 | — | — | — | 26.1 | L | −5 | 20.6 | 0.23 | −4 |
| LYM879 | 74602.1 | 1121.9 | 0.19 | 8 | — | — | — | — | — | — |
| LYM879 | 74605.1 | 1086.2 | 0.27 | 5 | — | — | — | — | — | — |
| LYM841 | 73670.1 | 1200.6 | L | 16 | — | — | — | — | — | — |
| LYM841 | 73671.1 | 1169.4 | 0.21 | 13 | 26.1 | L | −5 | 20.3 | L | −5 |
| LYM841 | 73672.1 | — | — | — | 25.4 | 0.12 | −7 | 20.2 | L | −6 |
| LYM841 | 73673.4 | 1291.2 | 0.04 | 25 | — | — | — | — | — | — |
| LYM820 | 74587.1 | — | — | — | — | — | — | 20.7 | 0.18 | −4 |
| LYM811 | 74385.2 | 1224.4 | 0.30 | 18 | — | — | — | 20.5 | L | −5 |

TABLE 98-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM811 | 74389.1 | — | — | — | 26.1 | L | −4 | 20.8 | 0.09 | −3 |
| LYM800 | 74576.1 | 1112.5 | 0.15 | 7 | — | — | — | — | — | — |
| LYM800 | 74576.2 | 1286.9 | 0.18 | 24 | — | — | — | — | — | — |
| LYM757 | 74429.2 | 1143.1 | 0.10 | 10 | — | — | — | — | — | — |
| LYM1004 | 74336.3 | 1186.9 | 0.16 | 15 | — | — | — | — | — | — |
| CONT. | — | 1035.4 | — | — | 27.3 | — | — | 21.5 | — | — |
| LYM986 | 73532.1 | 1075.0 | L | 6 | — | — | — | — | — | — |
| LYM986 | 73533.2 | 1122.5 | 0.27 | 11 | — | — | — | — | — | — |
| LYM985 | 73526.2 | 1115.6 | 0.20 | 10 | — | — | — | — | — | — |
| LYM947 | 73299.2 | 1043.1 | 0.08 | 3 | — | — | — | — | — | — |
| LYM891 | 73721.1 | 1041.2 | 0.29 | 3 | — | — | — | — | — | — |
| LYM885 | 73283.1 | — | — | — | 41.0 | 0.04 | −3 | 34.5 | 0.18 | −3 |
| LYM885 | 73283.3 | 1100.6 | 0.16 | 8 | 41.3 | 0.09 | −2 | 34.5 | 0.03 | −3 |
| LYM881 | 73592.2 | 1058.8 | 0.19 | 4 | — | — | — | — | — | — |
| LYM878 | 73234.2 | — | — | — | 41.1 | 0.06 | −2 | — | — | — |
| LYM878 | 73235.2 | 1033.1 | 0.24 | 2 | — | — | — | — | — | — |
| LYM875 | 73516.4 | 1142.5 | 0.12 | 13 | — | — | — | 35.1 | 0.15 | −2 |
| LYM874 | 73585.1 | 1100.6 | 0.09 | 8 | — | — | — | — | — | — |
| LYM844 | 73195.2 | — | — | — | 41.1 | 0.06 | −2 | — | — | — |
| LYM844 | 73197.2 | 1156.9 | L | 14 | — | — | — | — | — | — |
| LYM827 | 73432.4 | 1081.2 | 0.14 | 6 | 41.1 | 0.06 | −2 | 34.7 | 0.29 | −3 |
| LYM804 | 73219.5 | 1191.9 | 0.24 | 17 | — | — | — | — | — | — |
| LYM804 | 73222.1 | 1286.9 | 0.29 | 27 | — | — | — | — | — | — |
| LYM804 | 73223.1 | 1044.4 | 0.08 | 3 | — | — | — | — | — | — |
| LYM769 | 73598.3 | 1093.1 | 0.18 | 8 | — | — | — | — | — | — |
| LYM1009 | 73141.2 | 1175.0 | 0.13 | 16 | — | — | — | 33.8 | 0.10 | −5 |
| LYM1009 | 73141.5 | — | — | — | 41.1 | 0.06 | −2 | — | — | — |
| LYM1009 | 73143.2 | — | — | — | 41.3 | 0.09 | −2 | 34.9 | 0.15 | −2 |
| CONT. | — | 1015.4 | — | — | 42.1 | — | — | 35.6 | — | — |
| LYM996 | 73566.3 | — | — | — | — | — | — | 33.5 | 0.14 | −2 |
| LYM996 | 73567.1 | 1303.8 | L | 22 | — | — | — | — | — | — |
| LYM923 | 73286.3 | 1173.1 | 0.22 | 10 | — | — | — | — | — | — |
| LYM916 | 73238.4 | 1217.3 | L | 14 | — | — | — | — | — | — |
| LYM898 | 73461.1 | 1158.8 | 0.18 | 9 | — | — | — | — | — | — |
| LYM884 | 73211.1 | 1139.9 | 0.27 | 7 | — | — | — | — | — | — |
| LYM884 | 73212.2 | — | — | — | 39.2 | 0.02 | −3 | 33.2 | 0.05 | −3 |
| LYM873 | 73716.1 | — | — | — | — | — | — | 33.4 | 0.20 | −3 |
| LYM868 | 73573.2 | 1212.5 | 0.04 | 14 | — | — | — | — | — | — |
| LYM837 | 73665.4 | 1259.1 | 0.09 | 18 | — | — | — | — | — | — |
| LYM837 | 73666.3 | — | — | — | 39.9 | 0.27 | −1 | — | — | — |
| LYM764 | 73155.4 | — | — | — | 39.6 | 0.13 | −2 | 33.1 | 0.05 | −3 |
| LYM764 | 73156.2 | 1135.0 | 0.18 | 7 | 38.2 | 0.05 | −6 | 33.1 | 0.04 | −4 |
| LYM763 | 73457.3 | — | — | — | — | — | — | 33.1 | 0.05 | −3 |
| LYM763 | 73458.2 | 1161.9 | 0.06 | 9 | — | — | — | — | — | — |
| LYM762 | 73151.1 | 1183.1 | 0.02 | 11 | — | — | — | — | — | — |
| CONT. | — | 1064.9 | — | — | 40.5 | — | — | 34.3 | — | — |
| LYM985 | 73528.1 | 1108.8 | 0.10 | 11 | — | — | — | 31.8 | 0.16 | −1 |
| LYM985 | 73529.2 | 1183.8 | 0.28 | 18 | 37.9 | 0.23 | −2 | — | — | — |
| LYM985 | 73530.1 | — | — | — | 38.2 | 0.06 | −2 | 31.9 | 0.09 | −1 |
| LYM939 | 74150.5 | — | — | — | — | — | — | 31.4 | L | −3 |
| LYM939 | 74153.1 | — | — | — | 38.0 | 0.04 | −2 | 31.5 | 0.06 | −3 |
| LYM939 | 74154.1 | 1100.6 | 0.26 | 10 | — | — | — | 31.9 | 0.15 | −1 |
| LYM937 | 73550.1 | — | — | — | 37.8 | 0.27 | −3 | — | — | — |
| LYM937 | 73551.1 | — | — | — | 38.2 | 0.06 | −2 | 31.8 | 0.06 | −2 |
| LYM937 | 73551.2 | 1262.5 | L | 26 | — | — | — | — | — | — |
| LYM937 | 73553.1 | — | — | — | 36.7 | L | −5 | 29.2 | L | −10 |
| LYM931 | 73844.1 | 1080.6 | 0.15 | 8 | — | — | — | — | — | — |
| LYM931 | 73844.3 | — | — | — | 37.3 | 0.19 | −4 | — | — | — |
| LYM889 | 73793.2 | — | — | — | 38.4 | 0.14 | −1 | — | — | — |
| LYM889 | 73794.4 | 1154.4 | 0.02 | 15 | — | — | — | — | — | — |
| LYM877 | 73201.1 | 1098.8 | 0.21 | 10 | — | — | — | — | — | — |
| LYM877 | 73203.1 | 1121.2 | 0.05 | 12 | — | — | — | — | — | — |
| LYM875 | 73516.5 | — | — | — | 38.0 | 0.02 | −2 | 31.7 | 0.03 | −2 |
| LYM875 | 73518.1 | — | — | — | 37.4 | L | −4 | 29.6 | 0.05 | −8 |
| LYM875 | 73519.1 | 1196.9 | 0.03 | 19 | 38.1 | 0.10 | −2 | 31.6 | 0.13 | −2 |
| LYM842 | 74012.1 | 1115.0 | 0.06 | 11 | — | — | — | — | — | — |
| LYM842 | 74012.4 | 1078.1 | 0.17 | 7 | — | — | — | — | — | — |
| LYM842 | 74014.1 | 1240.0 | 0.22 | 24 | — | — | — | — | — | — |
| LYM807 | 73976.2 | — | — | — | 37.7 | 0.16 | −3 | — | — | — |
| LYM807 | 73980.3 | 1153.1 | 0.02 | 15 | 37.1 | 0.16 | −4 | 29.5 | 0.07 | −9 |
| LYM807 | 73981.3 | 1146.2 | 0.28 | 14 | 38.0 | 0.22 | −2 | — | — | — |

TABLE 98-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM806 | 73971.3 | 1074.4 | 0.25 | 7 | 38.1 | 0.10 | -2 | 31.8 | 0.06 | -2 |
| LYM806 | 73971.4 | 1106.9 | 0.12 | 10 | — | — | — | — | — | — |
| LYM803 | 74213.6 | — | — | — | — | — | — | 31.8 | 0.16 | -1 |
| LYM803 | 74215.5 | 1135.6 | 0.04 | 13 | — | — | — | — | — | — |
| LYM795 | 73960.4 | 1065.0 | 0.25 | 6 | 37.9 | L | -2 | 31.4 | L | -3 |
| LYM795 | 73961.3 | 1080.6 | 0.17 | 8 | — | — | — | — | — | — |
| LYM795 | 73963.1 | 1145.2 | 0.02 | 14 | — | — | — | — | — | — |
| LYM791 | 73952.2 | — | — | — | 37.6 | 0.05 | -3 | — | — | — |
| LYM791 | 73957.2 | — | — | — | 37.8 | L | -3 | 30.7 | 0.24 | -5 |
| LYM784 | 74083.1 | — | — | — | 37.9 | 0.05 | -2 | 31.8 | 0.06 | -2 |
| LYM781 | 73948.2 | — | — | — | — | — | — | 32.0 | 0.23 | -1 |
| LYM781 | 73948.4 | 1160.7 | 0.10 | 16 | — | — | — | — | — | — |
| LYM781 | 73950.1 | — | — | — | 37.8 | L | -3 | 30.7 | 0.24 | -5 |
| LYM781 | 73950.2 | 1118.1 | 0.05 | 11 | 37.2 | 0.12 | -4 | — | — | — |
| LYM764 | 73155.4 | 1255.6 | 0.23 | 25 | — | — | — | — | — | — |
| LYM764 | 73156.3 | 1105.6 | 0.08 | 10 | 37.4 | L | -4 | — | — | — |
| LYM764 | 73156.4 | 1088.1 | 0.27 | 8 | — | — | — | — | — | — |
| LYM764 | 73157.1 | — | — | — | 38.2 | 0.06 | -2 | 31.9 | 0.15 | -1 |
| LYM1008 | 73135.1 | 1098.1 | 0.18 | 9 | 37.0 | 0.10 | -5 | — | — | — |
| LYM1008 | 73140.6 | 1200.6 | 0.06 | 20 | — | — | — | 31.5 | 0.02 | -2 |
| CONT. | — | 1003.0 | — | — | 38.8 | — | — | 32.3 | — | — |
| LYM989 | 74222.1 | 1012.5 | 0.29 | 2 | — | — | — | — | — | — |
| LYM952 | 74250.3 | 1052.5 | 0.02 | 6 | — | — | — | — | — | — |
| LYM952 | 74251.4 | 1067.5 | 0.29 | 8 | — | — | — | — | — | — |
| LYM913 | 74365.3 | 1096.9 | 0.22 | 11 | — | — | — | — | — | — |
| LYM911 | 73840.2 | 1059.4 | 0.28 | 7 | — | — | — | 28.3 | 0.08 | -1 |
| LYM909 | 73832.1 | 1055.0 | 0.12 | 7 | 34.1 | L | -3 | 28.1 | 0.16 | -2 |
| LYM909 | 73836.3 | — | — | — | 33.7 | 0.14 | -4 | 27.0 | L | -6 |
| LYM896 | 74356.1 | 1037.5 | 0.23 | 5 | — | — | — | — | — | — |
| LYM896 | 74356.2 | 1085.8 | 0.25 | 10 | — | — | — | — | — | — |
| LYM858 | 74406.1 | 1065.0 | L | 8 | — | — | — | — | — | — |
| LYM842 | 74012.1 | — | — | — | 33.7 | 0.03 | -4 | — | — | — |
| LYM842 | 74012.3 | — | — | — | 34.9 | 0.24 | -1 | — | — | — |
| LYM842 | 74017.6 | 1061.2 | 0.21 | 7 | — | — | — | — | — | — |
| LYM842 | 74017.7 | — | — | — | 34.4 | 0.29 | -2 | 27.4 | 0.03 | -5 |
| LYM835 | 73820.2 | — | — | — | 33.7 | 0.06 | -4 | — | — | — |
| LYM835 | 73825.3 | — | — | — | 33.6 | 0.17 | -5 | — | — | — |
| LYM816 | 74335.1 | 1073.1 | 0.14 | 8 | — | — | — | — | — | — |
| LYM811 | 74385.2 | 1220.6 | 0.10 | 23 | — | — | — | — | — | — |
| LYM791 | 73955.4 | — | — | — | — | — | — | 28.2 | 0.06 | -2 |
| LYM791 | 73957.3 | 1210.0 | L | 22 | — | — | — | — | — | — |
| LYM786 | 74383.2 | 1053.8 | 0.17 | 7 | — | — | — | — | — | — |
| LYM786 | 74383.4 | 1030.0 | 0.08 | 4 | — | — | — | — | — | — |
| LYM779 | 73189.2 | 1193.9 | 0.15 | 21 | 32.9 | L | -7 | 26.9 | 0.19 | -6 |
| LYM779 | 73189.6 | 1080.0 | 0.16 | 9 | — | — | — | — | — | — |
| LYM779 | 73190.2 | 1127.5 | 0.10 | 14 | — | — | — | — | — | — |
| LYM779 | 73192.2 | — | — | — | — | — | — | 28.4 | 0.27 | -1 |
| LYM775 | 74070.2 | 1087.9 | L | 10 | — | — | — | — | — | — |
| LYM761 | 73995.1 | — | — | — | 34.1 | L | -3 | 28.0 | 0.02 | -2 |
| LYM761 | 73999.2 | — | — | — | — | — | — | 28.2 | 0.06 | -2 |
| LYM761 | 73999.3 | 1164.4 | 0.25 | 18 | — | — | — | 28.1 | 0.01 | -2 |
| LYM1000 | 74329.1 | — | — | — | 33.8 | L | -4 | 27.8 | 0.13 | -3 |
| CONT. | — | 989.1 | — | — | 35.2 | — | — | 28.7 | — | — |
| LYM991 | 74205.5 | 1065.6 | 0.19 | 9 | — | — | — | — | — | — |
| LYM991 | 74207.2 | 1129.8 | 0.28 | 15 | — | — | — | — | — | — |
| LYM987 | 74156.7 | 1115.3 | 0.23 | 14 | — | — | — | — | — | — |
| LYM987 | 74160.1 | 1063.8 | 0.16 | 8 | — | — | — | — | — | — |
| LYM938 | 74147.2 | 1019.4 | 0.28 | 4 | — | — | — | — | — | — |
| LYM933 | 73810.2 | — | — | — | — | — | — | 28.7 | 0.26 | -1 |
| LYM904 | 74019.1 | 1036.9 | 0.08 | 6 | — | — | — | — | — | — |
| LYM904 | 74021.1 | 1111.9 | 0.20 | 13 | — | — | — | 28.5 | 0.13 | -2 |
| LYM904 | 74021.2 | 1119.4 | 0.24 | 14 | — | — | — | 28.3 | 0.07 | -3 |
| LYM904 | 74023.2 | 1264.4 | L | 29 | — | — | — | — | — | — |
| LYM897 | 73736.4 | 1113.8 | L | 13 | 35.3 | 0.18 | -2 | 28.4 | 0.21 | -2 |
| LYM897 | 73737.2 | — | — | — | — | — | — | 28.6 | 0.09 | -2 |
| LYM887 | 73827.1 | 1095.0 | 0.30 | 12 | — | — | — | — | — | — |
| LYM887 | 73829.5 | 1051.2 | 0.13 | 7 | — | — | — | — | — | — |
| LYM887 | 73830.3 | 1024.4 | 0.24 | 4 | — | — | — | — | — | — |
| LYM867 | 74417.4 | — | — | — | 34.8 | 0.02 | -3 | 28.2 | 0.20 | -3 |
| LYM867 | 74418.1 | 1140.6 | 0.05 | 16 | — | — | — | 28.7 | 0.26 | -1 |
| LYM864 | 74411.3 | 1061.9 | 0.03 | 8 | — | — | — | — | — | — |

TABLE 98-continued

Genes showing improved plant performance at Normal growth conditions under regulation of At6669 promoter

| Gene Name | Event # | Dry Weight [mg] Ave. | P-Val. | % Incr. | Flowering Ave. | P-Val. | % Incr. | Inflorescence Emergence Ave. | P-Val. | % Incr. |
|---|---|---|---|---|---|---|---|---|---|---|
| LYM852 | 73887.3 | 1065.6 | 0.02 | 9 | — | — | — | — | — | — |
| LYM852 | 73890.1 | 1193.1 | 0.05 | 22 | — | — | — | — | — | — |
| LYM852 | 73890.3 | 1057.5 | 0.09 | 8 | 33.1 | L | −8 | 27.6 | 0.18 | −5 |
| LYM852 | 73891.1 | 1089.4 | 0.02 | 11 | — | — | — | — | — | — |
| LYM851 | 74392.1 | 1193.6 | 0.16 | 22 | — | — | — | 28.7 | 0.25 | −2 |
| LYM851 | 74392.2 | 1175.0 | 0.03 | 20 | — | — | — | — | — | — |
| LYM815 | 74087.2 | 1194.0 | 0.29 | 22 | — | — | — | — | — | — |
| LYM815 | 74088.3 | 1160.0 | L | 18 | — | — | — | — | — | — |
| LYM797 | 73965.1 | 1061.9 | 0.02 | 8 | — | — | — | 28.1 | 0.04 | −3 |
| LYM797 | 73966.3 | — | — | — | — | — | — | 28.8 | 0.27 | −1 |
| LYM797 | 73968.2 | 1128.8 | L | 15 | — | — | — | — | — | — |
| LYM755 | 74043.4 | — | — | — | 35.4 | 0.21 | −1 | 28.5 | 0.13 | −2 |
| LYM755 | 74045.1 | 1229.4 | 0.02 | 25 | — | — | — | — | — | — |
| LYM755 | 74045.3 | 1141.9 | 0.02 | 16 | — | — | — | — | — | — |
| LYM1006 | 74263.1 | 1051.2 | 0.09 | 7 | — | — | — | 28.5 | 0.03 | −2 |
| LYM1006 | 74263.2 | 1098.8 | 0.18 | 12 | — | — | — | — | — | — |
| LYM1006 | 74263.4 | 1047.8 | 0.27 | 7 | — | — | — | — | — | — |
| CONT. | — | 981.6 | — | — | 35.9 | — | — | 29.1 | — | — |
| LYM992 | 74651.2 | 1121.2 | 0.22 | 10 | — | — | — | — | — | — |
| LYM957 | 74199.4 | 1073.8 | L | 5 | — | — | — | — | — | — |
| LYM957 | 74203.5 | 1151.2 | 0.19 | 12 | — | — | — | — | — | — |
| LYM957 | 74203.6 | 1110.0 | L | 8 | — | — | — | — | — | — |
| LYM953 | 74486.2 | 1193.8 | 0.29 | 17 | — | — | — | — | — | — |
| LYM953 | 74486.3 | 1197.5 | 0.03 | 17 | — | — | — | — | — | — |
| LYM953 | 74491.2 | — | — | — | 27.7 | 0.15 | −3 | — | — | — |
| LYM936 | 74480.1 | 1131.9 | 0.07 | 11 | — | — | — | — | — | — |
| LYM936 | 74483.1 | 1078.1 | 0.04 | 5 | — | — | — | — | — | — |
| LYM936 | 74484.1 | 1172.8 | 0.24 | 15 | — | — | — | — | — | — |
| LYM932 | 74479.1 | 1166.2 | 0.22 | 14 | — | — | — | — | — | — |
| LYM932 | 74479.6 | 1123.8 | 0.19 | 10 | — | — | — | — | — | — |
| LYM929 | 74470.1 | 1232.5 | 0.11 | 20 | — | — | — | — | — | — |
| LYM929 | 74473.2 | 1165.6 | 0.14 | 14 | — | — | — | — | — | — |
| LYM929 | 74473.3 | 1095.6 | 0.01 | 7 | — | — | — | — | — | — |
| LYM900 | 74454.2 | 1246.2 | 0.09 | 22 | — | — | — | — | — | — |
| LYM900 | 74454.3 | 1096.9 | 0.02 | 7 | — | — | — | — | — | — |
| LYM900 | 74454.4 | 1209.2 | 0.03 | 18 | — | — | — | — | — | — |
| LYM882 | 74438.4 | 1277.5 | 0.01 | 25 | — | — | — | 21.8 | 0.15 | −3 |
| LYM882 | 74442.2 | 1215.6 | L | 19 | — | — | — | — | — | — |
| LYM857 | 74396.2 | 1155.6 | 0.02 | 13 | — | — | — | — | — | — |
| LYM857 | 74398.1 | 1062.5 | 0.06 | 4 | — | — | — | — | — | — |
| LYM857 | 74401.2 | 1108.8 | 0.14 | 8 | — | — | — | — | — | — |
| LYM840 | 73548.2 | 1056.9 | 0.05 | 3 | — | — | — | — | — | — |
| LYM840 | 73549.1 | 1088.1 | L | 6 | — | — | — | — | — | — |
| LYM802 | 74432.1 | 1064.4 | 0.23 | 4 | — | — | — | — | — | — |
| LYM802 | 74433.1 | 1049.4 | 0.15 | 3 | — | — | — | — | — | — |
| LYM802 | 74434.1 | 1104.4 | L | 8 | — | — | — | — | — | — |
| LYM802 | 74437.4 | 1102.5 | 0.05 | 8 | — | — | — | — | — | — |
| LYM783 | 74373.1 | 1085.0 | L | 6 | — | — | — | — | — | — |
| LYM783 | 74377.2 | 1136.9 | L | 11 | — | — | — | — | — | — |
| LYM771 | 74532.1 | — | — | — | — | — | — | 21.4 | 0.15 | −5 |
| LYM770 | 74519.1 | 1057..5 | 0.03 | 3 | — | — | — | — | — | — |
| LYM754 | 14540.4 | 1148.8 | 0.22 | 12 | — | — | — | — | — | — |
| CONT. | — | 1023.6 | — | — | 28.6 | — | — | 22.5 | — | — |
| LYM984 | 74253.1 | 953.8 | 0.14 | 10 | — | — | — | — | — | — |
| LYM984 | 74256.4 | 968.8 | 0.02 | 11 | — | — | — | — | — | — |
| LYM979 | 74243.2 | 928.8 | 0.29 | 7 | — | — | — | — | — | — |
| LYM963 | 74024.1 | 1039.4 | L | 20 | — | — | — | — | — | — |
| LYM963 | 74025.4 | 1037.5 | 0.20 | 19 | — | — | — | — | — | — |
| LYM963 | 74026.1 | 995.0 | 0.25 | 14 | — | — | — | — | — | — |
| LYM963 | 74026.2 | — | — | — | — | — | — | 31.5 | 0.03 | −2 |
| LYM940 | 73814.1 | 1040.8 | L | 20 | — | — | — | — | — | — |
| LYM940 | 73816.1 | 1018.8 | 0.06 | 17 | — | — | — | — | — | — |
| LYM940 | 73817.1 | 992.5 | 0.08 | 14 | — | — | — | — | — | — |
| LYM940 | 73818.2 | 1006.9 | L | 16 | 38.5 | 0.11 | −2 | 31.7 | 0.03 | −2 |
| LYM905 | 73802.5 | — | — | — | 36.5 | L | −7 | 29.0 | L | −10 |
| LYM905 | 73805.2 | 1059.8 | 0.22 | 22 | — | — | — | — | — | — |
| LYM905 | 73806.3 | 1012.4 | L | 16 | — | — | — | — | — | — |
| LYM905 | 73807.3 | 949.4 | 0.03 | 9 | — | — | — | — | — | — |
| LYM898 | 73460.6 | — | — | — | 37.7 | 0.0 | −4 | — | — | — |
| LYM898 | 73463.4 | 1015.6 | 0.10 | 17 | 38.3 | 0.07 | −2 | — | — | — |
| LYM898 | 73463.6 | 1013.1 | 0.15 | 17 | — | — | — | — | — | — |

TABLE 98-continued

Genes showing improved plant performance at Normal growth conditions under regulation of At6669 promoter

| Gene Name | Event # | Dry Weight [mg] | | | Flowering | | | Inflorescence Emergence | | |
|---|---|---|---|---|---|---|---|---|---|---|
| | | Ave. | P-Val. | % Incr. | Ave. | P-Val. | % Incr. | Ave. | P-Val. | % Incr. |
| LYM878 | 73232.1 | — | — | — | 38.0 | L | −3 | — | — | — |
| LYM878 | 73234.2 | 975.2 | 0.06 | 12 | — | — | — | — | — | — |
| LYM878 | 73236.2 | — | — | — | 37.8 | 0.05 | −3 | — | — | — |
| LYM871 | 74166.1 | 997.3 | 0.21 | 15 | — | — | — | — | — | — |
| LYM849 | 73856.1 | 944.4 | 0.09 | 9 | — | — | — | — | — | — |
| LYM849 | 73858.2 | 932.5 | 0.08 | 7 | — | — | — | — | — | — |
| LYM849 | 73859.2 | 1051.9 | L | 21 | — | — | — | — | — | — |
| LYM849 | 73860.1 | — | — | — | — | — | — | 31.9 | 0.23 | −1 |
| LYM849 | 73861.2 | 982.5 | L | 13 | — | — | — | — | — | — |
| LYM821 | 73988.1 | 970.6 | 0.04 | 12 | — | — | — | — | — | — |
| LYM821 | 73991.4 | 1108.0 | 0.11 | 27 | — | — | — | — | — | — |
| LYM821 | 73992.1 | 1009.2 | 0.22 | 16 | — | — | — | — | — | — |
| LYM821 | 73992.2 | 955.6 | 0.03 | 10 | — | — | — | 31.9 | 0.23 | −1 |
| LYM821 | 73993.3 | 1078.4 | L | 24 | — | — | — | — | — | — |
| LYM812 | 73983.2 | 1050.0 | 0.20 | 21 | — | — | — | — | — | — |
| LYM812 | 73983.7 | 1011.9 | L | 16 | — | — | — | — | — | — |
| LYM812 | 73984.1 | 971.2 | 0.05 | 12 | — | — | — | — | — | — |
| LYM812 | 73985.1 | 1074.4 | 0.03 | 24 | — | — | — | — | — | — |
| LYM804 | 73219.5 | 960.0 | 0.02 | 10 | — | — | — | — | — | — |
| LYM804 | 73222.1 | — | — | — | 36.9 | 0.03 | −6 | 29.1 | L | −10 |
| LYM804 | 73223.1 | 1023.7 | 0.20 | 18 | — | — | — | — | — | — |
| LYM792 | 74169.3 | — | — | — | 38.5 | 0.11 | −2 | 31.9 | 0.23 | −1 |
| LYM792 | 74172.1 | 964.4 | 0.01 | 11 | — | — | — | — | — | — |
| LYM792 | 74172.4 | 1051.2 | 0.05 | 21 | — | — | — | — | — | — |
| LYM775 | 74069.2 | 1001.2 | 0.27 | 15 | — | — | — | — | — | — |
| LYM775 | 74070.1 | 980.0 | 0.02 | 13 | — | — | — | — | — | — |
| LYM766 | 74065.3 | — | — | — | — | — | — | 31.6 | 0.02 | −2 |
| LYM759 | 74056.2 | 1024.4 | L | 18 | — | — | — | — | — | — |
| LYM759 | 74057.5 | 921.9 | 0.11 | 6 | — | — | — | — | — | — |
| LYM759 | 74058.3 | 991.2 | 0.22 | 14 | — | — | — | — | — | — |
| LYM755 | 74043.2 | 995.6 | L | 15 | — | — | — | — | — | — |
| LYM755 | 74043.4 | 990.6 | L | 14 | — | — | — | 31.8 | 0.24 | −1 |
| LYM755 | 74045.1 | 978.1 | 0.01 | 13 | — | — | — | — | — | — |
| LYM755 | 74047.4 | 903.1 | 0.27 | 4 | — | — | — | — | — | — |
| CONT. | — | 869.3 | — | — | 37.2 | — | — | 32.2 | — | — |

Table 98.
"CONT." - Control; "Ave." - Average; "% Incr." = % increment; "p-va;." - p-value, L-p < 0.01.

TABLE 99

Genes showing improved plant performance at Normal growth conditions under regulation of At6669 promoter

| Gene Name | Event # | Leaf Blade Area [cm²] | | | Leaf Number | | | Plot Coverage [cm²] | | |
|---|---|---|---|---|---|---|---|---|---|---|
| | | Ave. | P-Val. | % Incr. | Ave. | P-Val. | % Incr. | Ave. | P-Val. | % Incr. |
| LYM998 | 74217.1 | 1.1 | 0.07 | 14 | — | — | — | 64.1 | 0.10 | 13 |
| LYM998 | 74219.2 | 1.1 | 0.11 | 13 | — | — | — | 63.8 | 0.15 | 12 |
| LYM979 | 74244.3 | 1.1 | 0.15 | 14 | — | — | — | — | — | — |
| LYM967 | 74506.1 | 1.1 | 0.19 | 14 | — | — | — | — | — | — |
| LYM967 | 74506.2 | 1.1 | 0.04 | 16 | — | — | — | 64.6 | 0.09 | 14 |
| LYM967 | 74508.2 | 1.2 | 0.07 | 23 | — | — | — | 65.7 | 0.21 | 16 |
| LYM966 | 74523.1 | — | — | — | 10.9 | 0.20 | 4 | — | — | — |
| LYM966 | 74524.1 | — | — | — | 11.2 | 0.08 | 6 | 72.6 | 0.28 | 28 |
| LYM966 | 74525.1 | — | — | — | — | — | — | 61.0 | 0.29 | 7 |
| LYM966 | 74525.2 | — | — | — | 10.8 | 0.11 | 3 | — | — | — |
| LYM956 | 74498.1 | 1.1 | 0.03 | 17 | — | — | — | 66.5 | 0.12 | 17 |
| LYM954 | 74496.4 | 1.2 | L | 31 | — | — | — | 77.5 | L | 36 |
| LYM954 | 74497.1 | 1.1 | 0.20 | 20 | — | — | — | — | — | — |
| LYM942 | 74665.4 | 1.0 | 0.22 | 8 | — | — | — | 63.8 | 0.11 | 12 |
| LYM927 | 73771.2 | 1.1 | 0.05 | 14 | — | — | — | 63.4 | 0.12 | 12 |
| LYM917 | 74456.1 | 1.2 | 0.22 | 28 | — | — | — | — | — | — |
| LYM917 | 74456.3 | 1.1 | 0.21 | 21 | — | — | — | 69.3 | 0.03 | 22 |
| LYM899 | 74826.3 | 1.0 | 0.24 | 8 | — | — | — | — | — | — |
| LYM899 | 74827.3 | 1.1 | 0.08 | 15 | — | — | — | 67.2 | 0.07 | 18 |
| LYM886 | 74446.1 | — | — | — | — | — | — | 63.3 | 0.14 | 11 |
| LYM886 | 74446.4 | 1.3 | L | 40 | — | — | — | 80.6 | L | 42 |

TABLE 99-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM886 | 74447.6 | 1.4 | L | 48 | — | — | — | 80.3 | 0.09 | 41 |
| LYM886 | 74448.4 | 1.1 | 0.04 | 16 | — | — | — | 63.1 | 0.21 | 11 |
| LYM879 | 74602.1 | 1.2 | 0.23 | 30 | 11.0 | 0.02 | 5 | 74.7 | 0.15 | 32 |
| LYM879 | 74604.2 | — | — | — | 11.4 | 0.23 | 8 | 79.2 | 0.27 | 39 |
| LYM879 | 74605.1 | 1.3 | L | 36 | 10.9 | 0.06 | 3 | 80.0 | L | 41 |
| LYM820 | 74585.2 | 1.1 | 0.08 | 15 | — | — | — | 65.3 | 0.17 | 15 |
| LYM820 | 74587.1 | — | — | — | 10.8 | 0.17 | 2 | — | — | — |
| LYM811 | 74385.2 | 1.0 | 0.12 | 11 | 11.1 | 0.19 | 6 | 66.3 | 0.21 | 17 |
| LYM811 | 74388.2 | 1.1 | 0.09 | 13 | — | — | — | 64.1 | 0.13 | 13 |
| LYM811 | 74389.1 | 1.0 | 0.29 | 7 | 10.9 | 0.06 | 3 | 65.3 | 0.09 | 15 |
| LYM800 | 74576.1 | 1.1 | 0.26 | 17 | — | — | — | 65.5 | 0.19 | 15 |
| LYM800 | 74579.2 | 1.0 | 0.30 | 8 | — | — | — | — | — | — |
| LYM1004 | 74340.1 | 1.2 | 0.22 | 25 | — | — | — | 71.2 | 0.29 | 25 |
| CONT. | — | 0.9 | — | — | 10.5 | — | — | 56.8 | — | — |
| LYM986 | 73532.1 | 0.9 | 0.04 | 11 | — | — | — | 56.6 | 0.04 | 11 |
| LYM986 | 73532.2 | 1.0 | L | 22 | — | — | — | 61.4 | 0.07 | 20 |
| LYM986 | 73533.3 | 1.0 | 0.15 | 14 | — | — | — | 58.7 | 0.05 | 15 |
| LYM985 | 73526.1 | 0.9 | 0.10 | 8 | — | — | — | — | — | — |
| LYM949 | 73521.2 | — | — | — | 10.4 | 0.14 | 5 | — | — | — |
| LYM949 | 73525.4 | — | — | — | 10.4 | 0.14 | 5 | — | — | — |
| LYM947 | 73297.4 | 0.9 | 0.05 | 11 | — | — | — | — | — | — |
| LYM947 | 73299.2 | 1.0 | 0.11 | 16 | — | — | — | — | — | — |
| LYM891 | 73720.2 | 1.0 | 0.01 | 17 | — | — | — | 60.6 | 0.21 | 19 |
| LYM891 | 73720.3 | 1.0 | 0.03 | 17 | — | — | — | 57.4 | 0.22 | 12 |
| LYM885 | 73282.1 | 1.1 | 0.10 | 31 | — | — | — | 63.5 | 0.20 | 24 |
| LYM885 | 73283.1 | 1.0 | 0.14 | 20 | — | — | — | 60.4 | L | 18 |
| LYM885 | 73283.3 | 1.0 | 0.06 | 19 | — | — | — | 57.0 | 0.03 | 11 |
| LYM881 | 73592.1 | 1.0 | 0.14 | 16 | — | — | — | 58.9 | 0.29 | 15 |
| LYM881 | 73592.2 | 1.1 | L | 27 | 10.6 | 0.02 | 7 | 64.8 | L | 27 |
| LYM881 | 73596.2 | 0.9 | 0.18 | 7 | — | — | — | — | — | — |
| LYM878 | 73234.2 | 1.0 | 0.26 | 12 | — | — | — | 58.5 | 0.01 | 14 |
| LYM878 | 73235.2 | 0.9 | 0.05 | 10 | — | — | — | — | — | — |
| LYM875 | 73516.4 | 0.9 | 0.19 | 9 | — | — | — | 54.7 | 0.17 | 7 |
| LYM875 | 73516.5 | — | — | — | — | — | — | 58.1 | 0.05 | 14 |
| LYM875 | 73518.1 | 1.1 | 0.12 | 23 | — | — | — | — | — | — |
| LYM874 | 73584.1 | 0.9 | 0.05 | 11 | — | — | — | — | — | — |
| LYM874 | 73584.2 | 1.0 | 0.03 | 13 | 10.2 | 0.14 | 3 | 60.3 | L | 18 |
| LYM874 | 73585.1 | 1.0 | L | 22 | 10.4 | 0.27 | 5 | 64.3 | L | 26 |
| LYM844 | 73196.2 | 0.9 | 0.22 | 6 | — | — | — | — | — | — |
| LYM844 | 73197.2 | 1.1 | 0.06 | 24 | 10.4 | 0.02 | 5 | 61.6 | 0.02 | 21 |
| LYM844 | 73197.3 | 1.1 | L | 27 | 10.3 | 0.21 | 4 | 63.4 | L | 24 |
| LYM844 | 73199.1 | 1.0 | 0.11 | 17 | — | — | — | 58.8 | 0.18 | 15 |
| LYM827 | 73432.4 | 1.1 | 0.13 | 28 | — | — | — | 66.1 | 0.29 | 29 |
| LYM827 | 73434.3 | 0.9 | 0.22 | 9 | — | — | — | — | — | — |
| LYM804 | 73221.2 | — | — | — | — | — | — | 55.4 | 0.17 | 8 |
| LYM804 | 73222.1 | 1.0 | 0.25 | 19 | — | — | — | — | — | — |
| LYM769 | 73598.3 | 0.9 | 0.19 | 8 | — | — | — | — | — | — |
| LYM769 | 73599.1 | 0.9 | 0.21 | 6 | — | — | — | — | — | — |
| LYM769 | 73600.4 | 1.1 | 0.18 | 23 | 10.3 | 0.04 | 4 | 61.2 | 0.26 | 20 |
| LYM1009 | 73141.2 | 1.0 | 0.12 | 16 | 10.5 | 0.03 | 6 | 60.1 | 0.22 | 17 |
| LYM1009 | 73141.5 | 0.9 | 0.09 | 11 | — | — | — | 55.6 | 0.24 | 9 |
| LYM1009 | 73143.1 | 0.9 | 0.29 | 10 | — | — | — | — | — | — |
| LYM1009 | 73143.2 | — | — | — | — | — | — | 55.2 | 0.18 | 8 |
| CONT. | — | 0.9 | — | — | 9.9 | — | — | 51.1 | — | — |
| LYM996 | 73563.3 | 1.0 | 0.24 | 5 | — | — | — | — | — | — |
| LYM996 | 73564.1 | — | — | — | — | — | — | 60.8 | 0.17 | 8 |
| LYM996 | 73566.3 | 1.2 | 0.15 | 24 | 11.1 | 0.14 | 6 | 69.7 | 0.01 | 24 |
| LYM962 | 73613.3 | 1.0 | 0.10 | 9 | — | — | — | — | — | — |
| LYM962 | 73613.4 | 1.1 | 0.16 | 21 | — | — | — | — | — | — |
| LYM962 | 73615.2 | 1.2 | 0.02 | 24 | — | — | — | 67.1 | 0.02 | 19 |
| LYM937 | 73553.1 | 1.0 | 0.09 | 11 | — | — | — | 62.3 | 0.14 | 11 |
| LYM923 | 73286.4 | 1.0 | 0.17 | 8 | — | — | — | — | — | — |
| LYM923 | 73287.1 | 1.1 | L | 15 | — | — | — | 62.4 | 0.08 | 11 |
| LYM923 | 73287.4 | — | — | — | — | — | — | 60.6 | 0.26 | 8 |
| LYM916 | 73238.1 | 1.1 | L | 18 | — | — | — | 65.0 | 0.03 | 16 |
| LYM916 | 73238.3 | 1.1 | L | 20 | — | — | — | 69.1 | L | 23 |
| LYM916 | 73240.2 | 1.2 | 0.16 | 29 | — | — | — | 72.7 | 0.24 | 29 |
| LYM916 | 73241.1 | 1.0 | 0.17 | 12 | — | — | — | — | — | — |
| LYM898 | 73460.6 | 1.0 | 0.06 | 8 | — | — | — | — | — | — |
| LYM898 | 73463.1 | 1.0 | 0.02 | 11 | — | — | — | 63.0 | 0.19 | 12 |
| LYM898 | 73463.4 | 1.2 | 0.06 | 24 | — | — | — | 69.5 | L | 24 |
| LYM898 | 73463.6 | 1.0 | 0.08 | 8 | — | — | — | — | — | — |
| LYM892 | 73724.4 | 1.1 | 0.10 | 15 | — | — | — | 64.6 | 0.12 | 15 |

TABLE 99-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM892 | 73729.3 | 1.2 | 0.18 | 29 | — | — | — | 71.8 | 0.25 | 28 |
| LYM884 | 73207.1 | 1.1 | 0.04 | 14 | — | — | — | 62.1 | 0.10 | 10 |
| LYM884 | 73209.2 | 1.0 | 0.11 | 7 | — | — | — | — | — | — |
| LYM884 | 73210.2 | 1.0 | 0.15 | 7 | — | — | — | — | — | — |
| LYM884 | 73211.1 | 1.0 | 0.19 | 10 | — | — | — | — | — | — |
| LYM884 | 73212.2 | 1.1 | 0.02 | 21 | — | — | — | 70.3 | L | 25 |
| LYM877 | 73201.1 | 1.0 | 0.23 | 11 | — | — | — | 62.1 | 0.26 | 10 |
| LYM877 | 73203.1 | 1.1 | L | 13 | — | — | — | 65.0 | 0.30 | 16 |
| LYM873 | 73712.5 | 1.1 | 0.20 | 20 | — | — | — | 68.6 | 0.24 | 22 |
| LYM873 | 73716.1 | 1.2 | 0.17 | 24 | — | — | — | 72.4 | 0.24 | 29 |
| LYM868 | 73572.1 | 1.0 | 0.13 | 7 | — | — | — | 61.4 | 0.13 | 9 |
| LYM868 | 73573.2 | — | — | — | 11.1 | 0.11 | 6 | 74.5 | 0.23 | 33 |
| LYM866 | 73707.3 | 1.1 | 0.05 | 13 | — | — | — | — | — | — |
| LYM866 | 73708.2 | 1.0 | 0.20 | 6 | — | — | — | — | — | — |
| LYM866 | 73709.3 | 1.0 | 0.21 | 9 | 11.1 | 0.09 | 7 | 65.1 | 0.16 | 16 |
| LYM866 | 73710.1 | 1.0 | 0.30 | 10 | — | — | — | — | — | — |
| LYM853 | 73700.4 | 1.0 | 0.11 | 7 | — | — | — | 63.2 | 0.09 | 12 |
| LYM853 | 73701.2 | 1.0 | 0.24 | 11 | — | — | — | — | — | — |
| LYM853 | 73702.1 | 1.0 | 0.28 | 8 | — | — | — | — | — | — |
| LYM853 | 73702.2 | 1.1 | 0.03 | 12 | — | — | — | — | — | — |
| LYM853 | 73703.1 | 1.2 | 0.11 | 31 | — | — | — | 73.6 | 0.13 | 31 |
| LYM840 | 73547.1 | 1.1 | L | 17 | — | — | — | 65.9 | 0.05 | 17 |
| LYM840 | 73547.2 | 1.1 | 0.30 | 14 | — | — | — | — | — | — |
| LYM840 | 73549.1 | 1.1 | 0.08 | 17 | — | — | — | 67.7 | 0.08 | 20 |
| LYM837 | 73665.4 | 1.0 | 0.21 | 10 | — | — | — | — | — | — |
| LYM837 | 73666.3 | 1.0 | 0.04 | 11 | — | — | — | 61.8 | 0.14 | 10 |
| LYM837 | 73668.3 | 1.0 | 0.05 | 9 | 11.5 | 0.12 | 10 | 63.7 | 0.04 | 13 |
| LYM764 | 73155.4 | 1.2 | L | 24 | 11.2 | 0.17 | 7 | 70.8 | 0.02 | 26 |
| LYM764 | 73156.2 | 1.3 | 0.14 | 36 | 11.8 | 0.18 | 13 | 80.0 | 0.17 | 42 |
| LYM764 | 73156.4 | 1.1 | 0.12 | 12 | — | — | — | 66.6 | 0.02 | 18 |
| LYM764 | 73157.1 | 1.0 | 0.07 | 9 | — | — | — | 60.9 | 0.17 | 8 |
| LYM763 | 73457.2 | — | — | — | — | — | — | 62.1 | 0.18 | 10 |
| LYM763 | 73457.3 | 1.2 | L | 24 | — | — | — | 73.3 | L | 30 |
| LYM763 | 73458.2 | 1.0 | 0.27 | 8 | — | — | — | — | — | — |
| LYM763 | 73458.5 | 1.2 | 0.02 | 25 | 11.0 | 0.14 | 6 | 69.6 | 0.05 | 24 |
| LYM763 | 73459.1 | 1.0 | 0.18 | 6 | — | — | — | 61.9 | 0.10 | 10 |
| LYM762 | 73148.4 | 1.0 | 0.02 | 11 | — | — | — | 65.7 | 0.02 | 17 |
| LYM762 | 73149.3 | 1.0 | 0.22 | 5 | — | — | — | 61.0 | 0.17 | 9 |
| LYM762 | 73149.5 | — | — | — | — | — | — | 65.1 | 0.18 | 16 |
| LYM762 | 73151.1 | — | — | — | 10.9 | 0.22 | 5 | 61.7 | 0.29 | 10 |
| CONT. | — | 0.9 | — | — | 10.4 | — | — | 56.2 | — | — |
| LYM985 | 73526.1 | — | — | — | 10.9 | 0.26 | 4 | — | — | — |
| LYM985 | 73528.1 | 1.0 | L | 13 | — | — | — | 60.9 | 0.18 | 10 |
| LYM985 | 73529.2 | 1.1 | 0.23 | 29 | — | — | — | 72.7 | 0.19 | 31 |
| LYM985 | 73530.1 | 1.1 | 0.22 | 23 | — | — | — | 64.4 | 0.02 | 16 |
| LYM939 | 74150.5 | 1.1 | 0.06 | 30 | — | L | — | 70.8 | L | 28 |
| LYM939 | 74153.1 | — | — | — | 11.5 | L | 10 | — | — | — |
| LYM939 | 74154.1 | 1.0 | L | 19 | 11.4 | L | 9 | 71.9 | 0.02 | 30 |
| LYM938 | 74144.1 | 1.0 | 0.20 | 20 | — | — | — | 61.9 | 0.07 | 12 |
| LYM938 | 74147.2 | 1.0 | L | 16 | — | — | — | — | — | — |
| LYM938 | 74148.1 | 0.9 | 0.19 | 6 | — | — | — | 60.4 | 0.06 | 9 |
| LYM937 | 73550.1 | 1.0 | L | 12 | — | — | — | 60.5 | 0.12 | 9 |
| LYM937 | 73551.1 | 0.9 | 0.25 | 9 | 11.2 | 0.17 | 7 | 60.8 | 0.15 | 10 |
| LYM937 | 73552.2 | 1.0 | 0.29 | 10 | — | — | — | 61.6 | 0.18 | 11 |
| LYM937 | 73553.1 | — | — | — | 11.3 | 0.24 | 9 | 70.4 | 0.17 | 27 |
| LYM931 | 73844.1 | 1.0 | 0.18 | 13 | — | — | — | — | — | — |
| LYM931 | 73844.2 | 1.0 | 0.01 | 11 | — | — | — | 58.4 | 0.18 | 5 |
| LYM931 | 73844.3 | 1.1 | L | 30 | 11.5 | 0.15 | 10 | 73.9 | 0.14 | 33 |
| LYM931 | 73847.1 | 1.0 | 0.08 | 18 | 11.1 | 0.13 | 7 | 67.1 | 0.24 | 21 |
| LYM889 | 73790.1 | 0.9 | 0.29 | 3 | — | — | — | — | — | — |
| LYM889 | 73793.2 | — | — | — | 11.1 | 0.02 | 6 | — | — | — |
| LYM877 | 73202.3 | 1.1 | 0.19 | 32 | — | — | — | — | — | — |
| LYM875 | 73516.5 | 1.0 | 0.07 | 15 | 10.9 | 0.26 | 4 | 63.3 | L | 14 |
| LYM875 | 73518.1 | 1.1 | 0.14 | 23 | 11.0 | 0.05 | 6 | 72.1 | L | 30 |
| LYM842 | 74012.1 | 1.2 | 0.22 | 35 | 10.7 | 0.25 | 3 | — | — | — |
| LYM807 | 73976.2 | 0.9 | 0.30 | 8 | 10.8 | 0.23 | 4 | — | — | — |
| LYM807 | 73978.2 | 1.1 | 0.16 | 23 | — | — | — | 65.6 | L | 18 |
| LYM807 | 73980.1 | 1.0 | 0.04 | 16 | — | — | — | 62.4 | 0.07 | 13 |
| LYM807 | 73980.3 | 1.1 | 0.19 | 31 | 11.8 | L | 13 | 70.5 | 0.20 | 27 |
| LYM807 | 73981.3 | 1.0 | 0.21 | 20 | — | — | — | 64.9 | 0.13 | 17 |
| LYM806 | 73971.3 | 1.0 | L | 13 | — | — | — | — | — | — |
| LYM806 | 73971.4 | 1.1 | 0.02 | 25 | — | — | — | 65.5 | 0.04 | 18 |
| LYM806 | 73975.2 | — | — | — | 11.5 | 0.05 | 10 | 66.4 | 0.24 | 20 |

TABLE 99-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM803 | 74213.5 | — | — | — | 11.1 | 0.26 | 7 | — | — | — |
| LYM803 | 74213.6 | 1.1 | L | 28 | — | — | — | 70.7 | L | 28 |
| LYM803 | 74215.5 | — | — | — | — | — | — | 65.9 | 0.12 | 19 |
| LYM795 | 73958.3 | 1.1 | 0.09 | 32 | — | — | — | 74.1 | 0.07 | 34 |
| LYM795 | 73960.2 | — | — | — | — | — | — | 58.0 | 0.24 | 5 |
| LYM795 | 73960.4 | 1.0 | 0.03 | 20 | 11.1 | 0.13 | 7 | 65.0 | 0.09 | 17 |
| LYM795 | 73963.1 | 1.0 | 0.01 | 9 | — | — | — | 62.2 | 0.16 | 12 |
| LYM791 | 73952.1 | — | — | — | 10.9 | 0.05 | 5 | — | — | — |
| LYM791 | 73952.2 | 1.2 | L | 34 | — | — | — | 77.0 | 0.04 | 39 |
| LYM791 | 73957.2 | — | — | — | 10.9 | 0.13 | 5 | — | — | — |
| LYM784 | 74081.1 | — | — | — | 10.9 | 0.13 | 5 | 60.6 | 0.04 | 9 |
| LYM784 | 74081.3 | 1.0 | 0.18 | 15 | — | — | — | 65.8 | 0.20 | 19 |
| LYM784 | 74083.1 | 1.0 | 0.04 | 11 | — | — | — | 63.7 | L | 15 |
| LYM781 | 73948.2 | 1.0 | 0.05 | 16 | 10.8 | 0.11 | 4 | 62.7 | 0.04 | 13 |
| LYM781 | 73950.1 | 1.0 | 0.02 | 11 | 11.2 | 0.17 | 7 | 65.5 | L | 18 |
| LYM781 | 73950.2 | 1.1 | 0.08 | 31 | — | — | — | 71.6 | 0.05 | 29 |
| LYM764 | 73156.2 | — | — | — | 11.4 | L | 9 | — | — | — |
| LYM764 | 73156.3 | 1.0 | 0.06 | 20 | — | — | — | 62.3 | 0.19 | 12 |
| LYM764 | 73156.4 | 0.9 | 0.07 | 6 | — | — | — | — | — | — |
| LYM764 | 73157.1 | — | — | — | 11.3 | 0.14 | 9 | — | — | — |
| LYM1008 | 73135.1 | 1.0 | 0.16 | 13 | — | — | — | — | — | — |
| LYM1008 | 73140.6 | 0.9 | 0.25 | 7 | 11.0 | 0.05 | 6 | 62.5 | 0.01 | 13 |
| CONT. | — | 0.9 | — | — | 10.4 | — | — | 55.4 | — | — |
| LYM989 | 74222.1 | — | — | — | 9.7 | 0.04 | 6 | — | — | — |
| LYM952 | 74249.2 | 0.6 | 0.04 | 24 | — | — | — | 35.8 | 0.16 | 21 |
| LYM952 | 74251.2 | 0.6 | 0.12 | 14 | 9.8 | 0.05 | 6 | 34.2 | 0.10 | 16 |
| LYM952 | 74251.4 | 0.6 | 0.12 | 14 | 9.5 | 0.22 | 4 | 35.5 | 0.05 | 20 |
| LYM913 | 74364.1 | — | — | — | 9.9 | 0.05 | 8 | — | — | — |
| LYM909 | 73832.1 | — | — | — | 9.5 | 0.22 | 4 | 32.9 | 0.24 | 11 |
| LYM909 | 73835.1 | — | — | — | 9.6 | 0.10 | 5 | — | — | — |
| LYM909 | 73836.3 | — | — | — | — | — | — | 33.3 | 0.17 | 13 |
| LYM858 | 74406.1 | — | — | — | 9.8 | 0.02 | 7 | — | — | — |
| LYM842 | 74012.1 | 0.6 | 0.11 | 18 | 9.8 | 0.05 | 6 | 37.5 | 0.02 | 27 |
| LYM842 | 74012.3 | — | — | — | — | — | — | 33.3 | 0.18 | 13 |
| LYM842 | 74017.7 | 0.7 | L | 30 | — | — | — | 38.2 | 0.01 | 29 |
| LYM816 | 74332.2 | 0.6 | 0.17 | 14 | 9.6 | 0.11 | 4 | 34.5 | 0.11 | 17 |
| LYM816 | 74335.1 | 0.7 | 0.09 | 41 | — | — | — | 41.1 | 0.28 | 39 |
| LYM811 | 74388.2 | 0.6 | 0.19 | 26 | — | — | — | 37.0 | 0.15 | 25 |
| LYM791 | 73952.1 | 0.6 | 0.24 | 15 | — | — | — | 35.2 | 0.26 | 19 |
| LYM791 | 73952.2 | — | — | — | 9.8 | 0.02 | 7 | — | — | — |
| LYM791 | 73955.4 | 0.6 | 0.12 | 16 | 10.2 | 0.22 | 11 | 35.1 | 0.13 | 19 |
| LYM791 | 73957.2 | — | — | — | — | — | — | 37.6 | 0.25 | 27 |
| LYM791 | 73957.3 | — | — | — | 9.7 | 0.26 | 6 | — | — | — |
| LYM786 | 74383.3 | 0.6 | 0.16 | 13 | — | — | — | 32.8 | 0.22 | 11 |
| LYM786 | 74383.4 | 0.6 | 0.12 | 15 | 9.4 | 0.25 | 3 | 33.0 | 0.21 | 12 |
| LYM779 | 73189.2 | 0.6 | 0.24 | 12 | 9.4 | 0.25 | 3 | 34.8 | 0.08 | 18 |
| LYM779 | 73190.2 | 0.6 | 0.26 | 11 | 9.6 | 0.24 | 4 | — | — | — |
| LYM775 | 74066.1 | — | — | — | 9.8 | 0.05 | 6 | — | — | — |
| LYM761 | 73995.3 | — | — | — | 9.6 | 0.10 | 5 | — | — | — |
| LYM761 | 73999.2 | — | — | — | 9.4 | 0.25 | 3 | — | — | — |
| LYM1004 | 74338.2 | 0.7 | 0.18 | 37 | — | — | — | 40.1 | 0.11 | 36 |
| LYM1000 | 74328.4 | 0.6 | 0.18 | 17 | 9.6 | 0.10 | 5 | 36.2 | 0.19 | 22 |
| LYM1000 | 74329.1 | — | — | — | 9.6 | 0.06 | 5 | — | — | — |
| CONT. | — | 0.5 | — | — | 9.2 | — | — | 29.5 | — | — |
| LYM991 | 74208.3 | 0.9 | 0.21 | 14 | — | — | — | 52.5 | 0.07 | 13 |
| LYM987 | 74157.1 | — | — | — | 10.2 | 0.21 | 3 | — | — | — |
| LYM987 | 74157.2 | 0.9 | L | 9 | — | — | — | 48.6 | 0.06 | 5 |
| LYM938 | 74146.4 | 0.9 | L | 16 | — | — | — | 52.5 | 0.29 | 13 |
| LYM933 | 73810.2 | 1.0 | 0.16 | 24 | — | — | — | — | — | — |
| LYM933 | 73812.1 | 0.8 | 0.14 | 3 | — | — | — | — | — | — |
| LYM933 | 73812.5 | 0.9 | L | 8 | — | — | — | 51.3 | L | 11 |
| LYM904 | 74021.2 | 0.9 | L | 14 | — | — | — | 55.3 | 0.05 | 19 |
| LYM897 | 73736.4 | 0.9 | L | 12 | 10.4 | 0.04 | 6 | 55.0 | 0.04 | 19 |
| LYM897 | 73741.3 | 0.9 | 0.30 | 14 | — | — | — | 52.3 | 0.26 | 13 |
| LYM887 | 73827.1 | 0.9 | 0.27 | 18 | — | — | — | 55.2 | 0.28 | 19 |
| LYM887 | 73829.5 | 0.9 | 0.06 | 6 | — | — | — | — | — | — |
| LYM870 | 74420.1 | 0.9 | 0.14 | 7 | — | — | — | 51.9 | 0.17 | 12 |
| LYM870 | 74424.3 | 0.9 | 0.07 | 12 | — | — | — | 51.8 | 0.05 | 12 |
| LYM867 | 74417.2 | 0.8 | 0.05 | 5 | — | — | — | — | — | — |
| LYM867 | 74417.4 | 0.8 | 0.25 | 4 | — | — | — | — | — | — |
| LYM867 | 74418.1 | 0.9 | 0.23 | 17 | — | — | — | 59.8 | 0.09 | 29 |
| LYM864 | 74409.1 | 0.9 | L | 16 | — | — | — | 52.6 | L | 14 |
| LYM864 | 74409.4 | 0.9 | 0.27 | 13 | — | — | — | — | — | — |

TABLE 99-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM864 | 74412.4 | 1.0 | L | 19 | — | — | — | 54.7 | L | 18 |
| LYM852 | 73888.5 | 0.9 | 0.22 | 18 | — | — | — | 56.0 | 0.02 | 21 |
| LYM852 | 73890.1 | 0.9 | 0.02 | 8 | — | — | — | 48.3 | 0.26 | 4 |
| LYM852 | 73890.3 | 0.9 | L | 17 | 10.4 | 0.25 | 5 | 57.0 | L | 23 |
| LYM851 | 74392.1 | 1.0 | L | 22 | — | — | — | 59.1 | 0.07 | 28 |
| LYM851 | 74392.2 | 0.9 | 0.02 | 16 | — | — | — | 55.6 | L | 20 |
| LYM851 | 74393.1 | 0.9 | 0.03 | 7 | — | — | — | 52.2 | 0.02 | 13 |
| LYM851 | 74393.2 | 0.8 | 0.12 | 5 | — | — | — | 49.7 | 0.25 | 7 |
| LYM815 | 74087.3 | — | — | — | — | — | — | 52.7 | 0.23 | 14 |
| LYM815 | 74088.3 | 1.0 | L | 20 | — | — | — | 57.3 | L | 24 |
| LYM812 | 73984.1 | 0.9 | L | 9 | — | — | — | 50.4 | L | 9 |
| LYM803 | 74213.6 | 0.8 | 0.13 | 4 | — | — | — | — | — | — |
| LYM797 | 73965.1 | 0.9 | 0.25 | 16 | — | — | — | 57.9 | 0.20 | 25 |
| LYM797 | 73966.3 | — | — | — | — | — | — | 48.8 | 0.05 | 6 |
| LYM755 | 74043.4 | 0.9 | L | 16 | 10.4 | 0.25 | 5 | 58.5 | L | 26 |
| LYM755 | 74045.3 | 1.0 | L | 26 | — | — | — | 61.6 | L | 33 |
| LYM1006 | 74259.1 | 0.9 | 0.15 | 14 | — | — | — | 53.9 | 0.25 | 16 |
| LYM1006 | 74263.1 | 0.9 | 0.22 | 16 | 10.6 | 0.02 | 7 | 58.0 | 0.07 | 25 |
| CONT. | — | 0.8 | — | — | 9.9 | — | — | 46.3 | — | — |
| LYM992 | 74649.3 | 1.2 | L | 15 | 10.4 | 0.30 | 5 | 68.0 | 0.02 | 16 |
| LYM992 | 74649.4 | 1.1 | 0.26 | 6 | — | — | — | 65.1 | 0.01 | 12 |
| LYM992 | 74651.2 | 1.1 | 0.04 | 13 | 10.2 | 0.24 | 3 | 65.2 | L | 12 |
| LYM992 | 74653.4 | 1.2 | 0.26 | 16 | 10.2 | 0.20 | 3 | 69.3 | 0.19 | 19 |
| LYM957 | 74203.6 | 1.2 | 0.23 | 14 | — | — | — | 65.6 | 0.23 | 12 |
| LYM953 | 74487.1 | — | — | — | 10.4 | 0.13 | 5 | 66.0 | 0.09 | 13 |
| LYM953 | 74488.1 | 1.2 | L | 19 | — | — | — | 68.7 | 0.14 | 18 |
| LYM936 | 74482.1 | — | — | — | 10.9 | L | 10 | — | — | — |
| LYM932 | 74479.1 | — | — | — | 10.3 | 0.22 | 4 | 62.3 | 0.22 | 7 |
| LYM929 | 74468.3 | 1.1 | 0.21 | 12 | 10.3 | 0.10 | 4 | 66.4 | 0.11 | 14 |
| LYM929 | 74470.1 | — | — | — | — | — | — | 63.3 | 0.08 | 9 |
| LYM929 | 74473.2 | 1.1 | 0.05 | 9 | — | — | — | 63.6 | 0.19 | 9 |
| LYM920 | 74462.1 | 1.2 | 0.11 | 17 | 10.6 | 0.08 | 7 | 72.1 | L | 24 |
| LYM920 | 74464.1 | 1.1 | 0.16 | 5 | — | — | — | — | — | — |
| LYM920 | 74465.2 | — | — | — | — | — | — | 60.8 | 0.25 | 4 |
| LYM900 | 74454.4 | 1.2 | L | 17 | 11.3 | L | 14 | 73.8 | L | 26 |
| LYM882 | 74438.4 | 1.1 | 0.25 | 8 | 10.5 | 0.03 | 6 | 65.1 | 0.28 | 12 |
| LYM882 | 74442.3 | 1.2 | 0.29 | 17 | — | — | — | — | — | — |
| LYM857 | 74396.2 | 1.2 | 0.01 | 21 | 10.2 | 0.15 | 3 | 71.1 | 0.05 | 22 |
| LYM857 | 74398.1 | 1.1 | 0.23 | 5 | — | — | — | — | — | — |
| LYM840 | 73547.1 | 1.1 | 0.23 | 6 | — | — | — | 61.9 | 0.23 | 6 |
| LYM840 | 73548.1 | 1.1 | 0.30 | 11 | — | — | — | 66.7 | L | 14 |
| LYM802 | 74434.1 | 1.1 | 0.01 | 9 | 10.4 | 0.30 | 5 | 68.5 | L | 17 |
| LYM787 | 74568.3 | 1.2 | 0.01 | 14 | — | — | — | 69.4 | 0.09 | 19 |
| LYM771 | 74528.1 | 1.2 | L | 13 | 10.2 | 0.24 | 3 | 67.7 | 0.12 | 16 |
| LYM771 | 74530.2 | — | — | — | 10.4 | 0.10 | 5 | — | — | — |
| LYM771 | 74532.1 | 1.2 | 0.29 | 16 | — | — | — | — | — | — |
| LYM770 | 74516.2 | — | — | — | 10.2 | 0.24 | 3 | 63.9 | 0.07 | 10 |
| LYM770 | 74519.1 | 1.1 | 0.17 | 4 | — | — | — | 60.7 | 0.27 | 4 |
| CONT. | — | 1.0 | — | — | 9.9 | — | — | 58.4 | — | — |
| LYM984 | 74253.1 | 1.3 | 0.27 | 14 | — | — | — | — | — | — |
| LYM984 | 74253.3 | 1.3 | 0.13 | 19 | 11.8 | 0.17 | 5 | 87.4 | 0.03 | 20 |
| LYM984 | 74256.2 | 1.3 | 0.08 | 12 | — | — | — | — | — | — |
| LYM984 | 74256.4 | — | — | — | 11.7 | 0.28 | 5 | — | — | — |
| LYM984 | 74257.6 | 1.3 | 0.10 | 15 | — | — | — | 82.2 | 0.10 | 13 |
| LYM979 | 74243.1 | 1.2 | 0.26 | 9 | 12.2 | L | 10 | 81.6 | 0.11 | 12 |
| LYM979 | 74243.2 | — | — | — | 11.6 | 0.20 | 4 | — | — | — |
| LYM979 | 74244.3 | — | — | — | 11.6 | 0.05 | 4 | — | — | — |
| LYM963 | 74025.4 | 1.2 | 0.30 | 7 | 11.8 | 0.22 | 6 | 81.9 | 0.03 | 13 |
| LYM963 | 74026.2 | 1.3 | 0.02 | 18 | 11.4 | 0.19 | 3 | 91.3 | L | 26 |
| LYM963 | 74029.3 | — | — | — | 12.1 | 0.27 | 9 | — | — | — |
| LYM940 | 73816.1 | — | — | — | 11.9 | 0.26 | 7 | — | — | — |
| LYM940 | 73817.1 | — | — | — | 12.1 | 0.14 | 8 | — | — | — |
| LYM940 | 73818.2 | 1.3 | 0.02 | 20 | — | — | — | 87.1 | L | 20 |
| LYM905 | 73802.5 | 1.3 | 0.05 | 14 | — | — | — | 86.6 | 0.02 | 19 |
| LYM905 | 73805.2 | — | — | — | 11.9 | 0.05 | 7 | — | — | — |
| LYM905 | 73807.3 | — | — | — | 11.4 | 0.19 | 3 | — | — | — |
| LYM898 | 73460.6 | 1.3 | 0.16 | 16 | 11.6 | 0.25 | 4 | 88.9 | 0.12 | 22 |
| LYM898 | 73463.4 | 1.2 | 0.22 | 11 | 12.0 | 0.21 | 8 | 88.5 | 0.02 | 22 |
| LYM898 | 73463.6 | — | — | — | — | — | — | 82.1 | 0.15 | 13 |
| LYM878 | 73232.1 | 1.3 | 0.02 | 18 | 11.6 | 0.08 | 4 | 88.1 | L | 21 |
| LYM878 | 73232.4 | — | — | — | 12.1 | L | 9 | 78.8 | 0.18 | 8 |
| LYM878 | 73235.2 | 1.2 | 0.23 | 8 | — | — | — | 82.9 | 0.02 | 14 |
| LYM878 | 73236.2 | 1.4 | 0.13 | 24 | — | — | — | 85.7 | L | 18 |

TABLE 99-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM871 | 74164.2 | — | — | — | 11.8 | 0.02 | 5 | 81.6 | 0.28 | 12 |
| LYM871 | 74166.1 | — | — | — | 11.6 | 0.25 | 4 | — | — | — |
| LYM871 | 74166.2 | 1.3 | 0.21 | 11 | — | — | — | 84.3 | 0.14 | 16 |
| LYM871 | 74167.2 | 1.3 | 0.11 | 13 | — | — | — | 79.2 | 0.23 | 9 |
| LYM849 | 73856.1 | — | — | — | 11.7 | 0.03 | 5 | — | — | — |
| LYM849 | 73859.2 | 1.4 | 0.04 | 23 | — | — | — | 91.9 | L | 26 |
| LYM849 | 73860.1 | — | — | — | 11.8 | 0.02 | 5 | — | — | — |
| LYM821 | 73991.4 | 1.2 | 0.27 | 9 | 11.8 | 0.17 | 5 | 80.3 | 0.05 | 11 |
| LYM821 | 73992.2 | 1.3 | 0.19 | 12 | 11.7 | 0.28 | 5 | 84.0 | 0.01 | 16 |
| LYM812 | 73983.7 | — | — | — | 11.8 | 0.17 | 5 | — | — | — |
| LYM812 | 73984.1 | — | — | — | 11.9 | 0.26 | 7 | — | — | — |
| LYM812 | 73985.1 | 1.2 | 0.15 | 10 | — | — | — | 78.9 | 0.28 | 9 |
| LYM804 | 73222.1 | 1.6 | L | 38 | — | — | — | 95.6 | L | 32 |
| LYM804 | 73223.1 | — | — | — | 11.5 | 0.17 | 3 | 90.2 | 0.20 | 24 |
| LYM792 | 74169.3 | 1.3 | 0.10 | 16 | 11.9 | 0.26 | 7 | 86.2 | 0.03 | 19 |
| LYM792 | 74170.1 | — | — | — | 11.8 | 0.17 | 5 | — | — | — |
| LYM792 | 74172.1 | 1.5 | 0.01 | 32 | — | — | — | 93.6 | 0.02 | 29 |
| LYM792 | 74172.3 | 1.4 | 0.28 | 21 | 12.2 | 0.15 | 10 | 93.0 | 0.02 | 28 |
| LYM792 | 74172.4 | 1.3 | 0.06 | 14 | — | — | — | — | — | — |
| LYM775 | 74066.1 | 1.4 | 0.10 | 21 | — | — | — | 86.7 | 0.02 | 19 |
| LYM775 | 74070.1 | 1.3 | 0.17 | 14 | 11.8 | 0.04 | 5 | 86.7 | L | 19 |
| LYM775 | 74070.2 | 1.3 | 0.19 | 14 | — | — | — | 81.3 | 0.06 | 12 |
| LYM766 | 74062.1 | — | — | — | 11.7 | 0.12 | 5 | 84.5 | 0.23 | 16 |
| LYM766 | 74064.1 | 1.3 | 0.22 | 13 | 12.2 | 0.02 | 9 | 86.9 | 0.02 | 20 |
| LYM766 | 74065.3 | 1.2 | 0.24 | 8 | — | — | — | — | — | — |
| LYM759 | 74056.2 | 1.4 | 0.07 | 21 | — | — | — | — | — | — |
| LYM759 | 74057.5 | 1.3 | 0.16 | 12 | — | — | — | 86.1 | L | 18 |
| LYM759 | 74058.3 | 1.4 | 0.21 | 24 | 11.4 | 0.19 | 3 | 94.1 | 0.15 | 29 |
| LYM755 | 74043.4 | 1.3 | 0.18 | 16 | — | — | — | 82.9 | 0.03 | 14 |
| LYM755 | 74045.1 | 1.3 | 0.19 | 16 | — | — | — | — | — | — |
| CONT. | — | 1.1 | — | — | 11.1 | — | — | 72.7 | — | — |

"CONT."—Control; "Ave."—Average; "% Incr." = % increment; "p-val."—p-value, L—$p < 0.01$.

TABLE 100

Genes showing improved plant performance at Normal growth conditions under regulation of At6669 promoter

| Gene | | RGR Of Leaf Number | | | RGR Of Plot Coverage | | | RGR Of Rosette Diameter | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM966 | 74524.1 | — | — | — | 9.6 | 0.11 | 28 | 0.5 | 0.18 | 17 |
| LYM956 | 74498.1 | — | — | — | 8.8 | 0.30 | 17 | — | — | — |
| LYM954 | 74496.4 | — | — | — | 10.2 | 0.04 | 35 | 0.5 | 0.26 | 13 |
| LYM954 | 74497.1 | — | — | — | 9.0 | 0.25 | 19 | — | — | — |
| LYM917 | 74456.1 | — | — | — | 9.6 | 0.11 | 28 | — | — | — |
| LYM917 | 74456.3 | — | — | — | 9.2 | 0.18 | 23 | — | — | — |
| LYM899 | 74827.3 | — | — | — | 8.9 | 0.25 | 19 | — | — | — |
| LYM886 | 74446.4 | — | — | — | 10.5 | 0.02 | 40 | 0.6 | 0.11 | 19 |
| LYM886 | 74447.6 | — | — | — | 10.6 | 0.02 | 41 | 0.5 | 0.21 | 15 |
| LYM879 | 74602.1 | — | — | — | 9.9 | 0.07 | 32 | 0.5 | 0.15 | 18 |
| LYM879 | 74604.2 | — | — | — | 10.4 | 0.04 | 38 | 0.5 | 0.23 | 15 |
| LYM879 | 74605.1 | — | — | — | 10.5 | 0.02 | 40 | 0.6 | 0.05 | 25 |
| LYM1004 | 74336.2 | — | — | — | 9.5 | 0.14 | 27 | — | — | — |
| LYM1004 | 74340.1 | — | — | — | 9.3 | 0.17 | 24 | 0.5 | 0.27 | 14 |
| CONT. | — | — | — | — | 7.5 | — | — | 0.5 | — | — |
| LYM986 | 73532.2 | 0.7 | 0.24 | 16 | 7.2 | 0.09 | 20 | — | — | — |
| LYM986 | 73533.3 | 0.8 | 0.08 | 26 | 6.9 | 0.21 | 15 | 0.4 | 0.20 | 11 |
| LYM947 | 73300.3 | 0.7 | 0.30 | 13 | — | — | — | — | — | — |
| LYM927 | 73767.1 | 0.7 | 0.21 | 16 | — | — | — | — | — | — |
| LYM891 | 73720.2 | — | — | — | 7.2 | 0.11 | 19 | 0.4 | 0.24 | 10 |
| LYM891 | 73720.3 | — | — | — | 6.9 | 0.23 | 14 | — | — | — |
| LYM891 | 73721.3 | 0.7 | 0.11 | 21 | — | — | — | — | — | — |
| LYM885 | 73282.1 | — | — | — | 7.3 | 0.08 | 22 | 0.4 | 0.16 | 12 |
| LYM885 | 73283.1 | — | — | — | 7.2 | 0.12 | 19 | 0.4 | 0.14 | 13 |
| LYM885 | 73283.3 | — | — | — | 6.8 | 0.29 | 12 | 0.4 | 0.21 | 10 |
| LYM881 | 73592.1 | — | — | — | 6.9 | 0.22 | 14 | — | — | — |
| LYM881 | 73592.2 | — | — | — | 7.6 | 0.03 | 26 | 0.4 | 0.24 | 10 |

TABLE 100-continued

Genes showing improved plant performance at Normal growth conditions under regulation of At6669 promoter

| Gene | | RGR Of Leaf Number | | | RGR Of Plot Coverage | | | RGR Of Rosette Diameter | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM878 | 73234.2 | — | — | — | 6.9 | 0.17 | 15 | 0.4 | 0.21 | 10 |
| LYM875 | 73516.5 | — | — | — | — | — | — | 0.4 | 0.16 | 13 |
| LYM875 | 73518.1 | — | — | — | 7.4 | 0.08 | 23 | 0.4 | 0.24 | 11 |
| LYM875 | 73519.1 | 0.7 | 0.16 | 18 | — | — | — | — | — | — |
| LYM874 | 73584.2 | — | — | — | 7.0 | 0.16 | 17 | — | — | — |
| LYM874 | 73585.1 | — | — | — | 7.6 | 0.04 | 26 | 0.4 | 0.07 | 16 |
| LYM844 | 73197.2 | — | — | — | 7.2 | 0.10 | 20 | 0.4 | 0.20 | 11 |
| LYM844 | 73197.3 | — | — | — | 7.6 | 0.03 | 26 | 0.4 | 0.08 | 15 |
| LYM844 | 73199.1 | — | — | — | 6.9 | 0.22 | 15 | — | — | — |
| LYM827 | 73430.1 | — | — | — | — | — | — | 0.4 | 0.01 | 29 |
| LYM827 | 73432.4 | — | — | — | 7.8 | 0.03 | 30 | 0.4 | 0.06 | 18 |
| LYM804 | 73221.2 | — | — | — | — | — | — | 0.4 | 0.06 | 21 |
| LYM804 | 73222.1 | — | — | — | 7.4 | 0.07 | 23 | — | — | — |
| LYM769 | 73600.4 | — | — | — | 7.3 | 0.08 | 21 | 0.4 | 0.17 | 12 |
| LYM1009 | 73141.2 | — | — | — | 7.1 | 0.14 | 18 | 0.4 | 0.09 | 15 |
| LYM1009 | 73141.5 | — | — | — | — | — | — | 0.4 | 0.27 | 10 |
| LYM1009 | 73143.2 | — | — | — | — | — | — | 0.4 | 0.28 | 9 |
| CONT. | — | 0.6 | — | — | 6.0 | — | — | 0.3 | — | — |
| LYM996 | 73566.3 | — | — | — | 8.3 | 0.09 | 25 | 0.4 | 0.14 | 16 |
| LYM962 | 73611.2 | — | — | — | 7.7 | 0.29 | 16 | — | — | — |
| LYM962 | 73613.4 | — | — | — | 7.8 | 0.27 | 18 | 0.4 | 0.04 | 22 |
| LYM962 | 73615.2 | — | — | — | 8.0 | 0.14 | 21 | 0.4 | 0.10 | 18 |
| LYM916 | 73238.3 | — | — | — | 8.2 | 0.09 | 24 | 0.4 | 0.23 | 13 |
| LYM916 | 73240.2 | — | — | — | 8.5 | 0.06 | 29 | 0.4 | 0.11 | 17 |
| LYM898 | 73463.4 | — | — | — | 8.3 | 0.09 | 24 | 0.4 | 0.22 | 13 |
| LYM892 | 73724.4 | — | — | — | 7.7 | 0.30 | 15 | — | — | — |
| LYM892 | 73729.3 | — | — | — | 8.5 | 0.07 | 29 | 0.4 | 0.06 | 21 |
| LYM884 | 73212.2 | — | — | — | 8.3 | 0.08 | 26 | — | — | — |
| LYM877 | 73201.1 | — | — | — | — | — | — | 0.4 | 0.25 | 12 |
| LYM877 | 73203.1 | — | — | — | 7.7 | 0.26 | 16 | — | — | — |
| LYM873 | 73712.5 | — | — | — | 8.2 | 0.13 | 23 | 0.4 | 0.10 | 19 |
| LYM873 | 73716.1 | — | — | — | 8.5 | 0.08 | 28 | — | — | — |
| LYM868 | 73573.2 | — | — | — | 8.7 | 0.05 | 31 | 0.4 | 0.13 | 16 |
| LYM866 | 73707.3 | — | — | — | — | — | — | 0.4 | 0.28 | 12 |
| LYM853 | 73703.1 | — | — | — | 8.7 | 0.05 | 30 | 0.4 | 0.05 | 22 |
| LYM840 | 73547.1 | — | — | — | 7.8 | 0.22 | 18 | 0.4 | 0.27 | 12 |
| LYM840 | 73549.1 | — | — | — | 7.9 | 0.18 | 19 | — | — | — |
| LYM837 | 73664.4 | — | — | — | 7.8 | 0.26 | 17 | 0.4 | 0.25 | 13 |
| LYM837 | 73668.3 | 0.8 | 0.19 | 18 | — | — | — | — | — | — |
| LYM764 | 73155.4 | 0.7 | 0.26 | 15 | 8.5 | 0.06 | 27 | 0.4 | 0.19 | 14 |
| LYM764 | 73156.2 | — | — | — | 9.6 | L | 44 | 0.5 | 0.04 | 24 |
| LYM764 | 73156.4 | — | — | — | 8.0 | 0.16 | 20 | — | — | — |
| LYM763 | 73457.3 | — | — | — | 8.7 | 0.04 | 31 | 0.4 | 0.17 | 15 |
| LYM763 | 73458.5 | — | — | — | 8.3 | 0.10 | 24 | 0.4 | 0.09 | 19 |
| LYM762 | 73148.4 | — | — | — | 7.7 | 0.25 | 17 | — | — | — |
| LYM762 | 73149.5 | — | — | — | 7.7 | 0.25 | 16 | — | — | — |
| CONT. | — | 0.7 | — | — | 6.6 | — | — | 0.4 | — | — |
| LYM985 | 73526.1 | — | — | — | — | — | — | 0.4 | 0.14 | 15 |
| LYM985 | 73529.2 | — | — | — | 9.7 | 0.02 | 32 | 0.5 | 0.04 | 21 |
| LYM985 | 73530.1 | — | — | — | 8.5 | 0.18 | 17 | 0.4 | 0.16 | 14 |
| LYM939 | 74150.5 | — | — | — | 9.6 | 0.01 | 31 | 0.5 | 0.03 | 23 |
| LYM939 | 74153.1 | — | — | — | 9.0 | 0.08 | 23 | — | — | — |
| LYM939 | 74154.1 | — | — | — | 9.6 | 0.01 | 32 | 0.5 | 0.01 | 26 |
| LYM939 | 74154.3 | — | — | — | 8.4 | 0.24 | 15 | 0.4 | 0.22 | 13 |
| LYM938 | 74144.1 | — | — | — | 8.3 | 0.25 | 14 | — | — | — |
| LYM938 | 74147.2 | — | — | — | 8.3 | 0.26 | 14 | — | — | — |
| LYM937 | 73550.1 | — | — | — | — | — | — | 0.4 | 0.16 | 14 |
| LYM937 | 73551.1 | — | — | — | — | — | — | 0.4 | 0.18 | 14 |
| LYM937 | 73553.1 | — | — | — | 9.5 | 0.02 | 30 | 0.4 | 0.14 | 15 |
| LYM931 | 73844.1 | — | — | — | — | — | — | 0.5 | 0.05 | 21 |
| LYM931 | 73844.3 | — | — | — | 9.9 | L | 36 | 0.5 | 0.03 | 23 |
| LYM931 | 73847.1 | 0.8 | 0.18 | 22 | 9.0 | 0.08 | 23 | 0.4 | 0.13 | 17 |
| LYM889 | 73792.1 | — | — | — | 8.3 | 0.29 | 14 | 0.4 | 0.24 | 12 |
| LYM877 | 73202.3 | — | — | — | 9.3 | 0.05 | 28 | 0.4 | 0.18 | 16 |
| LYM877 | 73203.1 | — | — | — | — | — | — | 0.5 | 0.07 | 19 |
| LYM875 | 73516.5 | — | — | — | 8.4 | 0.20 | 15 | — | — | — |
| LYM875 | 73518.1 | — | — | — | 9.7 | 0.01 | 33 | 0.5 | 0.07 | 19 |
| LYM842 | 74012.1 | — | — | — | 9.7 | 0.02 | 33 | 0.5 | 0.06 | 21 |
| LYM807 | 73976.2 | — | — | — | 8.3 | 0.27 | 13 | — | — | — |
| LYM807 | 73978.2 | — | — | — | 8.5 | 0.18 | 17 | 0.4 | 0.22 | 13 |
| LYM807 | 73980.1 | — | — | — | 8.3 | 0.26 | 14 | — | — | — |
| LYM807 | 73980.3 | 0.8 | 0.20 | 19 | 9.2 | 0.05 | 26 | 0.5 | 0.02 | 26 |

TABLE 100-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM807 | 73981.3 | — | — | — | 8.6 | 0.14 | 18 | — | — | — |
| LYM806 | 73971.4 | — | — | — | 8.8 | 0.10 | 20 | — | — | — |
| LYM806 | 73975.2 | 0.8 | 0.15 | 21 | 8.9 | 0.08 | 22 | 0.4 | 0.22 | 13 |
| LYM803 | 74213.5 | 0.8 | 0.20 | 20 | — | — | — | 0.4 | 0.14 | 15 |
| LYM803 | 74213.6 | — | — | — | 9.4 | 0.02 | 28 | 0.4 | 0.14 | 15 |
| LYM803 | 74215.3 | — | — | — | 8.4 | 0.29 | 15 | — | — | — |
| LYM803 | 74215.5 | — | — | — | 8.8 | 0.10 | 20 | 0.4 | 0.18 | 13 |
| LYM795 | 73958.3 | — | — | — | 10.1 | L | 38 | 0.5 | 0.03 | 22 |
| LYM795 | 73960.2 | — | — | — | — | — | — | 0.4 | 0.25 | 11 |
| LYM795 | 73960.4 | — | — | — | 8.7 | 0.13 | 19 | 0.4 | 0.16 | 15 |
| LYM795 | 73961.3 | — | — | — | 8.4 | 0.26 | 15 | — | — | — |
| LYM795 | 73963.1 | — | — | — | 8.2 | 0.29 | 13 | 0.5 | 0.08 | 19 |
| LYM791 | 73952.2 | — | — | — | 10.3 | L | 41 | 0.5 | L | 31 |
| LYM791 | 73955.4 | — | — | — | — | — | — | 0.4 | 0.27 | 12 |
| LYM784 | 74081.1 | 0.8 | 0.18 | 20 | — | — | — | — | — | — |
| LYM784 | 74081.3 | — | — | — | 8.9 | 0.08 | 22 | 0.5 | 0.06 | 19 |
| LYM784 | 74083.1 | — | — | — | 8.4 | 0.21 | 15 | 0.4 | 0.14 | 15 |
| LYM781 | 73949.1 | — | — | — | 8.8 | 0.17 | 20 | 0.4 | 0.20 | 16 |
| LYM781 | 73950.1 | — | — | — | 8.8 | 0.10 | 20 | 0.4 | 0.15 | 15 |
| LYM781 | 73950.2 | — | — | — | 9.6 | 0.02 | 31 | 0.4 | 0.11 | 17 |
| LYM764 | 73155.4 | — | — | — | — | — | — | 0.4 | 0.18 | 13 |
| LYM764 | 73156.3 | — | — | — | 8.4 | 0.23 | 15 | — | — | — |
| LYM764 | 73157.1 | 0.8 | 0.20 | 18 | — | — | — | — | — | — |
| LYM1008 | 73135.1 | — | — | — | — | — | — | 0.4 | 0.13 | 16 |
| LYM1008 | 73140.6 | — | — | — | 8.3 | 0.25 | 13 | 0.4 | 0.30 | 10 |
| CONT. | — | 0.7 | — | — | 7.3 | — | — | 0.4 | — | — |
| LYM952 | 74249.2 | — | — | — | 4.6 | 0.24 | 22 | — | — | — |
| LYM952 | 74251.4 | — | — | — | 4.5 | 0.29 | 20 | — | — | — |
| LYM911 | 73840.2 | — | — | — | 4.6 | 0.23 | 23 | — | — | — |
| LYM842 | 74012.1 | — | — | — | 4.8 | 0.14 | 28 | — | — | — |
| LYM842 | 74017.7 | — | — | — | 4.8 | 0.14 | 27 | — | — | — |
| LYM816 | 74335.1 | — | — | — | 5.2 | 0.06 | 38 | — | — | — |
| LYM811 | 74388.2 | — | — | — | 4.7 | 0.19 | 25 | — | — | — |
| LYM791 | 73955.4 | 0.7 | 0.19 | 24 | — | — | — | 0.4 | 0.29 | 16 |
| LYM791 | 73957.2 | — | — | — | 4.7 | 0.20 | 25 | — | — | — |
| LYM761 | 73999.3 | — | — | — | 4.5 | 0.27 | 21 | — | — | — |
| LYM761 | 73999.5 | 0.8 | 0.12 | 25 | — | — | — | — | — | — |
| LYM1004 | 74338.2 | — | — | — | 5.0 | 0.08 | 35 | 0.4 | 0.29 | 17 |
| LYM1000 | 74327.2 | — | — | — | 4.6 | 0.23 | 24 | — | — | — |
| LYM1000 | 74328.4 | — | — | — | 4.6 | 0.24 | 22 | — | — | — |
| CONT. | — | 0.6 | — | — | 3.7 | — | — | 0.3 | — | — |
| LYM991 | 74205.5 | — | — | — | — | — | — | 0.4 | 0.24 | 8 |
| LYM991 | 74208.3 | — | — | — | 6.3 | 0.27 | 11 | — | — | — |
| LYM987 | 74157.2 | — | — | — | — | — | — | 0.3 | 0.27 | 7 |
| LYM938 | 74146.4 | — | — | — | 6.4 | 0.20 | 14 | — | — | — |
| LYM933 | 73810.2 | — | — | — | 6.7 | 0.12 | 18 | 0.4 | 0.03 | 15 |
| LYM933 | 73810.4 | — | — | — | 6.4 | 0.25 | 12 | — | — | — |
| LYM933 | 73812.5 | — | — | — | — | — | — | 0.4 | 0.14 | 9 |
| LYM904 | 74019.1 | — | — | — | 6.5 | 0.20 | 15 | 0.4 | 0.13 | 10 |
| LYM904 | 74021.2 | — | — | — | 6.8 | 0.08 | 19 | 0.4 | 0.10 | 10 |
| LYM897 | 73736.4 | — | — | — | 6.7 | 0.09 | 19 | 0.4 | 0.15 | 8 |
| LYM897 | 73741.3 | — | — | — | 6.4 | 0.22 | 13 | — | — | — |
| LYM887 | 73827.1 | — | — | — | 6.7 | 0.10 | 18 | 0.4 | 0.14 | 10 |
| LYM887 | 73829.5 | — | — | — | — | — | — | 0.3 | 0.27 | 6 |
| LYM870 | 74420.1 | — | — | — | 6.4 | 0.20 | 13 | 0.4 | 0.21 | 7 |
| LYM870 | 74424.3 | — | — | — | 6.4 | 0.23 | 12 | 0.4 | 0.10 | 10 |
| LYM867 | 74417.2 | — | — | — | 6.4 | 0.26 | 12 | 0.3 | 0.26 | 6 |
| LYM867 | 74417.4 | — | — | — | — | — | — | 0.4 | 0.02 | 14 |
| LYM867 | 74418.1 | — | — | — | 7.3 | 0.01 | 29 | 0.4 | 0.11 | 9 |
| LYM867 | 74419.2 | — | — | — | — | — | — | 0.4 | 0.17 | 8 |
| LYM864 | 74409.1 | — | — | — | 6.4 | 0.20 | 13 | 0.4 | 0.08 | 10 |
| LYM864 | 74412.4 | — | — | — | 6.8 | 0.06 | 19 | 0.4 | 0.03 | 13 |
| LYM852 | 73888.5 | — | — | — | 6.8 | 0.06 | 21 | 0.4 | 0.14 | 9 |
| LYM852 | 73890.1 | — | — | — | — | — | — | 0.4 | 0.19 | 8 |
| LYM852 | 73890.3 | — | — | — | 7.0 | 0.03 | 23 | 0.4 | 0.07 | 11 |
| LYM851 | 74392.1 | — | — | — | 7.1 | 0.02 | 25 | 0.4 | 0.09 | 10 |
| LYM851 | 74392.2 | — | — | — | 6.7 | 0.08 | 18 | 0.4 | 0.02 | 14 |
| LYM851 | 74393.1 | — | — | — | 6.4 | 0.25 | 12 | — | — | — |
| LYM815 | 74087.3 | — | — | — | 6.5 | 0.15 | 15 | 0.4 | 0.09 | 10 |
| LYM815 | 74088.3 | — | — | — | 7.0 | 0.03 | 23 | 0.4 | 0.10 | 9 |
| LYM803 | 74213.6 | — | — | — | — | — | — | 0.3 | 0.28 | 6 |
| LYM797 | 73965.1 | — | — | — | 7.1 | 0.02 | 26 | 0.4 | 0.03 | 13 |

TABLE 100-continued

Genes showing improved plant performance at Normal growth conditions under regulation of At6669 promoter

| Gene | | RGR Of Leaf Number | | | RGR Of Plot Coverage | | | RGR Of Rosette Diameter | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM797 | 73966.3 | — | — | — | — | — | — | 0.3 | 0.27 | 6 |
| LYM755 | 74043.4 | — | — | — | 7.2 | 0.02 | 27 | 0.4 | 0.02 | 15 |
| LYM755 | 74045.3 | — | — | — | 7.6 | L | 34 | 0.4 | L | 21 |
| LYM1006 | 74259.1 | — | — | — | 6.6 | 0.13 | 16 | 0.4 | 0.06 | 11 |
| LYM1006 | 74263.1 | — | — | — | 7.0 | 0.03 | 23 | 0.4 | 0.02 | 14 |
| CONT. | — | — | — | — | 5.7 | — | — | 0.3 | — | — |
| LYM992 | 74649.3 | — | — | — | 8.8 | 0.25 | 16 | — | — | — |
| LYM992 | 74649.4 | — | — | — | — | — | — | 0.5 | 0.29 | 10 |
| LYM992 | 74651.2 | — | — | — | — | — | — | 0.5 | 0.15 | 13 |
| LYM992 | 74653.4 | — | — | — | 9.0 | 0.19 | 18 | — | — | — |
| LYM953 | 74487.1 | — | — | — | — | — | — | 0.5 | 0.15 | 13 |
| LYM953 | 74488.1 | — | — | — | 8.9 | 0.22 | 17 | 0.5 | 0.04 | 19 |
| LYM936 | 74482.1 | 0.8 | 0.06 | 28 | — | — | — | — | — | — |
| LYM920 | 74462.1 | — | — | — | 9.4 | 0.09 | 24 | 0.5 | 0.26 | 10 |
| LYM920 | 74463.1 | — | — | — | 9.1 | 0.18 | 20 | 0.5 | 0.16 | 13 |
| LYM900 | 74454.4 | 0.8 | 0.05 | 29 | 9.6 | 0.07 | 26 | 0.5 | 0.09 | 15 |
| LYM882 | 74438.4 | — | — | — | — | — | — | 0.5 | 0.19 | 12 |
| LYM882 | 74442.3 | — | — | — | — | — | — | 0.5 | 0.07 | 17 |
| LYM857 | 74396.2 | — | — | — | 9.3 | 0.11 | 23 | 0.5 | 0.14 | 13 |
| LYM840 | 73548.1 | — | — | — | 8.8 | 0.26 | 16 | 0.5 | 0.24 | 10 |
| LYM802 | 74434.1 | — | — | — | 9.0 | 0.19 | 18 | — | — | — |
| LYM787 | 74568.3 | — | — | — | 9.1 | 0.16 | 20 | 0.5 | 0.18 | 12 |
| LYM771 | 74528.1 | — | — | — | 8.9 | 0.23 | 17 | 0.5 | 0.09 | 15 |
| LYM771 | 74532.1 | — | — | — | 9.2 | 0.16 | 21 | 0.5 | 0.12 | 15 |
| CONT. | — | 0.6 | — | — | 7.6 | — | — | 0.4 | — | — |
| LYM984 | 74253.1 | — | — | — | 10.0 | 0.14 | 18 | — | — | — |
| LYM984 | 74253.3 | — | — | — | 10.2 | 0.07 | 20 | — | — | — |
| LYM979 | 74243.1 | 0.6 | 0.16 | 19 | 9.7 | 0.21 | 14 | — | — | — |
| LYM963 | 74025.4 | — | — | — | 9.6 | 0.25 | 13 | — | — | — |
| LYM963 | 74026.2 | — | — | — | 11.0 | 0.02 | 29 | 0.5 | 0.10 | 17 |
| LYM940 | 73817.1 | 0.7 | 0.02 | 34 | — | — | — | — | — | — |
| LYM940 | 73818.2 | — | — | — | 10.4 | 0.06 | 22 | — | — | — |
| LYM905 | 73802.5 | — | — | — | 10.1 | 0.10 | 18 | — | — | — |
| LYM905 | 73805.2 | 0.6 | 0.17 | 19 | — | — | — | — | — | — |
| LYM905 | 73807.3 | — | — | — | 9.8 | 0.21 | 15 | — | — | — |
| LYM898 | 73460.6 | — | — | — | 10.5 | 0.05 | 24 | — | — | — |
| LYM898 | 73463.4 | — | — | — | 10.3 | 0.07 | 21 | — | — | — |
| LYM898 | 73463.6 | — | — | — | 9.5 | 0.29 | 12 | — | — | — |
| LYM878 | 73232.1 | — | — | — | 10.6 | 0.04 | 24 | — | — | — |
| LYM878 | 73232.4 | 0.7 | 0.03 | 29 | — | — | — | — | — | — |
| LYM878 | 73235.2 | — | — | — | 9.9 | 0.15 | 17 | — | — | — |
| LYM878 | 73236.2 | — | — | — | 9.9 | 0.13 | 17 | — | — | — |
| LYM871 | 74164.2 | — | — | — | 9.6 | 0.26 | 13 | — | — | — |
| LYM871 | 74166.2 | — | — | — | 9.8 | 0.17 | 15 | — | — | — |
| LYM849 | 73858.2 | 0.6 | 0.19 | 20 | — | — | — | — | — | — |
| LYM849 | 73859.2 | — | — | — | 11.0 | 0.01 | 29 | 0.5 | 0.10 | 17 |
| LYM821 | 73992.2 | — | — | — | 9.8 | 0.17 | 15 | — | — | — |
| LYM804 | 73222.1 | — | — | — | 11.5 | L | 36 | 0.5 | 0.06 | 20 |
| LYM804 | 73223.1 | — | — | — | 10.7 | 0.03 | 26 | 0.5 | 0.20 | 13 |
| LYM792 | 74169.3 | — | — | — | 10.1 | 0.10 | 19 | — | — | — |
| LYM792 | 74172.1 | — | — | — | 11.0 | 0.01 | 29 | 0.5 | 0.16 | 14 |
| LYM792 | 74172.3 | 0.6 | 0.24 | 16 | 11.1 | 0.01 | 30 | 0.5 | 0.15 | 15 |
| LYM775 | 74066.1 | — | — | — | 10.3 | 0.08 | 21 | 0.5 | 0.19 | 14 |
| LYM775 | 74070.1 | — | — | — | 10.0 | 0.11 | 18 | — | — | — |
| LYM775 | 74070.2 | — | — | — | 9.6 | 0.26 | 13 | — | — | — |
| LYM766 | 74062.1 | — | — | — | 9.9 | 0.16 | 16 | — | — | — |
| LYM766 | 74064.1 | 0.6 | 0.10 | 23 | 10.4 | 0.06 | 23 | 0.5 | 0.27 | 12 |
| LYM759 | 74056.2 | — | — | — | — | — | — | 0.5 | 0.09 | 19 |
| LYM759 | 74057.5 | — | — | — | 10.2 | 0.08 | 20 | — | — | — |
| LYM759 | 74058.3 | — | — | — | 11.3 | L | 33 | 0.5 | 0.06 | 20 |
| LYM759 | 74058.4 | — | — | — | 10.0 | 0.22 | 18 | — | — | — |
| LYM755 | 74043.4 | — | — | — | 9.8 | 0.16 | 16 | — | — | — |
| LYM755 | 74045.1 | — | — | — | 10.2 | 0.11 | 20 | — | — | — |
| CONT. | — | 0.5 | — | — | 8.5 | — | — | 0.4 | — | — |

"CONT."—Control; "Ave."—Average; "% Incr." = % increment; "p-val."—p-value, L—p < 0.01.

TABLE 101

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM998 | 74217.1 | — | — | — | 8.0 | 0.10 | 13 | 4.9 | 0.28 | 4 |
| LYM998 | 74219.2 | — | — | — | 8.0 | 0.15 | 12 | 4.9 | 0.29 | 5 |
| LYM979 | 74244.1 | 0.3 | 0.27 | 4 | — | — | — | — | — | — |
| LYM967 | 74506.2 | — | — | — | 8.1 | 0.09 | 14 | 5.0 | 0.15 | 6 |
| LYM967 | 74508.2 | — | — | — | 8.2 | 0.21 | 16 | — | — | — |
| LYM966 | 74524.1 | — | — | — | 9.1 | 0.28 | 28 | — | — | — |
| LYM966 | 74525.1 | — | — | — | 7.6 | 0.29 | 7 | — | — | — |
| LYM956 | 74498.1 | — | — | — | 8.3 | 0.12 | 17 | 5.1 | 0.12 | 8 |
| LYM954 | 74496.4 | — | — | — | 9.7 | L | 36 | 5.5 | L | 17 |
| LYM954 | 74497.1 | — | — | — | — | — | — | 5.1 | 0.30 | 9 |
| LYM942 | 74665.4 | — | — | — | 8.0 | 0.11 | 12 | — | — | — |
| LYM927 | 73771.2 | — | — | — | 7.9 | 0.12 | 12 | 5.1 | 0.06 | 8 |
| LYM917 | 74456.1 | — | — | — | — | — | — | 5.3 | 0.22 | 14 |
| LYM917 | 74456.3 | — | — | — | 8.7 | 0.03 | 22 | 5.2 | 0.17 | 10 |
| LYM899 | 74826.3 | — | — | — | — | — | — | 4.9 | 0.26 | 4 |
| LYM899 | 74827.3 | — | — | — | 8.4 | 0.07 | 18 | 5.1 | 0.05 | 9 |
| LYM886 | 74446.1 | — | — | — | 7.9 | 0.14 | 11 | 4.9 | 0.24 | 5 |
| LYM886 | 74446.4 | — | — | — | 10.1 | L | 42 | 5.6 | 0.01 | 20 |
| LYM886 | 74447.6 | — | — | — | 10.0 | 0.09 | 41 | 5.5 | L | 17 |
| LYM886 | 74448.4 | — | — | — | 7.9 | 0.21 | 11 | 5.1 | 0.07 | 9 |
| LYM879 | 74602.1 | — | — | — | 9.3 | 0.15 | 32 | 5.5 | 0.14 | 17 |
| LYM879 | 74604.2 | 0.4 | 0.14 | 12 | 9.9 | 0.27 | 39 | 5.5 | 0.26 | 18 |
| LYM879 | 74605.1 | — | — | — | 10.0 | L | 41 | 5.8 | L | 25 |
| LYM820 | 74585.2 | — | — | — | 8.2 | 0.17 | 15 | 5.2 | 0.02 | 11 |
| LYM811 | 74385.2 | — | — | — | 8.3 | 0.21 | 17 | 5.0 | 0.24 | 7 |
| LYM811 | 74388.2 | — | — | — | 8.0 | 0.13 | 13 | 4.9 | 0.25 | 5 |
| LYM811 | 74389.1 | — | — | — | 8.2 | 0.09 | 15 | — | — | — |
| LYM800 | 74576.1 | 0.3 | 0.09 | 8 | 8.2 | 0.19 | 15 | 5.2 | 0.26 | 12 |
| LYM1004 | 74340.1 | — | — | — | 8.9 | 0.29 | 25 | 5.4 | 0.17 | 14 |
| CONT. | — | 0.3 | — | — | 7.1 | — | — | 4.7 | — | — |
| LYM986 | 73532.1 | — | — | — | 7.1 | 0.04 | 11 | 4.6 | 0.15 | 4 |
| LYM986 | 73532.2 | — | — | — | 7.7 | 0.07 | 20 | 4.8 | L | 8 |
| LYM986 | 73533.3 | — | — | — | 7.3 | 0.05 | 15 | 4.8 | L | 8 |
| LYM947 | 73297.4 | 0.2 | 0.09 | 13 | — | — | — | 4.7 | 0.01 | 7 |
| LYM891 | 73720.2 | — | — | — | 7.6 | 0.21 | 19 | 4.7 | 0.01 | 7 |
| LYM891 | 73720.3 | — | — | — | 7.2 | 0.22 | 12 | 4.6 | 0.25 | 4 |
| LYM885 | 73282.1 | — | — | — | 7.9 | 0.20 | 24 | 5.0 | 0.22 | 13 |
| LYM885 | 73283.1 | — | — | — | 7.5 | L | 18 | 4.8 | L | 8 |
| LYM885 | 73283.3 | 0.2 | 0.25 | 15 | 7.1 | 0.03 | 11 | 4.6 | 0.07 | 4 |
| LYM885 | 73284.2 | 0.2 | 0.19 | 15 | — | — | — | — | — | — |
| LYM881 | 73592.1 | — | — | — | 7.4 | 0.29 | 15 | 4.7 | 0.28 | 7 |
| LYM881 | 73592.2 | — | — | — | 8.1 | L | 27 | 4.8 | L | 9 |
| LYM878 | 73234.2 | — | — | — | 7.3 | 0.01 | 14 | 4.7 | 0.02 | 7 |
| LYM875 | 73516.4 | — | — | — | 6.8 | 0.17 | 7 | 4.6 | 0.08 | 4 |
| LYM875 | 73516.5 | — | — | — | 7.3 | 0.05 | 14 | 4.9 | L | 10 |
| LYM874 | 73584.2 | — | — | — | 7.5 | L | 18 | 4.8 | 0.10 | 9 |
| LYM874 | 73585.1 | — | — | — | 8.0 | L | 26 | 4.9 | 0.12 | 10 |
| LYM844 | 73197.2 | — | — | — | 7.7 | 0.02 | 21 | 4.8 | 0.23 | 9 |
| LYM844 | 73197.3 | — | — | — | 7.9 | L | 24 | 4.9 | L | 11 |
| LYM844 | 73199.1 | — | — | — | 7.4 | 0.18 | 15 | — | — | — |
| LYM827 | 73432.4 | — | — | — | 8.3 | 0.29 | 29 | 4.9 | 0.23 | 11 |
| LYM804 | 73221.2 | — | — | — | 6.9 | 0.17 | 8 | — | — | — |
| LYM804 | 73222.1 | — | — | — | — | — | — | 4.8 | 0.10 | 9 |
| LYM769 | 73599.1 | — | — | — | — | — | — | 4.6 | 0.12 | 3 |
| LYM769 | 73600.4 | — | — | — | 7.7 | 0.26 | 20 | 4.7 | 0.28 | 8 |
| LYM1009 | 73141.2 | — | — | — | 7.5 | 0.22 | 17 | 4.8 | 0.15 | 10 |
| LYM1009 | 73141.5 | — | — | — | 6.9 | 0.24 | 9 | — | — | — |
| LYM1009 | 73141.6 | 0.2 | 0.23 | 12 | — | — | — | — | — | — |
| LYM1009 | 73143.2 | — | — | — | 6.9 | 0.18 | 8 | 4.6 | 0.05 | 5 |
| CONT. | — | 0.2 | — | — | 6.4 | — | — | 4.4 | — | — |
| LYM996 | 73564.1 | — | — | — | 7.6 | 0.17 | 8 | — | — | — |
| LYM996 | 73566.3 | — | — | — | 8.7 | 0.01 | 24 | 5.2 | 0.10 | 13 |
| LYM962 | 73613.3 | — | — | — | — | — | — | 4.8 | 0.17 | 5 |
| LYM962 | 73613.4 | — | — | — | — | — | — | 5.2 | 0.06 | 13 |
| LYM962 | 73615.2 | — | — | — | 8.4 | 0.02 | 19 | 5.1 | L | 11 |
| LYM937 | 73553.1 | — | — | — | 7.8 | 0.14 | 11 | 4.9 | 0.20 | 8 |
| LYM923 | 73287.1 | — | — | — | 7.8 | 0.08 | 11 | 4.9 | 0.06 | 7 |
| LYM923 | 73287.4 | — | — | — | 7.6 | 0.26 | 8 | — | — | — |
| LYM916 | 73238.1 | — | — | — | 8.1 | 0.03 | 16 | 5.0 | 0.03 | 10 |
| LYM916 | 73238.3 | — | — | — | 8.6 | L | 23 | 5.2 | L | 14 |
| LYM916 | 73240.2 | — | — | — | 9.1 | 0.24 | 29 | 5.4 | 0.02 | 18 |
| LYM916 | 73241.1 | — | — | — | — | — | — | 4.8 | 0.26 | 4 |
| LYM898 | 73460.6 | — | — | — | — | — | — | 4.8 | 0.13 | 5 |

TABLE 101-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM898 | 73463.1 | — | — | — | 7.9 | 0.19 | 12 | — | — | — |
| LYM898 | 73463.4 | — | — | — | 8.7 | L | 24 | 5.2 | L | 14 |
| LYM892 | 73724.4 | — | — | — | 8.1 | 0.12 | 15 | 4.9 | 0.04 | 7 |
| LYM892 | 73729.3 | — | — | — | 9.0 | 0.25 | 28 | 5.3 | 0.09 | 16 |
| LYM884 | 73207.1 | — | — | — | 7.8 | 0.10 | 10 | 4.9 | 0.04 | 8 |
| LYM884 | 73209.2 | — | — | — | — | — | — | 4.9 | 0.29 | 6 |
| LYM884 | 73212.2 | 0.3 | 0.08 | 21 | 8.8 | L | 25 | 5.2 | L | 12 |
| LYM877 | 73201.1 | — | — | — | 7.8 | 0.26 | 10 | 4.9 | 0.16 | 6 |
| LYM877 | 73201.3 | 0.3 | 0.26 | 10 | — | — | — | — | — | — |
| LYM877 | 73203.1 | — | — | — | 8.1 | 0.30 | 16 | 4.9 | 0.05 | 7 |
| LYM873 | 73712.5 | — | — | — | 8.6 | 0.24 | 22 | 5.2 | 0.29 | 13 |
| LYM873 | 73713.3 | — | — | — | — | — | — | 5.0 | 0.29 | 8 |
| LYM873 | 73716.1 | — | — | — | 9.0 | 0.24 | 29 | 5.2 | 0.10 | 12 |
| LYM868 | 73572.1 | 0.3 | 0.26 | 10 | 7.7 | 0.13 | 9 | 4.9 | 0.09 | 6 |
| LYM868 | 73573.2 | — | — | — | 9.3 | 0.23 | 33 | 5.4 | L | 18 |
| LYM866 | 73707.3 | — | — | — | — | — | — | 4.9 | 0.15 | 7 |
| LYM866 | 73708.2 | — | — | — | — | — | — | 4.8 | 0.09 | 6 |
| LYM866 | 73709.3 | — | — | — | 8.1 | 0.16 | 16 | 4.9 | 0.24 | 7 |
| LYM866 | 73710.1 | — | — | — | — | — | — | 4.8 | 0.17 | 4 |
| LYM853 | 73700.4 | — | — | — | 7.9 | 0.09 | 12 | 4.9 | 0.04 | 7 |
| LYM853 | 73702.1 | — | — | — | — | — | — | 4.8 | 0.27 | 4 |
| LYM853 | 73703.1 | — | — | — | 9.2 | 0.13 | 31 | 5.4 | 0.06 | 19 |
| LYM840 | 73547.1 | — | — | — | 8.2 | 0.05 | 17 | 5.1 | 0.03 | 11 |
| LYM840 | 73549.1 | — | — | — | 8.5 | 0.08 | 20 | 5.1 | L | 12 |
| LYM837 | 73664.4 | — | — | — | — | — | — | 5.1 | 0.28 | 10 |
| LYM837 | 73665.4 | 0.3 | 0.08 | 17 | — | — | — | — | — | — |
| LYM837 | 73666.3 | — | — | — | 7.7 | 0.14 | 10 | 4.8 | 0.29 | 4 |
| LYM837 | 73668.3 | — | — | — | 8.0 | 0.04 | 13 | 4.8 | 0.25 | 4 |
| LYM764 | 73155.4 | — | — | — | 8.8 | 0.02 | 26 | 5.3 | L | 15 |
| LYM764 | 73156.2 | — | — | — | 10.0 | 0.17 | 42 | 5.5 | 0.17 | 20 |
| LYM764 | 73156.4 | — | — | — | 8.3 | 0.02 | 18 | 5.0 | 0.08 | 8 |
| LYM764 | 73157.1 | — | — | — | 7.6 | 0.17 | 8 | 4.8 | 0.10 | 6 |
| LYM763 | 73457.2 | — | — | — | 7.8 | 0.18 | 10 | 4.9 | 0.07 | 6 |
| LYM763 | 73457.3 | — | — | — | 9.2 | L | 30 | 5.3 | L | 16 |
| LYM763 | 73458.5 | — | — | — | 8.7 | 0.05 | 24 | 5.2 | L | 13 |
| LYM763 | 73459.1 | — | — | — | 7.7 | 0.10 | 10 | 4.8 | 0.25 | 4 |
| LYM762 | 73148.4 | — | — | — | 8.2 | 0.02 | 17 | 5.0 | 0.03 | 9 |
| LYM762 | 73149.3 | — | — | — | 7.6 | 0.17 | 9 | 4.8 | 0.18 | 4 |
| LYM762 | 73149.5 | — | — | — | 8.1 | 0.18 | 16 | 4.9 | 0.21 | 7 |
| LYM762 | 73151.1 | — | — | — | 7.7 | 0.29 | 10 | — | — | — |
| CONT. | — | 0.3 | — | — | 7.0 | — | — | 4.6 | — | — |
| LYM985 | 73526.1 | 0.2 | 0.07 | 10 | — | — | — | 4.9 | 0.23 | 6 |
| LYM985 | 73528.1 | — | — | — | 7.6 | 0.18 | 10 | 4.7 | 0.24 | 3 |
| LYM985 | 73529.2 | — | — | — | 9.1 | 0.19 | 31 | 5.2 | 0.12 | 13 |
| LYM985 | 73530.1 | 0.2 | 0.21 | 28 | 8.1 | 0.02 | 16 | 5.0 | 0.01 | 8 |
| LYM939 | 74150.5 | 0.2 | 0.22 | 7 | 8.8 | L | 28 | 5.2 | 0.04 | 13 |
| LYM939 | 74153.1 | 0.2 | 0.03 | 14 | — | — | — | — | — | — |
| LYM939 | 74154.1 | — | — | — | 9.0 | 0.02 | 30 | 5.4 | L | 17 |
| LYM939 | 74154.3 | — | — | — | — | — | — | 5.0 | 0.27 | 8 |
| LYM938 | 74144.1 | — | — | — | 7.7 | 0.07 | 12 | 4.8 | 0.28 | 5 |
| LYM938 | 74147.2 | — | — | — | — | — | — | 4.9 | 0.03 | 6 |
| LYM938 | 74148.1 | — | — | — | 7.5 | 0.06 | 9 | 4.8 | 0.08 | 5 |
| LYM937 | 73550.1 | — | — | — | 7.6 | 0.12 | 9 | 4.9 | 0.21 | 6 |
| LYM937 | 73551.1 | 0.2 | 0.12 | 15 | 7.6 | 0.15 | 10 | 4.9 | 0.25 | 6 |
| LYM937 | 73552.2 | — | — | — | 7.7 | 0.18 | 11 | 4.8 | 0.09 | 5 |
| LYM937 | 73553.1 | — | — | — | 8.8 | 0.17 | 27 | 5.1 | 0.05 | 11 |
| LYM931 | 73844.1 | — | — | — | — | — | — | 5.1 | 0.09 | 10 |
| LYM931 | 73844.2 | 0.2 | 0.20 | 10 | 7.3 | 0.18 | 5 | — | — | — |
| LYM931 | 73844.3 | 0.2 | 0.03 | 18 | 9.2 | 0.14 | 33 | 5.3 | 0.17 | 15 |
| LYM931 | 73847.1 | 0.2 | 0.19 | 11 | 8.4 | 0.24 | 21 | 5.2 | 0.26 | 12 |
| LYM889 | 73790.1 | 0.2 | 0.01 | 19 | — | — | — | 4.8 | 0.18 | 3 |
| LYM877 | 73201.1 | 0.2 | 0.26 | 6 | — | — | — | — | — | — |
| LYM877 | 73202.3 | 0.2 | 0.03 | 30 | — | — | — | — | — | — |
| LYM877 | 73203.1 | — | — | — | — | — | — | 5.0 | 0.18 | 9 |
| LYM875 | 73516.5 | 0.3 | L | 38 | 7.9 | L | 14 | 4.9 | 0.03 | 7 |
| LYM875 | 73518.1 | — | — | — | 9.0 | L | 30 | 5.2 | L | 12 |
| LYM842 | 74012.1 | — | — | — | — | — | — | 5.4 | 0.20 | 16 |
| LYM807 | 73976.2 | 0.2 | 0.06 | 19 | — | — | — | — | — | — |
| LYM807 | 73978.2 | 0.3 | 0.01 | 32 | 8.2 | L | 18 | 5.1 | L | 10 |
| LYM807 | 73980.1 | 0.2 | L | 25 | 7.8 | 0.07 | 13 | — | — | — |
| LYM807 | 73980.3 | — | — | — | 8.8 | 0.20 | 27 | 5.4 | 0.08 | 18 |
| LYM807 | 73981.3 | — | — | — | 8.1 | 0.13 | 17 | 5.0 | 0.29 | 8 |
| LYM806 | 73970.2 | 0.2 | 0.19 | 7 | — | — | — | — | — | — |

TABLE 101-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM806 | 73971.3 | 0.2 | 0.25 | 17 | — | — | — | — | — | — |
| LYM806 | 73971.4 | 0.2 | 0.03 | 21 | 8.2 | 0.04 | 18 | 5.0 | 0.19 | 9 |
| LYM806 | 73975.2 | — | — | — | 8.3 | 0.24 | 20 | 5.1 | 0.10 | 10 |
| LYM803 | 74213.6 | — | — | — | 8.8 | L | 28 | 5.2 | L | 12 |
| LYM803 | 74215.3 | 0.3 | 0.13 | 37 | — | — | — | — | — | — |
| LYM803 | 74215.5 | — | — | — | 8.2 | 0.12 | 19 | 5.0 | 0.01 | 8 |
| LYM795 | 73958.3 | 0.2 | 0.02 | 28 | 9.3 | 0.07 | 34 | 5.3 | L | 14 |
| LYM795 | 73960.2 | — | — | — | 7.3 | 0.24 | 5 | 4.9 | 0.18 | 6 |
| LYM795 | 73960.4 | — | — | — | 8.1 | 0.09 | 17 | 5.0 | 0.16 | 8 |
| LYM795 | 73963.1 | — | — | — | 7.8 | 0.16 | 12 | — | — | — |
| LYM791 | 73952.2 | 0.2 | 0.16 | 7 | 9.6 | 0.04 | 39 | 5.5 | 0.09 | 19 |
| LYM784 | 74081.1 | — | — | — | 7.6 | 0.04 | 9 | 4.8 | 0.18 | 4 |
| LYM784 | 74081.3 | — | — | — | 8.2 | 0.20 | 19 | 5.1 | 0.15 | 11 |
| LYM784 | 74083.1 | 0.2 | 0.30 | 6 | 8.0 | L | 15 | 5.0 | L | 9 |
| LYM781 | 73948.2 | 0.2 | 0.19 | 9 | 7.8 | 0.04 | 13 | 5.0 | 0.21 | 8 |
| LYM781 | 73950.1 | — | — | — | 8.2 | L | 18 | 5.0 | L | 8 |
| LYM781 | 73950.2 | 0.2 | 0.18 | 28 | 8.9 | 0.05 | 29 | 5.2 | L | 14 |
| LYM764 | 73155.4 | — | — | — | — | — | — | 4.8 | 0.23 | 5 |
| LYM764 | 73156.3 | — | — | — | 7.8 | 0.19 | 12 | — | — | — |
| LYM764 | 73156.4 | — | — | — | — | — | — | 4.8 | 0.09 | 4 |
| LYM1008 | 73135.1 | 0.2 | 0.25 | 6 | — | — | — | 4.9 | 0.26 | 6 |
| LYM1008 | 73140.6 | — | — | — | 7.8 | 0.01 | 13 | 4.8 | 0.09 | 4 |
| CONT. | — | 0.2 | — | — | 6.9 | — | — | 4.6 | — | — |
| LYM989 | 74224.1 | 0.4 | 0.02 | 12 | — | — | — | — | — | — |
| LYM952 | 74249.2 | — | — | — | 4.5 | 0.16 | 21 | 3.8 | 0.20 | 11 |
| LYM952 | 74251.2 | — | — | — | 4.3 | 0.10 | 16 | 3.7 | 0.16 | 9 |
| LYM952 | 74251.4 | — | — | — | 4.4 | 0.05 | 20 | 3.7 | 0.13 | 9 |
| LYM911 | 73838.2 | 0.4 | 0.14 | 7 | — | — | — | — | — | — |
| LYM911 | 73840.2 | 0.4 | 0.17 | 8 | — | — | — | — | — | — |
| LYM909 | 73832.1 | — | — | — | 4.1 | 0.24 | 11 | — | — | — |
| LYM909 | 73834.3 | 0.4 | 0.17 | 6 | — | — | — | — | — | — |
| LYM909 | 73836.3 | — | — | — | 4.2 | 0.17 | 13 | — | — | — |
| LYM842 | 74012.1 | — | — | — | 4.7 | 0.02 | 27 | 3.9 | 0.04 | 15 |
| LYM842 | 74012.3 | — | — | — | 4.2 | 0.18 | 13 | — | — | — |
| LYM842 | 74012.4 | — | — | — | — | — | — | 3.7 | 0.21 | 10 |
| LYM842 | 74017.7 | — | — | — | 4.8 | 0.01 | 29 | 3.9 | 0.02 | 16 |
| LYM835 | 73823.1 | 0.4 | 0.03 | 16 | — | — | — | — | — | — |
| LYM816 | 74332.1 | — | — | — | — | — | — | 3.6 | 0.27 | 6 |
| LYM816 | 74332.2 | — | — | — | 4.3 | 0.11 | 17 | — | — | — |
| LYM816 | 74335.1 | — | — | — | 5.1 | 0.28 | 39 | 4.1 | 0.17 | 20 |
| LYM811 | 74388.2 | — | — | — | 4.6 | 0.15 | 25 | 3.8 | 0.18 | 11 |
| LYM791 | 73952.1 | — | — | — | 4.4 | 0.26 | 19 | 3.8 | 0.17 | 12 |
| LYM791 | 73955.4 | 0.4 | 0.16 | 6 | 4.4 | 0.13 | 19 | 3.8 | 0.15 | 11 |
| LYM791 | 73957.2 | — | — | — | 4.7 | 0.25 | 27 | 3.9 | 0.29 | 14 |
| LYM786 | 74383.3 | — | — | — | 4.1 | 0.22 | 11 | 3.6 | 0.24 | 6 |
| LYM786 | 74383.4 | — | — | — | 4.1 | 0.21 | 12 | 3.8 | 0.07 | 11 |
| LYM779 | 73189.2 | — | — | — | 4.4 | 0.08 | 18 | 3.7 | 0.18 | 8 |
| LYM775 | 74071.1 | — | — | — | — | — | — | 3.6 | 0.26 | 6 |
| LYM761 | 73995.1 | 0.4 | 0.07 | 15 | — | — | — | 3.8 | 0.29 | 11 |
| LYM1004 | 74338.2 | 0.4 | 0.22 | 6 | 5.0 | 0.11 | 36 | 4.0 | 0.20 | 18 |
| LYM1004 | 74340.1 | — | — | — | — | — | — | 3.7 | 0.24 | 9 |
| LYM1000 | 74327.2 | — | — | — | — | — | — | 3.8 | 0.30 | 13 |
| LYM1000 | 74328.4 | — | — | — | 4.5 | 0.19 | 22 | 3.8 | 0.06 | 12 |
| CONT. | — | 0.4 | — | — | 3.7 | — | — | 3.4 | — | — |
| LYM991 | 74208.3 | — | — | — | 6.6 | 0.07 | 13 | 4.4 | 0.24 | 7 |
| LYM987 | 74156.1 | — | — | — | — | — | — | 4.3 | 0.06 | 4 |
| LYM987 | 74157.2 | — | — | — | 6.1 | 0.06 | 5 | 4.2 | 0.10 | 3 |
| LYM938 | 74146.4 | — | — | — | 6.6 | 0.29 | 13 | 4.4 | 0.25 | 6 |
| LYM933 | 73810.2 | — | — | — | — | — | — | 4.5 | 0.20 | 10 |
| LYM933 | 73812.1 | 0.3 | 0.10 | 12 | — | — | — | 4.2 | 0.01 | 2 |
| LYM933 | 73812.5 | — | — | — | 6.4 | L | 11 | 4.5 | L | 8 |
| LYM904 | 74019.1 | — | — | — | — | — | — | 4.6 | 0.24 | 13 |
| LYM904 | 74021.1 | 0.3 | 0.14 | 10 | — | — | — | 4.5 | L | 10 |
| LYM904 | 74021.2 | — | — | — | 6.9 | 0.05 | 19 | 4.5 | L | 10 |
| LYM897 | 73736.4 | — | — | — | 6.9 | 0.04 | 19 | 4.4 | 0.05 | 7 |
| LYM897 | 73738.2 | 0.4 | 0.06 | 19 | — | — | — | — | — | — |
| LYM897 | 73738.3 | 0.3 | 0.26 | 9 | — | — | — | 4.3 | 0.18 | 5 |
| LYM897 | 73741.3 | — | — | — | 6.5 | 0.26 | 13 | — | — | — |
| LYM887 | 73827.1 | — | — | — | 6.9 | 0.28 | 19 | 4.5 | 0.29 | 9 |
| LYM887 | 73829.5 | — | — | — | — | — | — | 4.2 | 0.27 | 1 |
| LYM870 | 74420.1 | — | — | — | 6.5 | 0.17 | 12 | 4.3 | L | 4 |
| LYM870 | 74424.3 | — | — | — | 6.5 | 0.05 | 12 | 4.4 | L | 6 |
| LYM867 | 74416.3 | — | — | — | — | — | — | 4.2 | 0.03 | 2 |

TABLE 101-continued

Genes showing improved plant performance at Normal growth conditions under regulation of At6669 promoter

| Gene | | Leaf Blade Area [cm²] | | | Leaf Number | | | Plot Coverage [cm²] | | |
|---|---|---|---|---|---|---|---|---|---|---|
| Name | Event # | Ave. | P-Val. | % Incr. | Ave. | P-Val. | % Incr. | Ave. | P-Val. | % Incr. |
| LYM867 | 74417.2 | — | — | — | — | — | — | 4.5 | 0.19 | 9 |
| LYM867 | 74417.4 | — | — | — | — | — | — | 4.5 | 0.05 | 10 |
| LYM867 | 74418.1 | — | — | — | 7.5 | 0.09 | 29 | 4.7 | 0.13 | 13 |
| LYM867 | 74419.2 | — | — | — | — | — | — | 4.5 | L | 8 |
| LYM864 | 74409.1 | — | — | — | 6.6 | L | 14 | 4.6 | L | 11 |
| LYM864 | 74409.4 | — | — | — | — | — | — | 4.4 | 0.16 | 7 |
| LYM864 | 74412.4 | — | — | — | 6.8 | L | 18 | 4.6 | L | 11 |
| LYM852 | 73888.5 | — | — | — | 7.0 | 0.02 | 21 | 4.5 | 0.11 | 10 |
| LYM852 | 73890.1 | — | — | — | 6.0 | 0.26 | 4 | 4.3 | L | 4 |
| LYM852 | 73890.3 | — | — | — | 7.1 | L | 23 | 4.5 | L | 9 |
| LYM852 | 73891.1 | — | — | — | — | — | — | 4.3 | 0.02 | 4 |
| LYM851 | 74392.1 | — | — | — | 7.4 | 0.07 | 28 | 4.6 | L | 11 |
| LYM851 | 74392.2 | — | — | — | 6.9 | L | 20 | 4.7 | 0.14 | 13 |
| LYM851 | 74393.1 | — | — | — | 6.5 | 0.02 | 13 | 4.3 | 0.21 | 4 |
| LYM851 | 74393.2 | — | — | — | 6.2 | 0.25 | 7 | — | — | — |
| LYM815 | 74087.3 | — | — | — | 6.6 | 0.23 | 14 | 4.4 | 0.23 | 8 |
| LYM815 | 74088.3 | — | — | — | 7.2 | L | 24 | 4.6 | L | 12 |
| LYM812 | 73984.1 | — | — | — | 6.3 | L | 9 | 4.3 | 0.21 | 5 |
| LYM812 | 73985.1 | 0.4 | 0.05 | 15 | — | — | — | — | — | — |
| LYM803 | 74211.1 | 0.3 | 0.22 | 8 | — | — | — | — | — | — |
| LYM803 | 74215.5 | 0.3 | 0.19 | 9 | — | — | — | — | — | — |
| LYM797 | 73965.1 | — | — | — | 7.2 | 0.20 | 25 | 4.6 | 0.22 | 11 |
| LYM797 | 73966.3 | — | — | — | 6.1 | 0.05 | 6 | 4.4 | L | 5 |
| LYM755 | 74043.4 | — | — | — | 7.3 | L | 26 | 4.6 | 0.02 | 11 |
| LYM755 | 74045.3 | — | — | — | 7.7 | L | 33 | 4.8 | L | 17 |
| LYM1006 | 74259.1 | — | — | — | 6.7 | 0.25 | 16 | 4.5 | 0.26 | 8 |
| LYM1006 | 74262.3 | 0.3 | 0.27 | 8 | — | — | — | — | — | — |
| LYM1006 | 74263.1 | — | — | — | 7.3 | 0.07 | 25 | 4.7 | L | 15 |
| CONT. | — | 0.3 | — | — | 5.8 | — | — | 4.1 | — | — |
| LYM992 | 74649.3 | — | — | — | 8.5 | 0.02 | 16 | 5.1 | 0.02 | 8 |
| LYM992 | 74649.4 | — | — | — | 8.1 | 0.01 | 12 | 5.1 | 0.01 | 6 |
| LYM992 | 74651.2 | — | — | — | 8.2 | L | 12 | 5.0 | 0.07 | 6 |
| LYM992 | 74653.4 | — | — | — | 8.7 | 0.19 | 19 | 5.2 | 0.09 | 9 |
| LYM957 | 74203.4 | 0.3 | 0.19 | 10 | — | — | — | — | — | — |
| LYM957 | 74203.6 | 0.3 | L | 25 | 8.2 | 0.23 | 12 | 5.1 | 0.28 | 7 |
| LYM953 | 74487.1 | — | — | — | 8.3 | 0.09 | 13 | 5.1 | 0.08 | 8 |
| LYM953 | 74488.1 | 0.3 | 0.07 | 19 | 8.6 | 0.14 | 18 | 5.4 | L | 13 |
| LYM953 | 74491.2 | 0.3 | 0.09 | 17 | — | — | — | — | — | — |
| LYM932 | 74479.1 | 0.3 | 0.06 | 16 | 7.8 | 0.22 | 7 | 5.0 | 0.14 | 5 |
| LYM929 | 74468.3 | — | — | — | 8.3 | 0.11 | 14 | 5.1 | 0.14 | 7 |
| LYM929 | 74470.1 | — | — | — | 7.9 | 0.08 | 9 | 4.9 | 0.15 | 4 |
| LYM929 | 74473.2 | — | — | — | 7.9 | 0.19 | 9 | — | — | — |
| LYM920 | 74462.1 | — | — | — | 9.0 | L | 24 | 5.3 | L | 11 |
| LYM920 | 74464.1 | — | — | — | — | — | — | 5.0 | 0.18 | 4 |
| LYM920 | 74465.2 | — | — | — | 7.6 | 0.25 | 4 | — | — | — |
| LYM900 | 74454.4 | — | — | — | 9.2 | L | 26 | 5.4 | L | 14 |
| LYM882 | 74438.4 | — | — | — | 8.1 | 0.28 | 12 | 5.2 | 0.24 | 9 |
| LYM882 | 74442.3 | — | — | — | — | — | — | 5.3 | 0.18 | 12 |
| LYM857 | 74396.2 | 0.3 | 0.20 | 22 | 8.9 | 0.05 | 22 | 5.3 | 0.01 | 11 |
| LYM857 | 74398.2 | 0.3 | 0.11 | 12 | — | — | — | — | — | — |
| LYM840 | 73547.1 | 0.3 | 0.02 | 20 | 7.7 | 0.23 | 6 | — | — | — |
| LYM840 | 73548.1 | — | — | — | 8.3 | L | 14 | 5.1 | 0.03 | 7 |
| LYM840 | 73549.1 | 0.3 | 0.07 | 14 | — | — | — | — | — | — |
| LYM802 | 74433.1 | 0.3 | 0.07 | 14 | — | — | — | — | — | — |
| LYM802 | 74434.1 | — | — | — | 8.6 | L | 17 | 5.0 | 0.03 | 5 |
| LYM802 | 74437.3 | 0.3 | 0.19 | 12 | — | — | — | — | — | — |
| LYM787 | 74568.3 | — | — | — | 8.7 | 0.09 | 19 | 5.2 | 0.03 | 9 |
| LYM783 | 74373.2 | 0.3 | 0.23 | 10 | — | — | — | — | — | — |
| LYM771 | 74528.1 | 0.3 | 0.02 | 20 | 8.5 | 0.12 | 16 | 5.2 | 0.06 | 9 |
| LYM771 | 74529.1 | 0.3 | 0.14 | 14 | — | — | — | — | — | — |
| LYM771 | 74530.2 | 0.3 | 0.20 | 12 | — | — | — | — | — | — |
| LYM771 | 74532.1 | 0.3 | 0.07 | 15 | — | — | — | 5.3 | 0.18 | 12 |
| LYM770 | 74516.2 | — | — | — | 8.0 | 0.07 | 10 | 5.0 | 0.04 | 5 |
| LYM770 | 74519.1 | — | — | — | 7.6 | 0.27 | 4 | 4.9 | 0.18 | 3 |
| LYM754 | 74541.1 | 0.3 | 0.08 | 16 | — | — | — | — | — | — |
| CONT. | — | 0.3 | — | — | 7.3 | — | — | 4.8 | — | — |
| LYM984 | 74253.3 | — | — | — | 10.9 | 0.03 | 20 | 6.0 | L | 12 |
| LYM984 | 74257.6 | — | — | — | 10.3 | 0.10 | 13 | — | — | — |
| LYM979 | 74243.1 | — | — | — | 10.2 | 0.11 | 12 | — | — | — |
| LYM963 | 74025.4 | — | — | — | 10.2 | 0.03 | 13 | 5.8 | 0.01 | 8 |
| LYM963 | 74026.2 | — | — | — | 11.4 | L | 26 | 5.9 | L | 11 |
| LYM940 | 73818.2 | — | — | — | 10.9 | L | 20 | 5.8 | 0.10 | 9 |
| LYM905 | 73802.5 | — | — | — | 10.8 | 0.02 | 19 | — | — | — |

TABLE 101-continued

Genes showing improved plant performance at Normal growth conditions under regulation of At6669 promoter

| Gene Name | Event # | Leaf Blade Area [cm²] Ave. | P-Val. | % Incr. | Leaf Number Ave. | P-Val. | % Incr. | Plot Coverage [cm²] Ave. | P-Val. | % Incr. |
|---|---|---|---|---|---|---|---|---|---|---|
| LYM898 | 73460.6 | — | — | — | 11.1 | 0.12 | 22 | 5.9 | 0.04 | 9 |
| LYM898 | 73463.4 | — | — | — | 11.1 | 0.02 | 22 | 6.0 | L | 12 |
| LYM898 | 73463.6 | — | — | — | 10.3 | 0.15 | 13 | 5.8 | 0.26 | 7 |
| LYM878 | 73232.1 | — | — | — | 11.0 | L | 21 | 5.8 | 0.05 | 8 |
| LYM878 | 73232.4 | — | — | — | 9.8 | 0.18 | 8 | 5.7 | 0.04 | 6 |
| LYM878 | 73234.2 | — | — | — | — | — | — | 5.6 | 0.17 | 4 |
| LYM878 | 73235.2 | 0.2 | 0.23 | 9 | 10.4 | 0.02 | 14 | 5.6 | 0.22 | 5 |
| LYM878 | 73236.2 | — | — | — | 10.7 | L | 18 | 6.1 | 0.09 | 13 |
| LYM871 | 74164.2 | — | — | — | 10.2 | 0.28 | 12 | — | — | — |
| LYM871 | 74166.2 | — | — | — | 10.5 | 0.14 | 16 | — | — | — |
| LYM871 | 74167.2 | — | — | — | 9.9 | 0.23 | 9 | — | — | — |
| LYM849 | 73859.2 | — | — | — | 11.5 | L | 26 | 6.2 | L | 15 |
| LYM821 | 73991.4 | — | — | — | 10.0 | 0.05 | 11 | 5.6 | 0.28 | 4 |
| LYM821 | 73992.2 | — | — | — | 10.5 | 0.01 | 16 | 5.8 | 0.18 | 8 |
| LYM821 | 73993.3 | 0.3 | 0.16 | 17 | — | — | — | — | — | — |
| LYM812 | 73983.3 | — | — | — | — | — | — | 5.7 | 0.27 | 6 |
| LYM812 | 73985.1 | — | — | — | 9.9 | 0.28 | 9 | 5.7 | 0.18 | 6 |
| LYM804 | 73222.1 | — | — | — | 12.0 | L | 32 | 6.2 | 0.12 | 16 |
| LYM804 | 73223.1 | — | — | — | 11.3 | 0.20 | 24 | 5.9 | 0.23 | 10 |
| LYM792 | 74169.3 | — | — | — | 10.8 | 0.03 | 19 | 5.8 | 0.03 | 8 |
| LYM792 | 74172.1 | — | — | — | 11.7 | 0.02 | 29 | 6.2 | L | 15 |
| LYM792 | 74172.3 | — | — | — | 11.6 | 0.02 | 28 | 6.1 | 0.08 | 13 |
| LYM792 | 74172.4 | 0.2 | 0.12 | 7 | — | — | — | — | — | — |
| LYM775 | 74066.1 | — | — | — | 10.8 | 0.02 | 19 | 5.9 | 0.14 | 10 |
| LYM775 | 74070.1 | — | — | — | 10.8 | L | 19 | 5.9 | L | 11 |
| LYM775 | 74070.2 | — | — | — | 10.2 | 0.06 | 12 | 5.7 | 0.10 | 7 |
| LYM766 | 74062.1 | — | — | — | 10.6 | 0.23 | 16 | 5.8 | 0.07 | 8 |
| LYM766 | 74064.1 | — | — | — | 10.9 | 0.02 | 20 | 5.8 | 0.08 | 9 |
| LYM766 | 74065.3 | — | — | — | 10.7 | L | 17 | 5.8 | 0.03 | 7 |
| LYM759 | 74056.2 | — | — | — | 10.8 | 0.29 | 19 | 6.1 | L | 13 |
| LYM759 | 74057.5 | — | — | — | 10.8 | L | 18 | 5.8 | 0.25 | 9 |
| LYM759 | 74058.3 | — | — | — | 11.8 | 0.15 | 29 | 6.2 | 0.17 | 16 |
| LYM755 | 74043.4 | — | — | — | 10.4 | 0.03 | 14 | 5.8 | 0.05 | 8 |
| LYM755 | 74045.1 | — | — | — | — | — | — | 5.7 | 0.27 | 7 |
| CONT. | — | 0.2 | — | — | 9.1 | — | — | 5.4 | — | — |

"CONT."—Control; "Ave."—Average; "% Incr." = % increment; "p-val."—p-value, L—p < 0.01.

TABLE 102

Genes showing improved plant performance at Normal growth conditions under regulation of 6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LYM998 | 74217.4 | 352.0 | 0.23 | 8 | — | — | — |
| LYM954 | 74497.1 | 391.9 | L | 20 | — | — | — |
| LYM942 | 74661.5 | 367.3 | 0.29 | 12 | — | — | — |
| LYM927 | 73771.2 | 379.4 | 0.11 | 16 | — | — | — |
| LYM917 | 74456.1 | 361.4 | 0.08 | 10 | — | — | — |
| LYM879 | 74604.2 | 414.7 | 0.28 | 27 | — | — | — |
| LYM800 | 74576.1 | 381.3 | 0.09 | 17 | — | — | — |
| LYM800 | 74576.2 | 363.1 | 0.23 | 11 | — | — | — |
| LYM757 | 74428.1 | 373.7 | 0.17 | 14 | — | — | — |
| LYM1004 | 74336.2 | 369.7 | 0.16 | 13 | — | — | — |
| LYM1004 | 74336.3 | 369.0 | 0.13 | 13 | — | — | — |
| CONT. | — | 327.3 | — | — | — | — | — |
| LYM986 | 73533.2 | — | — | — | 22.9 | L | 22 |
| LYM885 | 73282.1 | — | — | — | 19.4 | 0.17 | 3 |
| LYM885 | 73283.3 | 247.1 | 0.22 | 24 | — | — | — |
| LYM881 | 73592.2 | — | — | — | 20.4 | 0.02 | 8 |
| LYM875 | 73516.4 | 259.9 | 0.29 | 31 | — | — | — |
| LYM844 | 73195.2 | — | — | — | 20.3 | 0.02 | 8 |
| LYM844 | 73199.1 | — | — | — | 20.4 | 0.03 | 8 |
| LYM827 | 73432.4 | — | — | — | 19.3 | 0.22 | 3 |
| LYM769 | 73598.3 | — | — | — | 20.8 | L | 11 |
| LYM769 | 73600.2 | — | — | — | 20.5 | 0.16 | 9 |
| LYM1009 | 73141.6 | 233.0 | 0.29 | 17 | — | — | — |
| CONT. | — | 198.8 | — | — | 18.8 | — | — |
| LYM996 | 73563.3 | 315.2 | 0.25 | 19 | — | — | — |
| LYM996 | 73564.1 | — | — | — | 19.8 | L | 5 |
| LYM962 | 73611.2 | — | — | — | 22.1 | L | 17 |
| LYM962 | 73613.4 | — | — | — | 20.4 | 0.14 | 8 |
| LYM916 | 73240.2 | — | — | — | 21.4 | 0.06 | 13 |
| LYM898 | 73463.6 | — | — | — | 20.6 | 0.14 | 9 |
| LYM892 | 73727.3 | — | — | — | 22.8 | 0.14 | 21 |
| LYM892 | 73727.4 | 310.7 | 0.17 | 17 | — | — | — |
| LYM884 | 73211.1 | 302.0 | 0.14 | 14 | — | — | — |
| LYM877 | 73201.3 | 303.0 | 0.06 | 14 | — | — | — |
| LYM873 | 73716.1 | 311.7 | 0.05 | 18 | 22.6 | L | 20 |
| LYM868 | 73572.1 | 315.1 | 0.26 | 19 | — | — | — |
| LYM868 | 73573.2 | — | — | — | 25.6 | 0.17 | 36 |
| LYM840 | 73548.2 | — | — | — | 21.7 | 0.15 | 15 |
| LYM837 | 73664.4 | — | — | — | 19.5 | 0.15 | 3 |
| LYM837 | 73665.4 | 370.2 | L | 40 | — | — | — |
| LYM764 | 73155.4 | — | — | — | 20.7 | 0.02 | 10 |
| LYM764 | 73156.2 | — | — | — | 22.5 | 0.24 | 19 |
| LYM764 | 73156.4 | — | — | — | 19.7 | 0.13 | 4 |
| LYM763 | 73458.2 | — | — | — | 21.7 | L | 15 |
| LYM762 | 73151.1 | — | — | — | 20.2 | 0.08 | 7 |
| CONT. | — | 264.7 | — | — | 18.9 | — | — |
| LYM985 | 73526.1 | 218.4 | 0.13 | 14 | — | — | — |
| LYM985 | 73526.2 | 211.9 | 0.25 | 10 | 20.2 | L | 5 |

TABLE 102-continued

Genes showing improved plant performance at Normal growth conditions under regulation of 6669 promoter

| Gene Name | Event # | Seed Yield [mg] Ave. | P-Val. | % Incr. | 1000 Seed Weight [mg] Ave. | P-Val. | % Incr. |
|---|---|---|---|---|---|---|---|
| LYM985 | 73528.1 | 227.9 | 0.12 | 19 | — | — | — |
| LYM985 | 73529.2 | — | — | — | 23.3 | 0.27 | 21 |
| LYM985 | 73530.1 | 230.5 | 0.12 | 20 | — | — | — |
| LYM939 | 74153.1 | 218.3 | 0.13 | 14 | — | — | — |
| LYM939 | 74154.1 | — | — | — | 21.5 | L | 11 |
| LYM938 | 74147.1 | — | — | — | 20.3 | 0.29 | 5 |
| LYM937 | 73551.1 | 225.7 | 0.11 | 17 | — | — | — |
| LYM937 | 73552.2 | — | — | — | 19.9 | 0.06 | 3 |
| LYM937 | 73553.1 | — | — | — | 20.7 | 0.22 | 7 |
| LYM931 | 73844.1 | 239.6 | 0.20 | 25 | — | — | — |
| LYM931 | 73844.2 | 224.0 | 0.06 | 17 | — | — | — |
| LYM931 | 73844.3 | 234.0 | 0.04 | 22 | 21.2 | 0.11 | 10 |
| LYM931 | 73847.1 | 211.7 | 0.24 | 10 | — | — | — |
| LYM877 | 73201.1 | 223.1 | 0.06 | 16 | — | — | — |
| LYM877 | 73202.3 | 229.0 | 0.12 | 19 | — | — | — |
| LYM875 | 73516.5 | 292.8 | 0.15 | 52 | — | — | — |
| LYM875 | 73517.2 | — | — | — | 22.1 | 0.04 | 14 |
| LYM875 | 73518.1 | 215.5 | 0.19 | 12 | 21.8 | L | 13 |
| LYM875 | 73519.1 | 221.4 | 0.16 | 15 | 21.2 | 0.11 | 10 |
| LYM842 | 74012.1 | 266.1 | 0.26 | 38 | 23.1 | 0.07 | 19 |
| LYM842 | 74014.1 | 211.3 | 0.29 | 10 | — | — | — |
| LYM807 | 73978.2 | 240.1 | 0.06 | 25 | — | — | — |
| LYM807 | 73980.1 | 255.6 | 0.04 | 33 | — | — | — |
| LYM807 | 73980.3 | 261.2 | 0.14 | 36 | — | — | — |
| LYM807 | 73981.3 | 236.8 | 0.04 | 23 | — | — | — |
| LYM806 | 73971.3 | 241.2 | 0.24 | 26 | — | — | — |
| LYM806 | 73971.4 | 256.9 | 0.06 | 34 | — | — | — |
| LYM803 | 74215.3 | 284.3 | L | 48 | — | — | — |
| LYM795 | 73958.3 | 255.0 | 0.13 | 33 | — | — | — |
| LYM795 | 73961.3 | — | — | — | 22.1 | 0.25 | 14 |
| LYM795 | 73963.1 | — | — | — | 19.7 | 0.14 | 2 |
| LYM784 | 74081.1 | — | — | — | 21.8 | 0.14 | 13 |
| LYM781 | 73948.4 | 216.6 | 0.15 | 13 | — | — | — |
| LYM781 | 73950.1 | 223.4 | 0.28 | 16 | — | — | — |
| LYM781 | 73950.2 | 272.6 | 0.06 | 42 | 20.0 | 0.04 | 3 |
| LYM764 | 73155.4 | 237.5 | 0.02 | 24 | — | — | — |
| LYM764 | 73156.2 | 213.7 | 0.16 | 11 | 23.4 | 0.21 | 21 |
| LYM764 | 73156.4 | — | — | — | 20.6 | 0.03 | 6 |
| LYM764 | 73157.1 | — | — | — | 19.8 | 0.23 | 2 |
| LYM1008 | 73135.1 | 222.3 | 0.08 | 16 | 23.7 | L | 22 |
| LYM1008 | 73138.5 | 259.3 | 0.16 | 35 | — | — | — |
| LYM1008 | 73140.6 | — | — | — | 21.7 | 0.01 | 12 |
| CONT. | — | 192.2 | — | — | 19.3 | — | — |
| LYM989 | 74222.1 | — | — | — | 22.5 | L | 9 |
| LYM913 | 74363.1 | — | — | — | 22.0 | 0.01 | 7 |
| LYM911 | 73840.2 | 425.3 | 0.23 | 16 | — | — | — |
| LYM896 | 74356.2 | — | — | — | 21.5 | 0.08 | 4 |
| LYM858 | 74406.1 | — | — | — | 24.1 | 0.04 | 17 |
| LYM835 | 73823.1 | 400.6 | 0.26 | 9 | — | — | — |
| LYM816 | 74335.1 | — | — | — | 23.1 | 0.13 | 12 |
| LYM811 | 74385.2 | — | — | — | 24.8 | 0.04 | 20 |
| LYM791 | 73957.2 | 403.8 | 0.03 | 10 | — | — | — |
| LYM786 | 74383.2 | — | — | — | 21.1 | 0.29 | 2 |
| LYM779 | 73189.2 | — | — | — | 24.0 | 0.04 | 17 |
| LYM779 | 73190.2 | — | — | — | 24.3 | L | 18 |
| LYM779 | 73192.2 | — | — | — | 21.9 | 0.02 | 6 |
| LYM775 | 74066.1 | — | — | — | 21.5 | 0.26 | 4 |
| LYM775 | 74070.2 | — | — | — | 22.4 | 0.06 | 9 |
| LYM761 | 73995.1 | 429.0 | 0.16 | 17 | — | — | — |
| LYM761 | 73999.3 | — | — | — | 22.5 | 0.30 | 9 |
| LYM761 | 73999.5 | — | — | — | 21.1 | 0.30 | 2 |
| LYM1004 | 74336.2 | — | — | — | 21.5 | 0.06 | 5 |
| LYM1004 | 74338.2 | 397.8 | 0.15 | 8 | — | — | — |
| CONT. | — | 367.7 | — | — | 20.6 | — | — |
| LYM991 | 74207.2 | — | — | — | 24.5 | L | 13 |
| LYM987 | 74156.7 | — | — | — | 25.6 | 0.08 | 18 |
| LYM987 | 74157.2 | — | — | — | 24.7 | 0.08 | 14 |
| LYM938 | 74144.1 | — | — | — | 22.3 | 0.20 | 3 |
| LYM938 | 74146.4 | — | — | — | 23.8 | L | 10 |
| LYM933 | 73812.1 | 354.9 | 0.07 | 16 | — | — | — |
| LYM904 | 74021.1 | 382.4 | 0.01 | 25 | — | — | — |
| LYM904 | 74021.2 | 333.3 | 0.26 | 9 | — | — | — |
| LYM897 | 73738.2 | 358.9 | 0.05 | 17 | — | — | — |
| LYM887 | 73827.1 | 351.2 | 0.06 | 15 | — | — | — |
| LYM887 | 73830.3 | — | — | — | 25.7 | L | 18 |
| LYM870 | 74424.1 | — | — | — | 23.0 | 0.07 | 6 |
| LYM867 | 74418.1 | — | — | — | 22.5 | 0.18 | 4 |
| LYM852 | 73890.1 | — | — | — | 25.2 | L | 16 |
| LYM852 | 73890.3 | 351.5 | 0.06 | 15 | — | — | — |
| LYM852 | 73891.1 | — | — | — | 25.1 | L | 15 |
| LYM851 | 74392.1 | — | — | — | 25.3 | L | 17 |
| LYM851 | 74392.2 | 397.7 | 0.11 | 30 | — | — | — |
| LYM815 | 74086.1 | — | — | — | 24.9 | 0.14 | 15 |
| LYM815 | 74087.2 | — | — | — | 26.2 | L | 21 |
| LYM815 | 74088.3 | — | — | — | 25.7 | L | 18 |
| LYM812 | 73985.1 | 335.3 | 0.19 | 10 | — | — | — |
| LYM803 | 74211.1 | 354.7 | 0.22 | 16 | — | — | — |
| LYM803 | 74215.5 | — | — | — | 22.4 | 0.22 | 3 |
| LYM755 | 74045.1 | — | — | — | 25.8 | 0.07 | 19 |
| LYM755 | 74045.3 | — | — | — | 24.8 | L | 14 |
| CONT. | — | 306.1 | — | — | 21.7 | — | — |
| LYM957 | 74199.4 | 314.3 | 0.17 | 10 | — | — | — |
| LYM957 | 74200.3 | 312.2 | 0.20 | 9 | — | — | — |
| LYM957 | 74203.4 | 324.2 | 0.28 | 14 | — | — | — |
| LYM957 | 74203.6 | 386.6 | L | 35 | — | — | — |
| LYM953 | 74486.3 | 313.2 | 0.28 | 10 | — | — | — |
| LYM953 | 74488.1 | 335.3 | 0.14 | 17 | — | — | — |
| LYM953 | 74491.2 | 326.2 | 0.14 | 14 | — | — | — |
| LYM932 | 74479.1 | 376.0 | 0.05 | 32 | — | — | — |
| LYM900 | 74454.3 | 335.7 | 0.10 | 18 | — | — | — |
| LYM857 | 74396.2 | 393.4 | 0.07 | 38 | — | — | — |
| LYM857 | 74398.2 | 349.5 | 0.10 | 22 | — | — | — |
| LYM840 | 73547.1 | 310.1 | 0.23 | 9 | — | — | — |
| LYM840 | 73549.1 | 347.2 | 0.02 | 22 | — | — | — |
| LYM802 | 74433.1 | 334.4 | 0.04 | 17 | — | — | — |
| LYM771 | 74528.1 | 385.6 | 0.08 | 35 | — | — | — |
| LYM771 | 74529.1 | 313.5 | 0.21 | 10 | — | — | — |
| LYM771 | 74530.2 | 317.1 | 0.22 | 11 | — | — | — |
| LYM771 | 74532.3 | 343.6 | 0.23 | 20 | — | — | — |
| LYM754 | 74541.1 | 347.9 | 0.13 | 22 | — | — | — |
| CONT. | — | 285.5 | — | — | — | — | — |
| LYM979 | 74243.1 | 254.4 | 0.16 | 31 | — | — | — |
| LYM963 | 74024.1 | — | — | — | 22.5 | 0.24 | 12 |
| LYM963 | 74025.4 | 228.7 | 0.01 | 18 | — | — | — |
| LYM963 | 74029.3 | 211.6 | 0.24 | 9 | — | — | — |
| LYM940 | 73818.2 | 225.9 | 0.29 | 16 | — | — | — |
| LYM905 | 73807.3 | 215.9 | 0.09 | 11 | — | — | — |
| LYM898 | 73461.1 | 219.4 | 0.10 | 13 | 22.7 | 0.26 | 13 |
| LYM898 | 73463.6 | 226.0 | 0.02 | 16 | 21.8 | 0.26 | 9 |
| LYM878 | 73234.2 | 227.2 | 0.21 | 17 | — | — | — |
| LYM849 | 73859.2 | — | — | — | 25.1 | 0.11 | 25 |
| LYM849 | 73861.2 | 208.6 | 0.19 | 7 | — | — | — |
| LYM821 | 73992.1 | 216.4 | 0.17 | 11 | — | — | — |
| LYM821 | 73993.3 | 281.1 | 0.01 | 45 | — | — | — |
| LYM812 | 73983.2 | 222.5 | 0.15 | 14 | — | — | — |
| LYM812 | 73983.7 | 218.7 | 0.22 | 13 | — | — | — |
| LYM804 | 73222.1 | 213.1 | 0.27 | 10 | 22.3 | 0.10 | 11 |
| LYM804 | 73223.1 | — | — | — | 21.7 | 0.11 | 8 |
| LYM792 | 74172.1 | — | — | — | 22.4 | L | 11 |
| LYM792 | 74172.4 | 251.5 | 0.07 | 29 | — | — | — |
| LYM759 | 74058.3 | — | — | — | 22.0 | 0.04 | 10 |
| LYM755 | 74045.1 | 210.4 | 0.18 | 8 | 23.9 | L | 19 |
| CONT. | — | 194.4 | — | — | 20.1 | — | — |

Table 102:
"CONT."—Control; "Ave."—Average; "% Incr." = % increment; "p-val."—p-value, L—p < 0.01.

The results presented in Tables 98-102 show that exogenous expression of the genes of some embodiments of the invention results in increased biomass, growth rate, yield and vigor of a plant as compared to control plants (e.g., non-transformed plants, or plants transformed with a control empty vector) grown under the same, e.g., identical conditions.

Example 20

Evaluation of Transgenic *Arabidopsis* for Seed Yield and Plant Growth Rate Under Normal Conditions in Greenhouse Assays Until Bolting (GH-SB Assays)

Assay 2: Plant performance improvement measured until bolting stage: plant biomass and plant growth rate under normal greenhouse conditions (GH-SB Assays)—This assay follows the plant biomass formation and the rosette area growth of plants grown in the greenhouse under normal growth conditions. Transgenic *Arabidopsis* seeds were sown in agar media supplemented with ½ MS medium and a selection agent (Kanamycin). The $T_2$ transgenic seedlings were then transplanted to 1.7 trays filled with peat and perlite in a 1:1 ratio. The trays were irrigated with a solution containing of 6 mM inorganic nitrogen in the form of $KNO_3$ with 1 mM $KH_2PO_4$, 1 mM $MgSO_4$, 2 mM $CaCl_2$ and microelements. All plants were grown in the greenhouse until bolting stage. Plant biomass (the above ground tissue) was weight in directly after harvesting the rosette (plant fresh weight [FW]). Following plants were dried in an oven at 50° C. for 48 hours and weighted (plant dry weight [DW]).

Each construct was validated at its $T_2$ generation. Transgenic plants transformed with a construct conformed by an empty vector carrying the At6669 promoter (SEQ ID NO:10575) and the selectable marker was used as control.

The plants were analyzed for their overall size, growth rate, fresh weight and dry matter. Transgenic plants performance was compared to control plants grown in parallel under the same conditions. Mock-transgenic plants expressing the uidA reporter gene (GUS-Intron) or with no gene at all, under the same promoter were used as control.

The experiment was planned in nested randomized plot distribution. For each gene of the invention three to five independent transformation events were analyzed from each construct.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) was used for capturing images of plant samples.

The image capturing process was repeated every 2 days starting from day 1 after transplanting till day 15. Same camera, placed in a custom made iron mount, was used for capturing images of larger plants sawn in white tubs in an environmental controlled greenhouse. The tubs were square shape include 1.7 liter trays. During the capture process, the tubes were placed beneath the iron mount, while avoiding direct sun light and casting of shadows.

An image analysis system was used, which consists of a personal desktop computer (Intel P4 3.0 GHz processor) and a public domain program—ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Leaf analysis—Using the digital analysis leaves data was calculated, including leaf number, rosette area, rosette diameter, and leaf blade area.

Vegetative growth rate: the relative growth rate (RGR) of leaf number (Formula IX, described above), rosette area (Formula VIII described above) and plot coverage (Formula XIX, described above) were calculated using the indicated formulas.

Plant Fresh and Dry weight—On about day 80 from sowing, the plants were harvested and directly weight for the determination of the plant fresh weight (FW) and left to dry at 50° C. in a drying chamber for about 48 hours before weighting to determine plant dry weight (DW).

Statistical analyses—To identify outperforming genes and constructs, results from the independent transformation events tested were analyzed separately. Data was analyzed using Student's t-test and results are considered significant if the p value was less than 0.1. The JMP statistics software package was used (Version 5.2.1, SAS Institute Inc., Cary, N.C., USA).

Experimental Results:

Tables 103-105 summarize the observed phenotypes of transgenic plants expressing the genes constructs using the GH-SB Assays.

The genes listed in Tables 103-105 improved plant performance when grown at normal conditions. These genes produced larger plants with a larger photosynthetic area, biomass (fresh weight, dry weight, leaf number, rosette diameter, rosette area and plot coverage), relative growth rate, blade relative area and petiole relative area as compared to control plants (e.g., non-transformed plants or plants transformed with an "empty" vector) which were grown under identical conditions. The genes were cloned under the regulation of a constitutive At6669 promoter (SEQ ID NO:10575). The evaluation of each gene was performed by testing the performance of different number of events. Event with p-value <0.1 was considered statistically significant.

TABLE 103

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM987 | 74156.1 | 365.0 | 0.23 | 6 | — | — | — | — | — | — |
| LYM987 | 74156.7 | 536.5 | 0.19 | 56 | 5016.1 | 0.05 | 18 | 10.1 | L | 4 |
| LYM987 | 74157.1 | — | — | — | 4656.2 | 0.02 | 9 | — | — | — |
| LYM984 | 74256.2 | 365.0 | 0.19 | 6 | — | — | — | 10.2 | L | 5 |
| LYM984 | 74256.4 | — | — | — | 4518.8 | 0.18 | 6 | — | — | — |
| LYM962 | 73611.2 | — | — | — | 4581.2 | 0.15 | 7 | 10.4 | L | 7 |
| LYM962 | 73613.4 | — | — | — | — | — | — | 10.2 | 0.19 | 5 |
| LYM962 | 73615.2 | — | — | — | 4718.8 | 0.10 | 11 | — | — | — |

TABLE 103-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM939 | 74150.5 | 396.2 | 0.02 | 15 | 4756.2 | 0.02 | 11 | 10.1 | 0.02 | 4 |
| LYM939 | 74153.1 | 365.0 | 0.09 | 6 | 4681.2 | 0.01 | 10 | 10.6 | 0.14 | 9 |
| LYM939 | 74154.1 | — | — | — | — | — | — | 10.6 | 0.23 | 9 |
| LYM933 | 73810.2 | — | — | — | — | — | — | 9.9 | 0.08 | 2 |
| LYM933 | 73810.4 | — | — | — | — | — | — | 10.4 | L | 8 |
| LYM933 | 73812.1 | — | — | — | — | — | — | 10.2 | 0.19 | 5 |
| LYM933 | 73812.2 | 377.5 | 0.21 | 10 | 4768.8 | L | 12 | — | — | — |
| LYM933 | 73812.5 | — | — | — | 4443.8 | 0.10 | 4 | — | — | — |
| LYM931 | 73844.1 | 363.1 | 0.11 | 5 | 4737.5 | L | 11 | 10.2 | 0.06 | 6 |
| LYM931 | 73847.1 | — | — | — | — | — | — | 10.2 | 0.19 | 5 |
| LYM913 | 74363.1 | — | — | — | 4543.8 | 0.25 | 6 | — | — | — |
| LYM913 | 74363.2 | — | — | — | 4462.5 | 0.10 | 5 | — | — | — |
| LYM913 | 74364.3 | — | — | — | 4693.8 | 0.14 | 10 | — | — | — |
| LYM913 | 74365.1 | — | — | — | — | — | — | 10.3 | L | 6 |
| LYM896 | 74356.1 | — | — | — | 4618.8 | 0.03 | 8 | — | — | — |
| LYM896 | 74356.2 | — | — | — | — | — | — | 10.1 | 0.27 | 4 |
| LYM896 | 74358.4 | 358.8 | 0.21 | 4 | — | — | — | — | — | — |
| LYM896 | 74359.1 | — | — | — | 4725.0 | 0.13 | 11 | — | — | — |
| LYM896 | 74359.3 | — | — | — | 4550.0 | 0.16 | 7 | — | — | — |
| LYM884 | 73209.2 | — | — | — | 4481.2 | 0.05 | 5 | 10.1 | 0.02 | 4 |
| LYM884 | 73210.2 | 371.2 | 0.17 | 8 | — | — | — | — | — | — |
| LYM884 | 73211.1 | — | — | — | 4518.8 | 0.08 | 6 | — | — | — |
| LYM884 | 73212.2 | — | — | — | — | — | — | 10.2 | L | 5 |
| LYM873 | 73712.2 | — | — | — | 4856.2 | L | 14 | 10.2 | L | 5 |
| LYM873 | 73713.3 | — | — | — | 4550.0 | 0.13 | 7 | — | — | — |
| LYM873 | 73716.1 | — | — | — | 4731.2 | 0.19 | 11 | — | — | — |
| LYM867 | 74417.4 | — | — | — | — | — | — | 10.8 | L | 11 |
| LYM867 | 74419.1 | — | — | — | — | — | — | 10.8 | L | 11 |
| LYM867 | 74419.2 | — | — | — | 4475.0 | 0.22 | 5 | — | — | — |
| LYM864 | 74409.1 | — | — | — | 4500.0 | 0.04 | 5 | — | — | — |
| LYM864 | 74409.4 | — | — | — | 4837.5 | L | 13 | — | — | — |
| LYM864 | 74411.3 | 408.8 | 0.15 | 19 | 4900.0 | 0.12 | 15 | — | — | — |
| LYM864 | 74412.2 | 366.2 | 0.07 | 6 | 4550.0 | 0.23 | 7 | — | — | — |
| LYM864 | 74412.4 | 397.5 | 0.25 | 15 | 4750.0 | 0.01 | 11 | — | — | — |
| LYM844 | 73196.2 | — | — | — | 4718.8 | 0.02 | 11 | 10.1 | L | 4 |
| LYM844 | 73197.3 | — | — | — | 4775.9 | L | 12 | — | — | — |
| LYM828 | 73785.1 | — | — | — | — | — | — | 10.8 | L | 11 |
| LYM828 | 73788.1 | — | — | — | 4412.5 | 0.18 | 3 | — | — | — |
| LYM828 | 73789.2 | — | — | — | 4743.8 | L | 11 | — | — | — |
| LYM827 | 73430.1 | 380.6 | 0.01 | 11 | — | — | — | — | — | — |
| LYM827 | 73434.3 | — | — | — | — | — | — | 10.2 | L | 5 |
| LYM792 | 74172.1 | — | — | — | 4756.2 | 0.27 | 11 | — | — | — |
| LYM792 | 74172.4 | — | — | — | 4581.2 | 0.01 | 7 | — | — | — |
| LYM759 | 74057.5 | — | — | — | 4531.2 | 0.27 | 6 | 10.0 | 0.18 | 3 |
| LYM759 | 74058.3 | — | — | — | 4656.2 | 0.05 | 9 | 10.2 | 0.06 | 6 |
| LYM759 | 74058.4 | — | — | — | 4843.8 | 0.25 | 13 | — | — | — |
| LYM1000 | 74327.2 | — | — | — | 4868.8 | L | 14 | 10.2 | 0.19 | 5 |
| LYM1000 | 74328.4 | — | — | — | 4456.2 | 0.24 | 4 | — | — | — |
| LYM1000 | 74329.1 | — | — | — | 4768.8 | L | 12 | — | — | — |
| CONT. | — | 344.3 | — | — | 4267.9 | — | — | 9.7 | — | — |
| LYM947 | 73297.4 | — | — | — | — | — | — | 12.3 | L | 9 |
| LYM947 | 73299.2 | 277.5 | 0.16 | 9 | 3800.0 | 0.14 | 8 | — | — | — |
| LYM947 | 73300.1 | — | — | — | — | — | — | 12.6 | L | 11 |
| LYM947 | 73300.2 | 274.4 | 0.17 | 8 | 4025.0 | 0.01 | 14 | — | — | — |
| LYM947 | 73300.3 | 298.1 | L | 17 | 4093.8 | 0.08 | 16 | — | — | — |
| LYM940 | 73814.1 | — | — | — | — | — | — | 11.9 | 0.11 | 6 |
| LYM940 | 73815.2 | — | — | — | — | — | — | 12.7 | L | 12 |
| LYM940 | 73816.1 | — | — | — | — | — | — | 12.3 | L | 9 |
| LYM940 | 73817.1 | — | — | — | — | — | — | 12.2 | 0.02 | 8 |
| LYM940 | 73818.2 | — | — | — | 3687.5 | 0.29 | 5 | — | — | — |
| LYM923 | 73286.2 | 278.8 | 0.14 | 9 | 4031.2 | 0.14 | 14 | 11.9 | 0.22 | 6 |
| LYM923 | 73286.4 | — | — | — | 4000.0 | 0.14 | 13 | 11.9 | 0.11 | 6 |
| LYM923 | 73287.4 | — | — | — | — | — | — | 11.7 | 0.21 | 3 |
| LYM923 | 73288.2 | — | — | — | — | — | — | 11.8 | 0.17 | 5 |
| LYM909 | 73832.1 | 312.5 | L | 23 | 4043.8 | 0.02 | 15 | — | — | — |
| LYM909 | 73835.1 | 286.2 | 0.05 | 12 | 3987.5 | 0.07 | 13 | — | — | — |
| LYM897 | 73736.4 | 271.9 | 0.25 | 7 | 3950.0 | 0.24 | 12 | 12.1 | 0.03 | 7 |
| LYM897 | 73738.3 | 298.1 | 0.07 | 17 | 3893.8 | 0.04 | 10 | — | — | — |
| LYM897 | 73741.3 | — | — | — | 3918.8 | 0.16 | 11 | 12.1 | 0.17 | 7 |
| LYM885 | 73282.1 | 277.5 | 0.16 | 9 | — | — | — | 12.2 | 0.06 | 8 |
| LYM885 | 73282.2 | — | — | — | — | — | — | 12.2 | 0.23 | 8 |
| LYM885 | 73283.1 | 291.2 | 0.15 | 14 | 3893.8 | 0.18 | 10 | — | — | — |

TABLE 103-continued

Genes showing improved plant performance at Normal growth conditions under regulation of At6669 promoter

| Gene Name | Event # | Dry Weight [mg] | | | Fresh Weight [mg] | | | Leaf Number | | |
|---|---|---|---|---|---|---|---|---|---|---|
| | | Ave. | P-Val. | % Incr. | Ave. | P-Val. | % Incr. | Ave. | P-Val. | % Incr. |
| LYM885 | 73283.3 | 306.9 | L | 21 | 4112.5 | L | 17 | — | — | — |
| LYM869 | 73576.4 | 286.2 | 0.04 | 12 | 4018.8 | 0.01 | 14 | — | — | — |
| LYM869 | 73578.2 | — | — | — | — | — | — | 12.0 | 0.05 | 6 |
| LYM869 | 73579.2 | 310.0 | L | 22 | 4394.6 | L | 25 | 12.3 | L | 9 |
| LYM869 | 73579.3 | 306.2 | 0.03 | 20 | 4275.0 | L | 21 | — | — | — |
| LYM868 | 73568.1 | — | — | — | — | — | — | 12.4 | 0.04 | 10 |
| LYM868 | 73572.1 | 271.9 | 0.15 | 7 | — | — | — | 11.8 | 0.11 | 5 |
| LYM868 | 73573.2 | 314.4 | 0.02 | 23 | 4406.2 | 0.02 | 25 | 12.8 | 0.08 | 13 |
| LYM866 | 73707.3 | 291.2 | 0.25 | 14 | 4025.0 | 0.17 | 14 | 12.2 | 0.06 | 8 |
| LYM866 | 73708.2 | — | — | — | — | — | — | 12.1 | 0.03 | 7 |
| LYM866 | 73708.4 | — | — | — | 3925.0 | 0.17 | 11 | — | — | — |
| LYM866 | 73709.2 | 281.9 | 0.25 | 11 | 3687.5 | 0.29 | 5 | 12.0 | 0.05 | 6 |
| LYM866 | 73709.3 | 275.6 | 0.12 | 8 | 3931.2 | 0.03 | 11 | — | — | — |
| LYM849 | 73856.1 | — | — | — | — | — | — | 12.1 | 0.02 | 7 |
| LYM849 | 73858.2 | — | — | — | — | — | — | 11.8 | 0.17 | 5 |
| LYM849 | 73859.2 | — | — | — | 3868.8 | 0.05 | 10 | 12.1 | 0.17 | 7 |
| LYM849 | 73860.1 | 310.0 | 0.02 | 22 | 4168.8 | L | 18 | 11.7 | 0.21 | 3 |
| LYM849 | 73861.2 | — | — | — | — | — | — | 11.9 | 0.08 | 5 |
| LYM835 | 73822.1 | — | — | — | — | — | — | 12.3 | 0.02 | 9 |
| LYM835 | 73823.1 | — | — | — | — | — | — | 12.1 | 0.17 | 7 |
| LYM835 | 73825.1 | 276.9 | 0.08 | 9 | 3900.0 | 0.08 | 11 | — | — | — |
| LYM835 | 73825.3 | 307.5 | 0.01 | 21 | 3868.8 | 0.15 | 10 | 12.4 | 0.13 | 10 |
| LYM806 | 73971.3 | — | — | — | — | — | — | 11.8 | 0.18 | 4 |
| LYM806 | 73971.4 | 319.4 | 0.04 | 25 | 4337.5 | L | 23 | 12.2 | 0.13 | 8 |
| LYM806 | 73973.5 | 290.6 | 0.01 | 14 | 3987.5 | 0.02 | 13 | 12.1 | 0.03 | 7 |
| LYM797 | 73965.1 | 302.1 | 0.23 | 19 | 4041.1 | 0.19 | 15 | 12.2 | 0.16 | 8 |
| LYM797 | 73966.1 | 291.2 | 0.30 | 14 | 4068.7 | L | 15 | 12.2 | 0.04 | 8 |
| LYM797 | 73966.3 | — | — | — | 3956.2 | 0.29 | 12 | 12.6 | L | 11 |
| LYM797 | 73967.1 | 311.9 | 0.06 | 22 | — | — | — | — | — | — |
| LYM797 | 73968.2 | — | — | — | — | — | — | 12.0 | 0.13 | 6 |
| LYM784 | 74080.2 | — | — | — | — | — | — | 12.1 | 0.17 | 7 |
| LYM784 | 74081.1 | — | — | — | — | — | — | 11.8 | 0.18 | 4 |
| LYM784 | 74081.3 | 321.9 | L | 26 | 4456.2 | L | 26 | 11.9 | 0.11 | 6 |
| LYM784 | 74083.3 | 293.8 | 0.06 | 15 | 4075.0 | 0.01 | 16 | 12.8 | 0.15 | 13 |
| LYM781 | 73948.2 | 296.9 | 0.26 | 17 | 4268.8 | 0.17 | 21 | — | — | — |
| LYM781 | 73949.1 | 293.8 | 0.03 | 15 | 3956.2 | 0.02 | 12 | 12.6 | L | 11 |
| LYM781 | 73950.1 | 275.6 | 0.09 | 8 | 3731.2 | 0.19 | 6 | — | — | — |
| LYM781 | 73950.2 | — | — | — | — | — | — | 12.2 | 0.26 | 8 |
| LYM761 | 73995.3 | 275.6 | 0.15 | 8 | — | — | — | — | — | — |
| LYM761 | 73999.2 | — | — | — | — | — | — | 11.9 | 0.10 | 5 |
| LYM761 | 73999.3 | 297.0 | L | 17 | 4014.3 | 0.05 | 14 | — | — | — |
| LYM761 | 73999.5 | — | — | — | — | — | — | 12.4 | 0.04 | 10 |
| LYM758 | 74050.4 | 303.8 | 0.11 | 19 | 4031.2 | 0.18 | 14 | 12.2 | 0.16 | 8 |
| LYM758 | 74102.3 | — | — | — | — | — | — | 12.2 | 0.02 | 8 |
| LYM758 | 74104.4 | 285.6 | 0.29 | 12 | 4000.0 | 0.10 | 13 | — | — | — |
| LYM1008 | 73136.2 | — | — | — | — | — | — | 12.1 | 0.17 | 7 |
| LYM1008 | 73138.5 | — | — | — | — | — | — | 12.1 | 0.28 | 7 |
| LYM1008 | 73140.6 | — | — | — | — | — | — | 12.2 | 0.02 | 8 |
| CONT. | — | 254.6 | — | — | 3527.5 | — | — | 11.3 | — | — |
| LYM981 | 75058.2 | 124.0 | 0.04 | 23 | 1508.9 | 0.05 | 24 | 11.2 | L | 11 |
| LYM981 | 75060.3 | 123.3 | 0.25 | 22 | 1452.1 | 0.14 | 19 | — | — | — |
| LYM981 | 75061.1 | 125.6 | 0.04 | 24 | 1412.5 | 0.06 | 16 | 11.0 | 0.19 | 9 |
| LYM981 | 75062.6 | — | — | — | — | — | — | 11.1 | L | 10 |
| LYM959 | 74666.2 | 120.3 | 0.12 | 19 | 1440.2 | 0.04 | 18 | 11.0 | 0.09 | 9 |
| LYM959 | 74669.2 | — | — | — | — | — | — | 10.6 | 0.08 | 5 |
| LYM959 | 74669.4 | 115.0 | 0.15 | 14 | 1381.2 | 0.13 | 13 | 10.9 | 0.15 | 8 |
| LYM959 | 74671.1 | — | — | — | — | — | — | 10.6 | 0.07 | 5 |
| LYM950 | 75081.1 | — | — | — | — | — | — | 10.6 | 0.07 | 5 |
| LYM950 | 75083.1 | — | — | — | — | — | — | 10.8 | 0.19 | 7 |
| LYM950 | 75083.3 | — | — | — | — | — | — | 10.5 | 0.15 | 4 |
| LYM926 | 75573.2 | — | — | — | — | — | — | 10.4 | 0.16 | 4 |
| LYM926 | 75576.3 | — | — | — | — | — | — | 11.2 | 0.19 | 11 |
| LYM926 | 75577.2 | — | — | — | — | — | — | 10.5 | 0.15 | 4 |
| LYM801 | 75556.2 | — | — | — | — | — | — | 11.2 | L | 12 |
| LYM801 | 75557.6 | — | — | — | 1456.2 | 0.03 | 19 | 10.8 | 0.28 | 7 |
| LYM801 | 75559.1 | — | — | — | 1356.2 | 0.14 | 11 | 11.4 | L | 13 |
| LYM789 | 74607.1 | 111.6 | 0.30 | 10 | — | — | — | 11.4 | L | 13 |
| LYM789 | 74608.2 | — | — | — | — | — | — | 10.8 | 0.02 | 7 |
| LYM789 | 74608.4 | 116.2 | 0.21 | 15 | 1425.0 | 0.22 | 17 | 11.8 | 0.02 | 17 |
| LYM789 | 74608.5 | — | — | — | — | — | — | 10.4 | 0.16 | 4 |
| LYM789 | 74611.4 | — | — | — | — | — | — | 11.0 | 0.01 | 9 |
| LYM788 | 75543.2 | — | — | — | 1425.0 | 0.27 | 17 | 11.0 | L | 9 |

TABLE 103-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LYM788 | 75544.1 | — | — | — | — | — | — | 10.8 | 0.03 | 7 |
| LYM788 | 75544.4 | — | — | — | — | — | — | 10.6 | 0.08 | 5 |
| LYM788 | 75546.2 | 112.0 | 0.25 | 11 | — | — | — | 11.2 | 0.05 | 12 |
| CONT. | — | 101.2 | — | — | 1219.1 | — | — | 10.1 | — | — |
| LYM981 | 75060.3 | — | — | — | 2737.5 | L | 15 | 10.8 | 0.05 | 8 |
| LYM981 | 75062.1 | — | — | — | — | — | — | 10.4 | 0.24 | 4 |
| LYM981 | 75062.6 | — | — | — | — | — | — | 10.4 | 0.23 | 3 |
| LYM979 | 74244.1 | 219.0 | 0.14 | 10 | — | — | — | — | — | — |
| LYM953 | 74486.3 | — | — | — | — | — | — | 10.3 | 0.27 | 3 |
| LYM939 | 74150.5 | — | — | — | — | — | — | 10.4 | 0.24 | 4 |
| LYM917 | 74457.1 | — | — | — | — | — | — | 10.6 | 0.05 | 6 |
| LYM917 | 74461.1 | 231.9 | 0.11 | 17 | — | — | — | — | — | — |
| LYM911 | 73840.2 | 223.8 | 0.27 | 12 | — | — | — | — | — | — |
| LYM907 | 74706.2 | — | — | — | — | — | — | 10.6 | 0.05 | 5 |
| LYM907 | 74707.4 | — | — | — | 2493.8 | 0.27 | 5 | — | — | — |
| LYM895 | 74631.4 | 233.9 | 0.10 | 18 | — | — | — | — | — | — |
| LYM895 | 74632.3 | 234.4 | 0.02 | 18 | — | — | — | — | — | — |
| LYM824 | 74726.1 | 258.8 | L | 30 | 2575.0 | 0.20 | 8 | — | — | — |
| LYM809 | 74983.3 | — | — | — | — | — | — | 10.6 | 0.14 | 5 |
| LYM809 | 74986.1 | — | — | — | — | — | — | 10.5 | 0.11 | 4 |
| LYM809 | 74987.3 | 247.5 | 0.03 | 24 | — | — | — | — | — | — |
| LYM789 | 74608.2 | 230.0 | 0.04 | 16 | 2575.0 | 0.29 | 8 | 10.4 | 0.12 | 4 |
| LYM789 | 74608.4 | — | — | — | — | — | — | 10.4 | 0.23 | 3 |
| LYM789 | 74608.5 | — | — | — | 2643.8 | 0.02 | 11 | 11.1 | 0.06 | 11 |
| LYM773 | 75073.2 | — | — | — | — | — | — | 10.9 | 0.25 | 9 |
| CONT. | — | 198.9 | — | — | 2383.7 | — | — | 10.1 | — | — |
| LYM996 | 73563.3 | 274.4 | 0.16 | 15 | — | — | — | — | — | — |
| LYM996 | 73566.3 | 292.5 | 0.05 | 23 | 3956.2 | 0.04 | 19 | — | — | — |
| LYM996 | 73566.4 | 273.6 | 0.17 | 15 | 3621.4 | 0.30 | 9 | — | — | — |
| LYM996 | 73567.1 | 309.8 | 0.02 | 30 | 4147.3 | 0.02 | 24 | 9.6 | 0.12 | 4 |
| LYM986 | 73533.1 | 296.9 | 0.04 | 25 | 3925.0 | 0.05 | 18 | — | — | — |
| LYM986 | 73533.2 | 276.2 | 0.17 | 16 | 3693.8 | 0.17 | 11 | — | — | — |
| LYM986 | 73533.3 | 273.8 | 0.28 | 15 | 3731.2 | 0.25 | 12 | — | — | — |
| LYM963 | 74024.1 | 303.8 | 0.03 | 28 | 4143.8 | 0.02 | 24 | — | — | — |
| LYM963 | 74026.1 | 294.6 | 0.11 | 24 | 4102.7 | 0.10 | 23 | — | — | — |
| LYM963 | 74026.2 | — | — | — | — | — | — | 9.8 | 0.06 | 6 |
| LYM916 | 73238.1 | 293.1 | 0.07 | 23 | 3787.5 | 0.17 | 14 | — | — | — |
| LYM916 | 73238.3 | 273.1 | 0.17 | 15 | 3706.2 | 0.18 | 11 | — | — | — |
| LYM916 | 73238.4 | 323.8 | 0.03 | 36 | 4462.5 | L | 34 | — | — | — |
| LYM905 | 73802.5 | 280.6 | 0.11 | 18 | 3706.2 | 0.22 | 11 | — | — | — |
| LYM905 | 73807.3 | 281.2 | 0.22 | 18 | 4056.3 | 0.18 | 22 | — | — | — |
| LYM892 | 73724.4 | 336.2 | L | 41 | 4612.5 | L | 38 | — | — | — |
| LYM889 | 73790.1 | 265.1 | 0.29 | 11 | — | — | — | — | — | — |
| LYM889 | 73792.1 | 288.8 | 0.26 | 21 | 3806.2 | 0.22 | 14 | — | — | — |
| LYM889 | 73793.2 | — | — | — | — | — | — | 9.6 | 0.11 | 4 |
| LYM889 | 73794.2 | 300.0 | 0.07 | 26 | 4181.2 | 0.01 | 25 | — | — | — |
| LYM881 | 73593.3 | — | — | — | 4193.8 | 0.09 | 26 | — | — | — |
| LYM881 | 73597.2 | 279.4 | 0.12 | 17 | — | — | — | — | — | — |
| LYM837 | 73665.4 | 286.9 | 0.08 | 21 | 3756.2 | 0.12 | 13 | — | — | — |
| LYM837 | 73666.3 | 285.3 | 0.08 | 20 | 4033.9 | 0.03 | 21 | — | — | — |
| LYM837 | 73668.3 | — | — | — | 3768.8 | 0.22 | 13 | — | — | — |
| LYM828 | 73784.2 | 278.1 | 0.13 | 17 | 3768.8 | 0.11 | 13 | — | — | — |
| LYM828 | 73785.1 | — | — | — | 3836.6 | 0.12 | 15 | — | — | — |
| LYM828 | 73789.2 | — | — | — | — | — | — | 9.6 | 0.11 | 4 |
| LYM821 | 73988.1 | — | — | — | 3856.2 | 0.09 | 16 | — | — | — |
| LYM821 | 73991.4 | 275.0 | 0.15 | 16 | — | — | — | — | — | — |
| LYM821 | 73992.1 | — | — | — | — | — | — | 9.6 | 0.11 | 4 |
| LYM821 | 73992.2 | 285.0 | 0.09 | 20 | 3881.2 | 0.06 | 16 | 9.4 | 0.29 | 2 |
| LYM821 | 73993.3 | 303.1 | 0.14 | 27 | 4331.2 | 0.06 | 30 | — | — | — |
| LYM815 | 74085.1 | — | — | — | 3650.0 | 0.23 | 10 | — | — | — |
| LYM815 | 74086.1 | 288.5 | 0.07 | 21 | 3968.8 | 0.03 | 19 | — | — | — |
| LYM815 | 74087.2 | 311.9 | 0.02 | 31 | 4175.0 | 0.09 | 25 | — | — | — |
| LYM815 | 74087.3 | 305.6 | 0.06 | 28 | 4250.0 | 0.09 | 28 | — | — | — |
| LYM807 | 73976.2 | 275.0 | 0.22 | 16 | — | — | — | — | — | — |
| LYM807 | 73978.2 | 318.8 | 0.02 | 34 | 4150.0 | 0.04 | 25 | 9.8 | 0.06 | 6 |
| LYM807 | 73980.3 | 310.0 | 0.18 | 30 | 4250.0 | 0.04 | 28 | — | — | — |
| LYM795 | 73958.3 | 280.6 | 0.13 | 18 | — | — | — | 9.5 | 0.26 | 3 |
| LYM795 | 73960.2 | 296.9 | 0.13 | 25 | 4000.0 | 0.03 | 20 | — | — | — |
| LYM795 | 73960.4 | 284.4 | 0.11 | 19 | 3906.2 | 0.23 | 17 | — | — | — |
| LYM795 | 73963.1 | — | — | — | — | — | — | 9.5 | 0.26 | 3 |
| LYM779 | 73190.2 | — | — | — | — | — | — | 9.5 | 0.26 | 3 |
| LYM779 | 73191.1 | — | — | — | — | — | — | 9.5 | 0.26 | 3 |

TABLE 103-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LYM779 | 73193.2 | 275.6 | 0.15 | 16 | 3831.2 | 0.08 | 15 | — | — | — |
| LYM766 | 74062.1 | 301.5 | 0.03 | 27 | 4089.3 | 0.02 | 23 | — | — | — |
| LYM766 | 74065.4 | 300.6 | 0.05 | 26 | 4275.0 | 0.03 | 28 | 9.6 | 0.06 | 4 |
| LYM763 | 73457.2 | 313.1 | 0.03 | 32 | 4212.5 | 0.09 | 26 | — | — | — |
| LYM763 | 73457.3 | 305.0 | 0.10 | 28 | 4237.5 | 0.07 | 27 | — | — | — |
| LYM763 | 73458.5 | 273.1 | 0.17 | 15 | — | — | — | — | — | — |
| LYM1009 | 73141.2 | 276.9 | 0.16 | 16 | 3931.2 | 0.05 | 18 | — | — | — |
| LYM1009 | 73141.5 | 292.5 | 0.06 | 23 | 3787.5 | 0.18 | 14 | — | — | — |
| LYM1009 | 73141.6 | 282.5 | 0.15 | 19 | 3906.2 | 0.05 | 17 | — | — | — |
| LYM1009 | 73143.4 | 300.0 | 0.15 | 26 | 3943.8 | 0.05 | 18 | — | — | — |
| CONT. | — | 238.0 | — | — | 3332.1 | — | — | 9.2 | — | — |
| LYM999 | 75018.1 | — | — | — | 1899.1 | 0.02 | 13 | — | — | — |
| LYM999 | 75018.2 | 190.6 | 0.03 | 19 | 2087.5 | L | 24 | — | — | — |
| LYM999 | 75019.3 | 173.3 | 0.17 | 8 | 1800.0 | 0.24 | 7 | — | — | — |
| LYM999 | 75019.4 | — | — | — | — | — | — | 9.8 | L | 9 |
| LYM999 | 75022.1 | 195.6 | 0.07 | 22 | 2025.0 | 0.02 | 20 | 9.6 | 0.03 | 7 |
| LYM992 | 74648.1 | — | — | — | — | — | — | 9.7 | L | 8 |
| LYM992 | 74649.3 | — | — | — | 1773.2 | 0.25 | 5 | — | — | — |
| LYM992 | 74649.4 | 173.0 | 0.25 | 8 | 2027.7 | L | 20 | 9.8 | 0.02 | 8 |
| LYM992 | 74651.2 | — | — | — | — | — | — | 9.5 | L | 6 |
| LYM992 | 74653.4 | — | — | — | — | — | — | 9.8 | L | 9 |
| LYM990 | 74642.2 | 220.8 | 0.19 | 38 | 2446.4 | 0.02 | 45 | — | — | — |
| LYM990 | 74643.2 | 186.2 | 0.19 | 16 | 2137.5 | L | 27 | 9.5 | 0.25 | 6 |
| LYM990 | 74643.3 | — | — | — | — | — | — | 9.4 | 0.19 | 5 |
| LYM990 | 74644.1 | — | — | — | 1912.5 | 0.03 | 13 | 9.6 | 0.03 | 7 |
| LYM990 | 74644.2 | — | — | — | 2043.8 | L | 21 | 9.3 | 0.05 | 3 |
| LYM982 | 74709.4 | — | — | — | 2062.5 | 0.27 | 22 | 10.1 | L | 12 |
| LYM982 | 74710.3 | — | — | — | — | — | — | 9.3 | 0.05 | 3 |
| LYM959 | 74666.2 | — | — | — | 2331.2 | 0.25 | 38 | 9.5 | 0.10 | 5 |
| LYM959 | 74669.4 | — | — | — | 2043.8 | 0.25 | 21 | — | — | — |
| LYM943 | 74699.4 | — | — | — | — | — | — | 9.6 | L | 6 |
| LYM935 | 74654.1 | — | — | — | — | — | — | 9.3 | 0.30 | 3 |
| LYM935 | 74656.1 | — | — | — | 1863.4 | 0.09 | 11 | 9.3 | 0.05 | 3 |
| LYM935 | 74657.1 | — | — | — | — | — | — | 9.3 | 0.07 | 3 |
| LYM935 | 74659.2 | — | — | — | — | — | — | 9.5 | L | 6 |
| LYM922 | 75075.1 | — | — | — | 2193.8 | 0.28 | 30 | — | — | — |
| LYM922 | 75076.1 | 195.0 | L | 22 | — | — | — | — | — | — |
| LYM922 | 75078.1 | 179.9 | 0.07 | 12 | — | — | — | 9.6 | L | 6 |
| LYM922 | 75080.1 | — | — | — | — | — | — | 9.8 | L | 8 |
| LYM922 | 75080.2 | 170.7 | 0.26 | 7 | 1976.8 | 0.02 | 17 | 9.8 | 0.16 | 9 |
| LYM915 | 74956.1 | 220.2 | 0.13 | 37 | 2193.8 | 0.20 | 30 | 9.6 | 0.03 | 7 |
| LYM915 | 74957.1 | 186.9 | 0.23 | 17 | 1975.0 | 0.13 | 17 | 9.8 | 0.20 | 9 |
| LYM915 | 74958.2 | — | — | — | — | — | — | 9.6 | 0.19 | 7 |
| LYM915 | 74958.4 | 201.9 | L | 26 | 2181.2 | 0.08 | 29 | 10.1 | 0.25 | 12 |
| LYM904 | 74018.1 | — | — | — | 1885.7 | 0.03 | 12 | 9.2 | 0.21 | 2 |
| LYM904 | 74021.1 | 181.9 | 0.19 | 14 | 2031.2 | L | 20 | 9.6 | L | 6 |
| LYM904 | 74021.2 | 182.5 | 0.12 | 14 | 2012.5 | L | 19 | 10.4 | L | 15 |
| LYM847 | 75051.3 | — | — | — | — | — | — | 9.7 | L | 8 |
| LYM847 | 75052.1 | — | — | — | — | — | — | 9.7 | 0.10 | 8 |
| LYM847 | 75052.2 | — | — | — | — | — | — | 9.7 | 0.24 | 8 |
| LYM847 | 75052.4 | — | — | — | — | — | — | 9.4 | 0.01 | 5 |
| LYM842 | 74012.3 | 235.5 | 0.25 | 47 | — | — | — | 9.5 | 0.25 | 6 |
| LYM842 | 74012.4 | — | — | — | — | — | — | 9.2 | 0.21 | 2 |
| LYM842 | 74017.6 | 202.9 | 0.19 | 27 | 2150.0 | 0.24 | 28 | — | — | — |
| LYM842 | 74017.7 | 181.2 | 0.13 | 13 | 2087.5 | L | 24 | 9.6 | 0.13 | 6 |
| LYM839 | 74995.2 | 196.4 | 0.16 | 23 | — | — | — | 9.8 | 0.15 | 8 |
| LYM839 | 74996.1 | — | — | — | — | — | — | 9.8 | 0.30 | 9 |
| LYM839 | 74996.2 | — | — | — | — | — | — | 9.4 | 0.01 | 5 |
| LYM839 | 74996.3 | — | — | — | — | — | — | 10.2 | 0.08 | 14 |
| LYM839 | 74996.5 | 185.0 | 0.04 | 15 | 2050.0 | 0.02 | 22 | 9.6 | L | 6 |
| LYM826 | 74619.2 | 177.5 | 0.16 | 11 | 1962.5 | 0.04 | 16 | 9.6 | L | 6 |
| LYM826 | 74620.2 | — | — | — | — | — | — | 9.2 | 0.24 | 3 |
| LYM826 | 74620.3 | — | — | — | 1787.5 | 0.21 | 6 | 9.4 | 0.11 | 4 |
| LYM826 | 74623.2 | 232.6 | 0.14 | 45 | 2275.0 | L | 35 | 9.7 | 0.24 | 8 |
| LYM808 | 74612.1 | 173.8 | 0.30 | 8 | 2025.0 | 0.19 | 20 | 9.4 | 0.19 | 5 |
| LYM808 | 74613.5 | — | — | — | 1818.8 | 0.11 | 8 | 9.7 | L | 8 |
| LYM808 | 74615.1 | — | — | — | — | — | — | 9.6 | 0.30 | 6 |
| LYM808 | 74617.2 | — | — | — | — | — | — | 9.3 | 0.05 | 3 |
| LYM808 | 74617.3 | 204.9 | L | 28 | 2045.5 | L | 21 | 10.1 | L | 12 |
| LYM805 | 74546.1 | — | — | — | 1887.5 | 0.10 | 12 | 10.2 | 0.04 | 13 |
| LYM805 | 74547.2 | — | — | — | 2100.0 | 0.05 | 25 | 9.9 | 0.01 | 10 |
| LYM805 | 74548.1 | — | — | — | — | — | — | 9.4 | 0.01 | 5 |

TABLE 103-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. | Leaf Number Ave. | P-Val. | % Incr. |
|---|---|---|---|---|---|---|---|---|---|---|
| LYM805 | 74549.2 | 176.2 | 0.11 | 10 | 1808.3 | 0.24 | 7 | — | — | — |
| LYM751 | 74534.1 | 171.7 | 0.30 | 7 | — | — | — | — | — | — |
| LYM751 | 74536.4 | 172.1 | 0.21 | 7 | 1925.0 | 0.10 | 14 | 10.2 | L | 14 |
| LYM751 | 74539.2 | 182.4 | 0.04 | 14 | — | — | — | — | — | — |
| LYM751 | 74539.3 | — | — | — | — | — | — | 9.3 | 0.05 | 3 |
| LYM1005 | 74978.1 | 224.4 | 0.30 | 40 | — | — | — | 10.4 | 0.03 | 16 |
| LYM1005 | 74978.3 | 213.6 | L | 33 | 2534.8 | 0.26 | 50 | 10.4 | 0.07 | 15 |
| LYM1005 | 74979.1 | 191.2 | 0.17 | 19 | 1950.0 | 0.29 | 16 | — | — | — |
| LYM1005 | 74979.2 | 185.7 | 0.16 | 16 | 1985.7 | L | 18 | — | — | — |
| LYM1005 | 74982.4 | 218.6 | 0.30 | 36 | 2121.4 | 0.08 | 26 | 9.3 | 0.30 | 3 |
| CONT. | — | 160.2 | — | — | 1686.2 | — | — | 9.0 | — | — |
| LYM991 | 74207.2 | — | — | — | 4656.2 | 0.01 | 10 | — | — | — |
| LYM991 | 74208.2 | — | — | — | 4568.8 | 0.14 | 8 | — | — | — |
| LYM989 | 74222.3 | — | — | — | — | — | — | 10.4 | 0.05 | 6 |
| LYM989 | 74224.1 | — | — | — | 4375.0 | 0.12 | 3 | — | — | — |
| LYM957 | 74199.4 | — | — | — | 4531.2 | 0.10 | 7 | — | — | — |
| LYM952 | 74250.2 | — | — | — | 4518.8 | L | 7 | — | — | — |
| LYM952 | 74251.2 | — | — | — | — | — | — | 10.4 | 0.02 | 7 |
| LYM952 | 74251.4 | — | — | — | — | — | — | 10.2 | 0.11 | 4 |
| LYM949 | 73521.2 | — | — | — | 4562.5 | L | 8 | — | — | — |
| LYM949 | 73525.4 | 404.0 | 0.12 | 17 | 4549.1 | 0.20 | 8 | — | — | — |
| LYM911 | 73838.2 | — | — | — | — | — | — | 10.2 | 0.22 | 4 |
| LYM887 | 73827.1 | — | — | — | 4325.0 | 0.25 | 2 | — | — | — |
| LYM887 | 73830.3 | — | — | — | 4431.2 | 0.08 | 5 | — | — | — |
| LYM874 | 73584.2 | — | — | — | 4375.0 | 0.11 | 3 | — | — | — |
| LYM871 | 74166.1 | — | — | — | 4462.5 | 0.07 | 6 | — | — | — |
| LYM871 | 74167.2 | — | — | — | 4487.5 | 0.26 | 6 | — | — | — |
| LYM870 | 74424.3 | — | — | — | 4350.0 | 0.23 | 3 | — | — | — |
| LYM858 | 74406.1 | — | — | — | 4475.0 | 0.06 | 6 | — | — | — |
| LYM851 | 74393.2 | 372.5 | 0.30 | 8 | 4650.0 | L | 10 | 10.4 | 0.18 | 6 |
| LYM816 | 74332.2 | — | — | — | 4456.2 | 0.02 | 5 | — | — | — |
| LYM816 | 74334.2 | — | — | — | 4693.8 | L | 11 | — | — | — |
| LYM816 | 74335.1 | — | — | — | 4468.8 | 0.02 | 6 | 10.8 | 0.27 | 10 |
| LYM769 | 73599.1 | — | — | — | 4387.5 | 0.08 | 4 | — | — | — |
| LYM769 | 73600.2 | — | — | — | 4575.0 | 0.12 | 8 | — | — | — |
| LYM769 | 73600.4 | 425.0 | 0.17 | 24 | — | — | — | — | — | — |
| LYM769 | 73601.1 | — | — | — | 4600.0 | L | 9 | — | — | — |
| LYM758 | 74102.3 | — | — | — | 4369.6 | 0.19 | 3 | — | — | — |
| LYM1006 | 74258.3 | 370.6 | 0.30 | 8 | 4550.0 | 0.01 | 8 | — | — | — |
| LYM1006 | 74259.1 | — | — | — | 4543.8 | 0.22 | 7 | — | — | — |
| LYM1006 | 74262.3 | — | — | — | 4506.2 | 0.23 | 7 | — | — | — |
| LYM1006 | 74263.1 | — | — | — | 4587.5 | 0.15 | 8 | — | — | — |
| LYM1006 | 74263.4 | — | — | — | 4509.8 | 0.02 | 7 | — | — | — |
| CONT. | — | 343.9 | — | — | 4228.3 | — | — | 9.8 | — | — |

Table 103.
"CONT."—Control; "Ave."—Average; "% Incr." = % increment; "p-val."—p-value, L—p < 0.01.

TABLE 104

Genes showing improved plant performance at Normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LYM987 | 74156.1 | 55.2 | 0.27 | 23 | 6.9 | 0.30 | 21 | — | — | — |
| LYM987 | 74156.7 | 53.2 | 0.30 | 19 | — | — | — | — | — | — |
| LYM987 | 74157.2 | 54.9 | 0.13 | 23 | 6.9 | 0.16 | 20 | — | — | — |
| LYM984 | 74256.2 | 52.0 | 0.17 | 16 | 6.5 | 0.21 | 14 | 4.3 | 0.28 | 6 |
| LYM962 | 73611.2 | 50.1 | 0.19 | 12 | 6.3 | 0.25 | 10 | — | — | — |
| LYM962 | 73615.2 | 53.9 | L | 20 | 6.7 | L | 18 | 4.3 | 0.01 | 6 |
| LYM939 | 74150.5 | 60.0 | 0.13 | 34 | 7.5 | 0.15 | 31 | 4.6 | 0.20 | 14 |
| LYM939 | 74153.1 | 55.4 | L | 24 | 6.9 | L | 21 | 4.3 | L | 7 |
| LYM939 | 74154.1 | 58.3 | L | 30 | 7.3 | L | 28 | 4.5 | L | 11 |
| LYM939 | 74154.3 | 53.7 | 0.02 | 20 | 6.7 | 0.03 | 18 | 4.5 | 0.09 | 11 |
| LYM933 | 73810.4 | 59.2 | 0.02 | 32 | 7.4 | 0.03 | 30 | 4.5 | 0.20 | 12 |

TABLE 104-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM931 | 73844.1 | 49.6 | 0.08 | 11 | 6.2 | 0.12 | 9 | 4.2 | 0.25 | 4 |
| LYM931 | 73844.3 | 52.8 | 0.05 | 18 | 6.6 | 0.07 | 16 | 4.4 | 0.11 | 8 |
| LYM931 | 73847.1 | 52.3 | 0.02 | 17 | 6.5 | 0.02 | 15 | 4.3 | 0.04 | 5 |
| LYM884 | 73209.2 | 48.7 | 0.20 | 9 | 6.1 | 0.27 | 7 | — | — | — |
| LYM884 | 73210.2 | 49.8 | 0.10 | 11 | 6.2 | 0.14 | 9 | — | — | — |
| LYM884 | 73212.2 | 50.9 | 0.01 | 14 | 6.4 | 0.01 | 12 | 4.3 | 0.09 | 5 |
| LYM873 | 73712.2 | 51.4 | 0.20 | 15 | 6.4 | 0.25 | 13 | 4.3 | 0.30 | 6 |
| LYM873 | 73713.3 | 50.3 | 0.04 | 12 | 6.3 | 0.05 | 10 | 4.2 | 0.05 | 4 |
| LYM867 | 74417.4 | — | — | — | — | — | — | 4.4 | 0.15 | 9 |
| LYM867 | 74419.1 | — | — | — | — | — | — | 4.7 | 0.19 | 16 |
| LYM864 | 74409.1 | 48.9 | 0.06 | 9 | 6.1 | 0.07 | 7 | 4.3 | 0.26 | 5 |
| LYM864 | 74409.4 | 55.0 | 0.13 | 23 | 6.9 | 0.16 | 21 | 4.6 | 0.04 | 12 |
| LYM864 | 74412.4 | 48.5 | 0.24 | 8 | — | — | — | — | — | — |
| LYM844 | 73196.2 | — | — | — | — | — | — | 4.3 | 0.09 | 6 |
| LYM844 | 73197.2 | 47.8 | 0.18 | 7 | 6.0 | 0.26 | 5 | 4.2 | 0.10 | 3 |
| LYM828 | 73784.1 | 49.1 | 0.05 | 10 | 6.1 | 0.06 | 8 | 4.2 | 0.08 | 4 |
| LYM828 | 73785.1 | 55.7 | 0.03 | 24 | 7.0 | 0.05 | 22 | 4.4 | 0.03 | 8 |
| LYM828 | 73789.2 | 50.5 | 0.05 | 13 | 6.3 | 0.08 | 11 | 4.3 | 0.24 | 7 |
| LYM827 | 73430.1 | 55.7 | 0.02 | 24 | 7.0 | 0.04 | 22 | 4.4 | 0.10 | 9 |
| LYM827 | 73432.4 | 52.1 | L | 16 | 6.5 | L | 14 | 4.2 | 0.05 | 4 |
| LYM792 | 74172.1 | 56.6 | 0.29 | 26 | — | — | — | — | — | — |
| LYM792 | 74172.3 | — | — | — | — | — | — | 4.2 | 0.10 | 4 |
| LYM759 | 74057.4 | — | — | — | — | — | — | 4.2 | 0.20 | 3 |
| LYM759 | 74057.5 | 57.1 | L | 27 | 7.1 | L | 25 | 4.5 | L | 10 |
| LYM759 | 74058.3 | 59.1 | 0.13 | 32 | 7.4 | 0.15 | 30 | 4.6 | 0.13 | 14 |
| LYM1000 | 74327.2 | 51.7 | 0.30 | 15 | — | — | — | — | — | — |
| LYM1000 | 74328.4 | 48.3 | 0.10 | 8 | 6.0 | 0.12 | 6 | — | — | — |
| CONT. | — | 44.8 | — | — | 5.7 | — | — | 4.1 | — | — |
| LYM947 | 73297.4 | 76.6 | 0.28 | 25 | — | — | — | — | — | — |
| LYM940 | 73814.1 | 87.4 | L | 43 | 10.9 | L | 41 | 5.7 | L | 16 |
| LYM940 | 73815.2 | 76.0 | 0.01 | 24 | 9.5 | 0.01 | 22 | 5.4 | L | 12 |
| LYM940 | 73816.1 | 74.5 | 0.02 | 22 | 9.3 | 0.02 | 20 | 5.3 | 0.04 | 8 |
| LYM940 | 73817.1 | 66.8 | 0.30 | 9 | — | — | — | — | — | — |
| LYM923 | 73287.4 | 71.6 | 0.05 | 17 | 9.0 | 0.06 | 15 | 5.1 | 0.12 | 6 |
| LYM909 | 73832.1 | 69.1 | 0.13 | 13 | 8.6 | 0.16 | 11 | 5.3 | 0.07 | 8 |
| LYM909 | 73835.1 | 67.2 | 0.24 | 10 | 8.4 | 0.29 | 8 | — | — | — |
| LYM897 | 73737.2 | 70.3 | 0.08 | 15 | 8.8 | 0.09 | 13 | 5.2 | 0.21 | 7 |
| LYM897 | 73738.3 | 74.9 | 0.18 | 23 | 9.4 | 0.21 | 21 | 5.3 | 0.14 | 8 |
| LYM897 | 73741.3 | 74.8 | 0.05 | 22 | 9.3 | 0.06 | 20 | 5.2 | 0.17 | 7 |
| LYM885 | 73282.2 | 69.0 | 0.12 | 13 | 8.6 | 0.14 | 11 | — | — | — |
| LYM885 | 73283.1 | 70.2 | 0.30 | 15 | — | — | — | — | — | — |
| LYM869 | 73576.3 | 72.7 | 0.04 | 19 | 9.1 | 0.05 | 17 | 5.4 | 0.02 | 10 |
| LYM869 | 73579.2 | 79.1 | 0.06 | 29 | 9.9 | 0.07 | 27 | 5.5 | 0.01 | 12 |
| LYM869 | 73579.3 | 74.6 | 0.11 | 22 | 9.3 | 0.13 | 20 | — | — | — |
| LYM868 | 73568.1 | 77.4 | L | 27 | 9.7 | L | 25 | 5.4 | 0.02 | 10 |
| LYM868 | 73572.1 | 69.0 | 0.24 | 13 | 8.6 | 0.29 | 11 | — | — | — |
| LYM868 | 73573.2 | 80.9 | 0.14 | 32 | 10.1 | 0.16 | 30 | 5.4 | 0.11 | 12 |
| LYM866 | 73707.3 | 71.9 | 0.06 | 18 | 9.0 | 0.07 | 16 | 5.2 | 0.05 | 7 |
| LYM866 | 73709.2 | 70.4 | 0.19 | 15 | 8.8 | 0.23 | 13 | — | — | — |
| LYM849 | 73856.1 | 81.9 | 0.24 | 34 | 10.2 | 0.26 | 32 | 5.6 | 0.22 | 14 |
| LYM849 | 73858.2 | — | — | — | — | — | — | 5.2 | 0.16 | 7 |
| LYM849 | 73859.2 | 69.1 | 0.12 | 13 | 8.6 | 0.14 | 11 | 5.2 | 0.05 | 8 |
| LYM849 | 73861.2 | 69.6 | 0.27 | 14 | — | — | — | 5.1 | 0.30 | 5 |
| LYM835 | 73823.1 | 68.3 | 0.15 | 12 | 8.5 | 0.18 | 10 | — | — | — |
| LYM835 | 73825.3 | 86.0 | 0.11 | 41 | 10.8 | 0.12 | 39 | 5.6 | 0.10 | 16 |
| LYM806 | 73971.4 | 79.4 | L | 30 | 9.9 | L | 28 | 5.4 | 0.08 | 11 |
| LYM806 | 73975.2 | 72.9 | 0.06 | 19 | 9.1 | 0.07 | 17 | 5.3 | 0.08 | 8 |
| LYM797 | 73966.1 | 77.3 | 0.02 | 27 | 9.7 | 0.03 | 25 | 5.4 | L | 11 |
| LYM797 | 73968.2 | 72.0 | 0.08 | 18 | 9.0 | 0.10 | 16 | 5.4 | 0.02 | 10 |
| LYM784 | 74080.2 | 71.6 | 0.07 | 17 | 8.9 | 0.09 | 15 | 5.1 | 0.24 | 5 |
| LYM784 | 74081.1 | — | — | — | — | — | — | 5.2 | 0.06 | 7 |
| LYM784 | 74081.3 | 67.5 | 0.24 | 11 | 8.4 | 0.30 | 9 | — | — | — |
| LYM784 | 74083.3 | 73.3 | 0.22 | 20 | 9.2 | 0.25 | 18 | — | — | — |
| LYM781 | 73948.4 | 68.2 | 0.21 | 12 | 8.5 | 0.26 | 10 | — | — | — |
| LYM781 | 73949.1 | 90.0 | 0.09 | 47 | 11.3 | 0.11 | 45 | 5.8 | 0.06 | 19 |
| LYM781 | 73950.2 | 75.1 | 0.17 | 23 | 9.4 | 0.20 | 21 | 5.4 | 0.22 | 10 |
| LYM761 | 73995.3 | — | — | — | — | — | — | 5.1 | 0.19 | 4 |
| LYM761 | 73999.3 | 74.5 | 0.03 | 22 | 9.3 | 0.04 | 20 | 5.2 | 0.06 | 7 |
| LYM761 | 73999.5 | 74.5 | 0.04 | 22 | 9.3 | 0.05 | 20 | 5.4 | 0.11 | 11 |
| LYM758 | 74050.4 | 91.4 | 0.10 | 50 | 11.4 | 0.11 | 47 | 5.9 | 0.14 | 21 |
| LYM758 | 74104.1 | 72.0 | 0.22 | 18 | 9.0 | 0.25 | 16 | 5.1 | 0.27 | 5 |

TABLE 104-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM1008 | 73138.2 | 68.4 | 0.15 | 12 | 8.5 | 0.17 | 10 | 5.1 | 0.11 | 6 |
| CONT. | — | 61.1 | — | — | 7.8 | — | — | 4.9 | — | — |
| LYM981 | 75058.2 | — | — | — | 10.8 | 0.19 | 31 | 5.6 | L | 13 |
| LYM981 | 75060.3 | 88.5 | 0.14 | 34 | 11.1 | 0.14 | 34 | 5.8 | 0.10 | 16 |
| LYM981 | 75061.1 | 86.7 | L | 31 | 10.8 | L | 31 | 5.7 | 0.06 | 15 |
| LYM981 | 75062.6 | 80.5 | 0.01 | 22 | 10.1 | 0.01 | 22 | 5.5 | L | 10 |
| LYM959 | 74666.2 | 82.4 | 0.08 | 25 | 11.0 | L | 33 | 5.8 | 0.01 | 17 |
| LYM959 | 74669.2 | 75.6 | 0.07 | 15 | 9.5 | 0.07 | 15 | 5.3 | 0.02 | 7 |
| LYM959 | 74669.4 | 80.3 | 0.17 | 22 | 10.0 | 0.17 | 22 | 5.5 | 0.13 | 10 |
| LYM950 | 75083.1 | 75.7 | 0.06 | 15 | 9.5 | 0.06 | 15 | 5.1 | 0.22 | 3 |
| LYM926 | 75576.3 | 76.8 | 0.12 | 16 | 9.6 | 0.12 | 16 | 5.3 | 0.07 | 6 |
| LYM926 | 75577.2 | 74.9 | 0.07 | 13 | 9.4 | 0.07 | 13 | 5.2 | 0.07 | 5 |
| LYM801 | 75556.2 | 79.1 | 0.02 | 20 | 9.9 | 0.02 | 20 | 5.3 | 0.07 | 6 |
| LYM801 | 75557.6 | 86.9 | L | 32 | 10.9 | L | 32 | 6.0 | L | 21 |
| LYM801 | 75559.1 | 77.8 | 0.28 | 18 | 9.7 | 0.28 | 18 | — | — | — |
| LYM789 | 74607.1 | 73.8 | 0.14 | 12 | 9.2 | 0.14 | 12 | 5.2 | 0.28 | 4 |
| LYM789 | 74608.4 | 86.9 | 0.14 | 32 | 10.9 | 0.14 | 32 | 5.6 | 0.20 | 13 |
| LYM788 | 75543.2 | 87.2 | 0.03 | 32 | 10.9 | 0.03 | 32 | 5.6 | 0.16 | 13 |
| LYM788 | 75544.1 | 79.0 | 0.03 | 20 | 9.9 | 0.03 | 20 | 5.4 | 0.04 | 8 |
| LYM788 | 75546.2 | 83.0 | 0.04 | 26 | 10.4 | 0.04 | 26 | 5.5 | 0.02 | 11 |
| CONT. | — | 66.0 | — | — | 8.3 | — | — | 5.0 | — | — |
| LYM981 | 75060.3 | 73.9 | L | 25 | 9.2 | L | 25 | 5.3 | 0.16 | 14 |
| LYM953 | 74486.3 | 69.9 | L | 19 | 8.7 | L | 19 | 5.1 | L | 10 |
| LYM953 | 74487.1 | 60.5 | 0.21 | 3 | 7.6 | 0.21 | 3 | — | — | — |
| LYM911 | 73838.2 | — | — | — | — | — | — | 4.8 | 0.08 | 3 |
| LYM908 | 74636.4 | — | — | — | — | — | — | 5.2 | 0.17 | 13 |
| LYM907 | 74706.2 | 69.2 | 0.09 | 17 | 8.7 | 0.09 | 17 | 5.1 | 0.10 | 9 |
| LYM907 | 74707.4 | 65.1 | L | 10 | 8.1 | L | 10 | 4.9 | 0.27 | 6 |
| LYM895 | 74632.2 | 63.6 | 0.29 | 8 | 7.9 | 0.29 | 8 | — | — | — |
| LYM872 | 75054.3 | 61.7 | 0.04 | 5 | 7.7 | 0.04 | 5 | — | — | — |
| LYM831 | 74992.4 | — | — | — | — | — | — | 4.9 | L | 5 |
| LYM809 | 74983.3 | 62.5 | 0.16 | 6 | 7.8 | 0.16 | 6 | — | — | — |
| LYM809 | 74987.2 | 71.1 | 0.11 | 21 | 8.9 | 0.11 | 21 | 5.1 | L | 10 |
| LYM809 | 74987.3 | — | — | — | — | — | — | 5.0 | 0.26 | 8 |
| LYM789 | 74608.5 | 82.2 | 0.08 | 40 | 10.3 | 0.08 | 40 | 5.4 | 0.09 | 16 |
| CONT. | — | 58.9 | — | — | 7.4 | — | — | 4.6 | — | — |
| LYM996 | 73563.3 | 22.6 | 0.14 | 11 | 2.8 | 0.14 | 11 | 3.1 | 0.10 | 9 |
| LYM996 | 73566.3 | 23.0 | 0.14 | 13 | 2.9 | 0.14 | 13 | 3.0 | 0.11 | 7 |
| LYM996 | 73567.1 | 24.7 | 0.03 | 21 | 3.1 | 0.03 | 21 | 3.2 | 0.03 | 10 |
| LYM986 | 73532.1 | 23.7 | 0.04 | 16 | 3.0 | 0.04 | 16 | 3.1 | 0.10 | 8 |
| LYM986 | 73533.2 | 25.1 | 0.14 | 23 | 3.1 | 0.14 | 23 | 3.2 | 0.20 | 11 |
| LYM986 | 73537.1 | — | — | — | — | — | — | 3.0 | 0.20 | 6 |
| LYM963 | 74024.1 | 23.4 | 0.06 | 15 | 2.9 | 0.06 | 15 | 3.0 | 0.15 | 6 |
| LYM963 | 74025.4 | 26.5 | 0.17 | 30 | 3.3 | 0.17 | 30 | 3.2 | 0.14 | 13 |
| LYM963 | 74026.2 | 25.9 | L | 27 | 3.2 | L | 27 | 3.2 | 0.02 | 12 |
| LYM916 | 73238.1 | 24.6 | 0.02 | 21 | 3.1 | 0.02 | 21 | 3.1 | 0.03 | 10 |
| LYM916 | 73240.2 | 24.5 | 0.10 | 20 | 3.1 | 0.10 | 20 | 3.1 | 0.03 | 9 |
| LYM905 | 73802.5 | 24.3 | 0.08 | 19 | 3.0 | 0.08 | 19 | 3.2 | 0.15 | 12 |
| LYM892 | 73724.1 | 22.4 | 0.17 | 10 | 2.8 | 0.17 | 10 | 3.0 | 0.12 | 6 |
| LYM892 | 73724.4 | 26.3 | 0.18 | 29 | 3.3 | 0.18 | 29 | 3.3 | 0.05 | 14 |
| LYM892 | 73727.4 | — | — | — | — | — | — | 3.0 | 0.21 | 5 |
| LYM889 | 73790.1 | 22.9 | 0.11 | 12 | 2.9 | 0.11 | 12 | 3.1 | 0.10 | 7 |
| LYM889 | 73793.2 | 22.7 | 0.12 | 11 | 2.8 | 0.12 | 11 | 3.0 | 0.19 | 6 |
| LYM889 | 73794.2 | 24.2 | 0.03 | 18 | 3.0 | 0.03 | 18 | 3.1 | 0.07 | 8 |
| LYM881 | 73592.1 | 25.0 | 0.12 | 23 | 3.1 | 0.12 | 23 | 3.2 | 0.02 | 12 |
| LYM881 | 73592.2 | 23.5 | 0.13 | 15 | 2.9 | 0.13 | 15 | 3.2 | 0.02 | 11 |
| LYM881 | 73593.3 | — | — | — | — | — | — | 3.1 | 0.27 | 10 |
| LYM881 | 73596.1 | — | — | — | — | — | — | 3.0 | 0.19 | 5 |
| LYM881 | 73597.2 | 25.5 | L | 25 | 3.2 | L | 25 | 3.2 | 0.01 | 12 |
| LYM837 | 73665.4 | 23.7 | 0.04 | 16 | 3.0 | 0.04 | 16 | 3.1 | 0.09 | 8 |
| LYM837 | 73668.3 | — | — | — | — | — | — | 3.0 | 0.18 | 6 |
| LYM828 | 73784.1 | 23.2 | 0.22 | 14 | 2.9 | 0.22 | 14 | 3.1 | 0.16 | 9 |
| LYM828 | 73785.1 | 23.5 | 0.14 | 15 | 2.9 | 0.14 | 15 | 3.2 | 0.13 | 12 |
| LYM821 | 73988.1 | 22.9 | 0.22 | 12 | 2.9 | 0.22 | 12 | — | — | — |
| LYM821 | 73991.4 | 24.2 | 0.02 | 19 | 3.0 | 0.02 | 19 | 3.2 | 0.02 | 12 |
| LYM821 | 73992.1 | 25.4 | 0.13 | 24 | 3.2 | 0.13 | 24 | 3.2 | 0.14 | 13 |
| LYM821 | 73992.2 | 24.9 | 0.13 | 22 | 3.1 | 0.13 | 22 | 3.2 | 0.12 | 11 |
| LYM821 | 73993.3 | 23.1 | 0.08 | 13 | 2.9 | 0.08 | 13 | 3.1 | 0.07 | 8 |
| LYM815 | 74086.1 | 23.1 | 0.19 | 13 | 2.9 | 0.19 | 13 | 3.0 | 0.10 | 7 |
| LYM815 | 74087.2 | 25.7 | L | 26 | 3.2 | L | 26 | 3.3 | 0.06 | 15 |
| LYM815 | 74087.3 | 24.8 | 0.17 | 22 | 3.1 | 0.17 | 22 | 3.2 | 0.03 | 10 |

TABLE 104-continued

Genes showing improved plant performance at Normal growth conditions under regulation of At6669 promoter

| Gene Name | Event # | Plot Coverage [cm²] | | | Rosette Area [cm²] | | | Rosette Diameter [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM807 | 73976.2 | 22.0 | 0.26 | 8 | 2.8 | 0.26 | 8 | 3.0 | 0.26 | 4 |
| LYM807 | 73978.2 | 30.6 | L | 50 | 3.8 | L | 50 | 3.5 | 0.01 | 24 |
| LYM807 | 73980.1 | — | — | — | — | — | — | 3.0 | 0.28 | 5 |
| LYM807 | 73980.3 | 26.5 | 0.05 | 30 | 3.3 | 0.05 | 30 | 3.3 | 0.09 | 16 |
| LYM795 | 73958.3 | 25.7 | 0.02 | 26 | 3.2 | 0.02 | 26 | 3.2 | L | 13 |
| LYM795 | 73960.2 | 25.8 | 0.20 | 27 | 3.2 | 0.20 | 27 | 3.2 | 0.24 | 13 |
| LYM795 | 73960.4 | — | — | — | — | — | — | 3.0 | 0.30 | 6 |
| LYM795 | 73961.3 | 25.6 | 0.02 | 26 | 3.2 | 0.02 | 26 | 3.2 | 0.09 | 10 |
| LYM795 | 73963.1 | 23.9 | 0.14 | 17 | 3.0 | 0.14 | 17 | 3.2 | 0.02 | 11 |
| LYM779 | 73189.2 | — | — | — | — | — | — | 3.1 | 0.08 | 8 |
| LYM779 | 73190.2 | 22.1 | 0.23 | 8 | 2.8 | 0.23 | 8 | 3.0 | 0.14 | 6 |
| LYM779 | 73192.2 | 24.2 | 0.11 | 19 | 3.0 | 0.11 | 19 | 3.1 | 0.23 | 9 |
| LYM779 | 73193.2 | 23.5 | 0.14 | 15 | 2.9 | 0.14 | 15 | 3.2 | 0.14 | 12 |
| LYM766 | 74062.1 | 24.4 | 0.12 | 20 | 3.1 | 0.12 | 20 | 3.2 | 0.13 | 12 |
| LYM766 | 74064.1 | 22.1 | 0.22 | 9 | 2.8 | 0.22 | 9 | 3.0 | 0.29 | 4 |
| LYM766 | 74065.4 | 22.5 | 0.24 | 10 | 2.8 | 0.24 | 10 | 3.1 | 0.14 | 7 |
| LYM763 | 73457.2 | 26.1 | 0.21 | 28 | 3.3 | 0.21 | 28 | 3.3 | 0.10 | 16 |
| LYM763 | 73457.3 | 26.0 | L | 28 | 3.3 | L | 28 | 3.3 | L | 15 |
| LYM763 | 73458.2 | 24.9 | 0.24 | 22 | 3.1 | 0.24 | 22 | 3.3 | 0.18 | 14 |
| LYM763 | 73458.5 | 27.4 | L | 34 | 3.4 | L | 34 | 3.4 | L | 18 |
| LYM763 | 73459.1 | 23.8 | 0.23 | 17 | 3.0 | 0.23 | 17 | — | — | — |
| LYM1009 | 73141.2 | 27.0 | 0.11 | 32 | 3.4 | 0.11 | 32 | 3.4 | 0.09 | 18 |
| LYM1009 | 73141.6 | 22.2 | 0.21 | 9 | 2.8 | 0.21 | 9 | — | — | — |
| CONT. | — | 20.4 | — | — | 2.5 | — | — | 2.9 | — | — |
| LYM999 | 75018.1 | 49.0 | 0.04 | 17 | 6.1 | 0.04 | 17 | 4.3 | 0.29 | 8 |
| LYM999 | 75018.2 | 50.5 | L | 21 | 6.3 | L | 21 | 4.3 | 0.06 | 8 |
| LYM999 | 75019.4 | 48.0 | 0.08 | 15 | 6.0 | 0.08 | 15 | — | — | — |
| LYM999 | 75022.1 | 56.0 | 0.03 | 34 | 7.0 | 0.03 | 34 | 4.5 | L | 14 |
| LYM992 | 74648.1 | 45.3 | 0.19 | 8 | 5.7 | 0.19 | 8 | — | — | — |
| LYM992 | 74649.4 | 54.6 | 0.10 | 31 | 6.8 | 0.10 | 31 | — | — | — |
| LYM992 | 74653.4 | 49.9 | 0.16 | 19 | 6.2 | 0.16 | 19 | 4.4 | 0.11 | 10 |
| LYM990 | 74643.2 | 51.7 | 0.07 | 24 | 6.5 | 0.07 | 24 | 4.4 | 0.05 | 10 |
| LYM990 | 74643.3 | 52.1 | L | 25 | 6.5 | L | 25 | 4.4 | L | 12 |
| LYM990 | 74644.1 | 54.5 | L | 31 | 6.8 | L | 31 | 4.6 | L | 16 |
| LYM990 | 74644.2 | 59.9 | L | 43 | 7.5 | L | 43 | 4.8 | L | 22 |
| LYM982 | 74709.4 | 59.9 | L | 43 | 7.5 | L | 43 | 4.7 | L | 17 |
| LYM982 | 74710.3 | 48.2 | 0.04 | 15 | 6.0 | 0.04 | 15 | 4.3 | 0.02 | 8 |
| LYM959 | 74666.1 | — | — | — | — | — | — | 4.1 | 0.27 | 3 |
| LYM959 | 74666.2 | — | — | — | 6.3 | 0.01 | 21 | 4.3 | L | 9 |
| LYM943 | 74698.1 | — | — | — | — | — | — | 4.1 | 0.26 | 4 |
| LYM943 | 74699.4 | 45.6 | 0.30 | 9 | 5.7 | 0.30 | 9 | — | — | — |
| LYM943 | 74701.1 | 50.0 | 0.01 | 20 | 6.3 | 0.01 | 20 | 4.4 | L | 12 |
| LYM922 | 75075.1 | 53.8 | L | 29 | 6.7 | L | 29 | 4.5 | L | 13 |
| LYM922 | 75080.2 | — | — | — | 6.3 | 0.04 | 21 | 4.3 | 0.02 | 8 |
| LYM915 | 74956.1 | 55.9 | L | 34 | 7.0 | L | 34 | 4.6 | L | 15 |
| LYM915 | 74958.2 | 46.4 | 0.15 | 11 | 5.8 | 0.15 | 11 | 4.1 | 0.26 | 4 |
| LYM915 | 74958.4 | 61.9 | L | 48 | 7.7 | L | 48 | 4.8 | 0.09 | 21 |
| LYM915 | 74959.3 | 52.2 | 0.09 | 25 | 6.5 | 0.09 | 25 | 4.4 | 0.10 | 12 |
| LYM904 | 74018.1 | 46.3 | 0.15 | 11 | 5.8 | 0.15 | 11 | 4.2 | 0.15 | 6 |
| LYM904 | 74021.1 | 53.0 | L | 27 | 6.6 | L | 27 | 4.6 | L | 15 |
| LYM847 | 75052.1 | 52.7 | L | 26 | 6.6 | L | 26 | 4.6 | 0.02 | 16 |
| LYM847 | 75052.2 | 60.9 | L | 46 | 7.6 | L | 46 | 4.7 | 0.01 | 20 |
| LYM847 | 75052.4 | 45.6 | 0.30 | 9 | 5.7 | 0.30 | 9 | — | — | — |
| LYM842 | 74012.4 | — | — | — | — | — | — | 4.2 | 0.16 | 7 |
| LYM839 | 74996.3 | 57.0 | 0.24 | 36 | 7.1 | 0.24 | 36 | — | — | — |
| LYM839 | 74996.5 | 50.4 | 0.11 | 21 | 6.3 | 0.11 | 21 | 4.3 | 0.08 | 8 |
| LYM826 | 74620.2 | — | — | — | — | — | — | 4.1 | 0.30 | 3 |
| LYM826 | 74620.3 | 49.6 | 0.20 | 19 | 6.2 | 0.20 | 19 | 4.3 | 0.21 | 10 |
| LYM826 | 74623.2 | 51.8 | L | 24 | 6.5 | L | 24 | 4.4 | L | 11 |
| LYM808 | 74612.1 | 49.5 | 0.20 | 18 | 6.2 | 0.20 | 18 | 4.3 | 0.15 | 10 |
| LYM808 | 74613.5 | 48.9 | 0.26 | 17 | 6.1 | 0.26 | 17 | — | — | — |
| LYM808 | 74617.3 | 53.5 | L | 28 | 6.7 | L | 28 | 4.3 | L | 9 |
| LYM805 | 74546.1 | 50.1 | 0.11 | 20 | 6.3 | 0.11 | 20 | 4.3 | 0.02 | 9 |
| LYM805 | 74547.2 | 63.6 | L | 52 | 8.0 | L | 52 | 4.8 | L | 22 |
| LYM805 | 74548.1 | 45.2 | 0.29 | 8 | 5.7 | 0.29 | 8 | 4.1 | 0.22 | 4 |
| LYM805 | 74550.2 | 49.6 | 0.02 | 19 | 6.2 | 0.02 | 19 | 4.2 | 0.06 | 6 |
| LYM751 | 74536.4 | 51.8 | 0.13 | 24 | 6.5 | 0.13 | 24 | 4.4 | 0.02 | 10 |
| LYM1005 | 74978.1 | 66.3 | L | 59 | 8.3 | L | 59 | 4.9 | L | 24 |
| LYM1005 | 74978.3 | 67.7 | 0.18 | 62 | 8.5 | 0.18 | 62 | 5.0 | 0.17 | 26 |

TABLE 104-continued

Genes showing improved plant performance at Normal growth conditions under regulation of At6669 promoter

| Gene Name | Event # | Plot Coverage [cm²] Ave. | P-Val. | % Incr. | Rosette Area [cm²] Ave. | P-Val. | % Incr. | Rosette Diameter [cm] Ave. | P-Val. | % Incr. |
|---|---|---|---|---|---|---|---|---|---|---|
| LYM1005 | 74979.1 | 52.5 | 0.19 | 26 | 6.6 | 0.19 | 26 | 4.5 | 0.11 | 14 |
| LYM1005 | 74979.2 | 52.2 | 0.02 | 25 | 6.5 | 0.02 | 25 | 4.5 | 0.08 | 13 |
| CONT. | — | 41.8 | — | — | 5.2 | — | — | 4.0 | — | — |
| LYM991 | 74205.4 | 40.4 | 0.26 | 12 | — | — | — | — | — | — |
| LYM991 | 74207.2 | 45.7 | 0.17 | 26 | 5.7 | 0.23 | 22 | 4.1 | 0.11 | 11 |
| LYM991 | 74208.2 | 40.3 | 0.12 | 11 | 5.0 | 0.17 | 7 | — | — | — |
| LYM991 | 74208.3 | 39.5 | 0.19 | 9 | 4.9 | 0.28 | 5 | — | — | — |
| LYM989 | 74222.3 | 44.0 | 0.01 | 22 | 5.5 | L | 17 | 3.9 | 0.02 | 7 |
| LYM989 | 74224.1 | 43.9 | 0.01 | 21 | 5.5 | 0.01 | 17 | 3.9 | 0.05 | 8 |
| LYM957 | 74199.4 | 40.6 | 0.09 | 12 | 5.1 | 0.11 | 8 | 3.8 | 0.10 | 4 |
| LYM957 | 74200.3 | 39.9 | 0.15 | 10 | 5.0 | 0.20 | 6 | — | — | — |
| LYM957 | 74203.6 | — | — | — | 6.4 | 0.24 | 37 | 4.3 | 0.11 | 17 |
| LYM952 | 74250.2 | 50.0 | L | 38 | 6.3 | L | 33 | 4.1 | L | 13 |
| LYM952 | 74250.3 | 43.9 | 0.26 | 21 | — | — | — | 3.9 | 0.26 | 8 |
| LYM952 | 74251.2 | 44.0 | 0.01 | 21 | 5.5 | 0.01 | 17 | 3.9 | 0.19 | 7 |
| LYM952 | 74251.4 | 47.8 | 0.04 | 32 | 6.0 | 0.07 | 27 | 4.2 | 0.07 | 15 |
| LYM949 | 73521.2 | 44.9 | L | 24 | 5.6 | L | 20 | 4.0 | L | 9 |
| LYM949 | 73522.1 | 41.9 | 0.05 | 16 | 5.2 | 0.05 | 12 | 3.8 | 0.06 | 5 |
| LYM949 | 73522.3 | 40.2 | 0.15 | 11 | 5.0 | 0.22 | 7 | — | — | — |
| LYM911 | 73838.2 | 45.7 | 0.20 | 26 | 5.7 | 0.26 | 22 | 4.0 | 0.21 | 10 |
| LYM911 | 73838.3 | 39.7 | 0.28 | 10 | — | — | — | — | — | — |
| LYM874 | 73582.1 | 41.8 | 0.04 | 15 | 5.2 | 0.04 | 11 | 3.9 | 0.03 | 6 |
| LYM874 | 73584.2 | 42.2 | 0.03 | 17 | 5.3 | 0.03 | 13 | 3.9 | 0.14 | 5 |
| LYM874 | 73585.1 | 54.4 | 0.05 | 50 | 6.8 | 0.08 | 45 | 4.4 | 0.05 | 21 |
| LYM871 | 74166.1 | 43.5 | 0.13 | 20 | 5.4 | 0.20 | 16 | 4.0 | L | 9 |
| LYM871 | 74167.2 | 46.6 | L | 29 | 5.8 | L | 24 | 4.2 | 0.01 | 14 |
| LYM870 | 74420.1 | 41.8 | 0.05 | 15 | 5.2 | 0.06 | 11 | 3.8 | 0.09 | 4 |
| LYM870 | 74420.2 | 39.6 | 0.29 | 9 | — | — | — | 3.8 | 0.27 | 3 |
| LYM870 | 74424.3 | 44.0 | 0.01 | 22 | 5.5 | L | 17 | 3.9 | L | 8 |
| LYM858 | 74406.1 | 43.5 | 0.12 | 20 | 5.4 | 0.18 | 16 | 4.0 | 0.27 | 8 |
| LYM853 | 73700.4 | 43.4 | 0.19 | 20 | 5.4 | 0.26 | 16 | 4.0 | 0.07 | 9 |
| LYM851 | 74392.1 | 45.6 | 0.06 | 26 | 5.7 | 0.10 | 22 | 3.9 | 0.22 | 7 |
| LYM851 | 74393.2 | 50.7 | L | 40 | 6.3 | 0.01 | 35 | 4.2 | 0.14 | 16 |
| LYM816 | 74332.2 | 41.1 | 0.21 | 14 | — | — | — | — | — | — |
| LYM816 | 74334.2 | 44.9 | 0.07 | 24 | 5.6 | 0.11 | 20 | 4.0 | 0.17 | 10 |
| LYM816 | 74335.1 | 50.2 | L | 39 | 6.3 | L | 34 | 4.2 | L | 15 |
| LYM769 | 73599.1 | 42.6 | 0.10 | 18 | 5.3 | 0.16 | 14 | 3.9 | 0.02 | 7 |
| LYM769 | 73600.2 | 53.0 | 0.14 | 46 | 6.6 | 0.17 | 41 | 4.4 | 0.12 | 20 |
| LYM769 | 73600.4 | 47.0 | L | 30 | 5.9 | L | 25 | 4.1 | 0.02 | 13 |
| LYM769 | 73601.1 | 44.4 | 0.01 | 23 | 5.6 | L | 18 | 4.0 | L | 10 |
| LYM758 | 74050.4 | 45.5 | 0.01 | 26 | 5.7 | 0.02 | 21 | 4.1 | 0.07 | 13 |
| LYM758 | 74102.3 | 39.4 | 0.20 | 9 | — | — | — | — | — | — |
| LYM758 | 74104.4 | 43.0 | 0.06 | 19 | 5.4 | 0.10 | 15 | 4.0 | L | 8 |
| LYM1006 | 74258.3 | 43.1 | 0.10 | 19 | 5.4 | 0.16 | 15 | 3.9 | 0.29 | 6 |
| LYM1006 | 74259.1 | 45.5 | 0.17 | 26 | 5.7 | 0.22 | 21 | 4.1 | 0.03 | 11 |
| LYM1006 | 74262.3 | 42.2 | 0.06 | 17 | 5.3 | 0.09 | 13 | 3.8 | 0.14 | 4 |
| LYM1006 | 74263.1 | — | — | — | — | — | — | 3.9 | 0.26 | 6 |
| LYM1006 | 74263.4 | 42.9 | 0.03 | 19 | 5.4 | 0.03 | 14 | 3.9 | 0.02 | 6 |
| CONT. | — | 36.2 | — | — | 4.7 | — | — | 3.7 | — | — |

Table 104.
"CONT."—Control; "Ave."—Average; "% Incr." = % increment; "p-val."—p-value, L—p < 0.01.

TABLE 105

Genes showing improved plant performance at Normal growth conditions under regulation of At6669 promoter

| Gene Name | Event # | RGR Of Leaf Number Ave. | P-Val. | % Incr. | RGR Of Plot Coverage Ave. | P-Val. | % Incr. | RGR Of Rosette Diameter Ave. | P-Val. | % Incr. |
|---|---|---|---|---|---|---|---|---|---|---|
| LYM987 | 74156.1 | — | — | — | 6.7 | 0.11 | 24 | — | — | — |
| LYM987 | 74156.7 | — | — | — | 6.5 | 0.20 | 18 | — | — | — |
| LYM987 | 74157.2 | — | — | — | 6.6 | 0.14 | 21 | — | — | — |
| LYM984 | 74256.2 | — | — | — | 6.3 | 0.25 | 16 | — | — | — |
| LYM962 | 73615.2 | 0.8 | 0.08 | 16 | 6.4 | 0.23 | 17 | — | — | — |

TABLE 105-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM939 | 74150.5 | — | — | — | 7.2 | 0.03 | 33 | 0.4 | 0.18 | 11 |
| LYM939 | 74153.1 | 0.7 | 0.25 | 10 | 6.7 | 0.11 | 23 | — | — | — |
| LYM939 | 74154.1 | — | — | — | 7.1 | 0.04 | 30 | 0.4 | 0.23 | 10 |
| LYM939 | 74154.3 | — | — | — | 6.5 | 0.15 | 20 | 0.4 | 0.29 | 9 |
| LYM933 | 73810.2 | 0.7 | 0.23 | 11 | — | — | — | — | — | — |
| LYM933 | 73810.4 | 0.7 | 0.28 | 10 | 7.1 | 0.04 | 31 | 0.4 | 0.28 | 9 |
| LYM933 | 73812.5 | — | — | — | 6.3 | 0.26 | 16 | — | — | — |
| LYM931 | 73844.3 | — | — | — | 6.4 | 0.23 | 17 | — | — | — |
| LYM931 | 73847.1 | — | — | — | 6.4 | 0.21 | 18 | — | — | — |
| LYM884 | 73209.2 | 0.7 | 0.14 | 14 | — | — | — | 0.4 | 0.29 | 9 |
| LYM873 | 73716.1 | — | — | — | 6.4 | 0.24 | 17 | — | — | — |
| LYM867 | 74417.4 | 0.8 | 0.06 | 19 | — | — | — | — | — | — |
| LYM867 | 74419.1 | — | — | — | — | — | — | 0.4 | 0.03 | 20 |
| LYM867 | 74419.2 | 0.7 | 0.12 | 14 | — | — | — | — | — | — |
| LYM864 | 74409.1 | 0.7 | 0.29 | 10 | — | — | — | — | — | — |
| LYM864 | 74409.4 | — | — | — | 6.6 | 0.13 | 22 | 0.4 | 0.17 | 11 |
| LYM864 | 74412.2 | — | — | — | 6.4 | 0.22 | 18 | — | — | — |
| LYM864 | 74412.4 | 0.7 | 0.21 | 13 | — | — | — | — | — | — |
| LYM844 | 73196.2 | — | — | — | — | — | — | 0.4 | 0.28 | 9 |
| LYM844 | 73197.3 | 0.7 | 0.24 | 11 | — | — | — | — | — | — |
| LYM828 | 73784.2 | 0.8 | 0.13 | 15 | — | — | — | — | — | — |
| LYM828 | 73785.1 | 0.7 | 0.15 | 12 | 6.8 | 0.08 | 25 | — | — | — |
| LYM828 | 73789.2 | 0.7 | 0.27 | 10 | — | — | — | — | — | — |
| LYM827 | 73430.1 | — | — | — | 6.8 | 0.08 | 24 | — | — | — |
| LYM827 | 73432.4 | — | — | — | 6.3 | 0.23 | 16 | — | — | — |
| LYM792 | 74170.1 | 0.7 | 0.24 | 11 | — | — | — | — | — | — |
| LYM792 | 74172.1 | — | — | — | 6.9 | 0.07 | 27 | — | — | — |
| LYM759 | 74057.5 | — | — | — | 6.8 | 0.07 | 26 | — | — | — |
| LYM759 | 74058.3 | — | — | — | 7.2 | 0.03 | 33 | 0.4 | 0.07 | 16 |
| LYM1000 | 74327.2 | — | — | — | 6.3 | 0.28 | 15 | — | — | — |
| LYM1000 | 74329.1 | 0.7 | 0.19 | 14 | — | — | — | — | — | — |
| CONT. | — | 0.7 | — | — | 5.4 | — | — | 0.3 | — | — |
| LYM947 | 73297.4 | — | — | — | 8.7 | 0.18 | 25 | — | — | — |
| LYM947 | 73300.1 | 0.8 | 0.18 | 22 | — | — | — | — | — | — |
| LYM940 | 73814.1 | — | — | — | 9.9 | 0.03 | 42 | 0.4 | 0.27 | 14 |
| LYM940 | 73815.2 | 0.8 | 0.18 | 20 | 8.7 | 0.17 | 25 | 0.4 | 0.23 | 15 |
| LYM940 | 73816.1 | — | — | — | 8.5 | 0.23 | 22 | — | — | — |
| LYM940 | 73817.1 | 0.8 | 0.24 | 19 | — | — | — | — | — | — |
| LYM923 | 73287.1 | 0.8 | 0.21 | 20 | — | — | — | — | — | — |
| LYM909 | 73836.3 | 0.9 | 0.02 | 37 | — | — | — | — | — | — |
| LYM897 | 73738.3 | — | — | — | 8.8 | 0.15 | 27 | — | — | — |
| LYM897 | 73741.3 | — | — | — | 8.4 | 0.27 | 20 | — | — | — |
| LYM885 | 73282.2 | 0.7 | 0.29 | 16 | — | — | — | — | — | — |
| LYM869 | 73576.3 | — | — | — | 8.4 | 0.26 | 20 | — | — | — |
| LYM869 | 73579.2 | 0.7 | 0.26 | 17 | 9.2 | 0.09 | 32 | — | — | — |
| LYM869 | 73579.3 | — | — | — | 8.7 | 0.16 | 26 | — | — | — |
| LYM868 | 73568.1 | — | — | — | 8.7 | 0.17 | 25 | — | — | — |
| LYM868 | 73573.2 | 0.8 | 0.20 | 19 | 9.3 | 0.08 | 33 | — | — | — |
| LYM849 | 73856.1 | — | — | — | 9.6 | 0.06 | 38 | 0.4 | 0.27 | 15 |
| LYM849 | 73858.2 | 0.7 | 0.27 | 16 | — | — | — | — | — | — |
| LYM835 | 73823.1 | 0.7 | 0.24 | 17 | — | — | — | — | — | — |
| LYM835 | 73825.3 | — | — | — | 9.8 | 0.03 | 41 | — | — | — |
| LYM806 | 73971.4 | — | — | — | 9.0 | 0.10 | 30 | — | — | — |
| LYM806 | 73975.2 | — | — | — | 8.4 | 0.25 | 20 | — | — | — |
| LYM797 | 73966.1 | 0.8 | 0.08 | 27 | 9.0 | 0.11 | 29 | — | — | — |
| LYM797 | 73966.3 | 0.7 | 0.29 | 17 | — | — | — | — | — | — |
| LYM797 | 73967.1 | 0.8 | 0.08 | 27 | — | — | — | — | — | — |
| LYM784 | 74083.3 | — | — | — | 8.5 | 0.24 | 21 | — | — | — |
| LYM781 | 73949.1 | — | — | — | 10.1 | 0.02 | 45 | 0.4 | 0.29 | 13 |
| LYM781 | 73950.2 | 0.8 | 0.15 | 24 | 8.8 | 0.15 | 26 | — | — | — |
| LYM761 | 73999.3 | — | — | — | 8.5 | 0.22 | 22 | — | — | — |
| LYM761 | 73999.5 | 0.7 | 0.29 | 16 | 8.4 | 0.26 | 20 | — | — | — |
| LYM758 | 74050.4 | — | — | — | 10.6 | L | 53 | 0.5 | 0.13 | 20 |
| LYM758 | 74104.1 | — | — | — | 8.3 | 0.29 | 19 | — | — | — |
| LYM1008 | 73135.1 | 0.7 | 0.25 | 17 | — | — | — | — | — | — |
| CONT. | — | 0.6 | — | — | 7.0 | — | — | 0.4 | — | — |
| LYM981 | 75058.2 | — | — | — | 11.1 | 0.08 | 23 | 0.6 | 0.09 | 14 |
| LYM981 | 75060.3 | — | — | — | 11.9 | L | 34 | 0.6 | 0.03 | 19 |
| LYM981 | 75061.1 | — | — | — | 11.7 | L | 31 | 0.6 | 0.06 | 16 |
| LYM981 | 75062.6 | — | — | — | 10.8 | 0.06 | 22 | 0.6 | 0.10 | 13 |
| LYM959 | 74666.2 | — | — | — | 10.9 | 0.05 | 23 | 0.6 | 0.02 | 21 |

TABLE 105-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM959 | 74669.2 | — | — | — | 10.1 | 0.22 | 14 | 0.6 | 0.11 | 13 |
| LYM959 | 74669.4 | — | — | — | 10.8 | 0.06 | 22 | 0.5 | 0.14 | 12 |
| LYM950 | 75083.1 | 0.8 | 0.28 | 17 | 10.2 | 0.20 | 14 | — | — | — |
| LYM926 | 75576.3 | 0.8 | 0.23 | 19 | 10.3 | 0.16 | 16 | 0.5 | 0.20 | 10 |
| LYM926 | 75577.2 | — | — | — | 10.1 | 0.21 | 14 | — | — | — |
| LYM801 | 75556.2 | 0.8 | 0.21 | 19 | 10.6 | 0.09 | 20 | — | — | — |
| LYM801 | 75557.6 | — | — | — | 11.7 | L | 32 | 0.6 | L | 24 |
| LYM801 | 75559.1 | 0.8 | 0.14 | 24 | 10.5 | 0.12 | 18 | — | — | — |
| LYM789 | 74607.1 | 0.8 | 0.15 | 23 | 9.9 | 0.29 | 12 | — | — | — |
| LYM789 | 74608.2 | 0.8 | 0.24 | 17 | — | — | — | — | — | — |
| LYM789 | 74608.4 | 0.9 | 0.05 | 32 | 11.7 | 0.01 | 32 | 0.6 | 0.12 | 13 |
| LYM789 | 74611.4 | 0.8 | 0.15 | 22 | — | — | — | — | — | — |
| LYM788 | 75543.2 | — | — | — | 11.8 | L | 33 | 0.6 | 0.12 | 13 |
| LYM788 | 75544.1 | — | — | — | 10.6 | 0.09 | 19 | 0.5 | 0.19 | 11 |
| LYM788 | 75546.2 | 0.8 | 0.23 | 20 | 11.2 | 0.03 | 26 | 0.6 | 0.07 | 15 |
| CONT. | — | 0.7 | — | — | 8.9 | — | — | 0.5 | — | — |
| LYM997 | 74691.2 | — | — | — | 8.9 | 0.23 | 16 | — | — | — |
| LYM981 | 75060.3 | — | — | — | 9.7 | 0.04 | 27 | 0.5 | 0.01 | 20 |
| LYM953 | 74486.3 | — | — | — | 9.2 | 0.13 | 20 | 0.5 | 0.14 | 11 |
| LYM950 | 75083.2 | 0.8 | 0.29 | 11 | — | — | — | — | — | — |
| LYM939 | 74150.5 | — | — | — | 9.1 | 0.16 | 18 | — | — | — |
| LYM917 | 74456.3 | — | — | — | 8.8 | 0.26 | 15 | — | — | — |
| LYM917 | 74457.1 | 0.8 | 0.12 | 16 | — | — | — | 0.5 | 0.21 | 10 |
| LYM908 | 74636.4 | — | — | — | 9.5 | 0.08 | 24 | 0.5 | 0.14 | 12 |
| LYM908 | 74636.8 | 0.8 | 0.25 | 12 | — | — | — | — | — | — |
| LYM908 | 74637.6 | 0.8 | 0.25 | 13 | — | — | — | — | — | — |
| LYM907 | 74706.2 | 0.8 | 0.27 | 11 | 9.1 | 0.16 | 18 | 0.5 | 0.07 | 14 |
| LYM809 | 74986.1 | 0.8 | 0.18 | 16 | — | — | — | — | — | — |
| LYM809 | 74987.2 | — | — | — | 9.3 | 0.11 | 21 | 0.5 | 0.06 | 13 |
| LYM809 | 74987.3 | — | — | — | — | — | — | 0.5 | 0.22 | 9 |
| LYM789 | 74608.2 | 0.8 | 0.26 | 11 | — | — | — | 0.5 | 0.29 | 8 |
| LYM789 | 74608.5 | — | — | — | 10.6 | L | 38 | 0.5 | 0.10 | 12 |
| LYM773 | 75069.2 | 0.8 | 0.21 | 13 | — | — | — | — | — | — |
| LYM773 | 75073.2 | 0.8 | 0.16 | 15 | — | — | — | — | — | — |
| CONT. | — | 0.7 | — | — | 7.7 | — | — | 0.5 | — | — |
| LYM996 | 73567.1 | — | — | — | 3.0 | 0.20 | 19 | — | — | — |
| LYM986 | 73533.2 | — | — | — | 3.1 | 0.13 | 24 | — | — | — |
| LYM963 | 74025.4 | — | — | — | 3.3 | 0.07 | 29 | — | — | — |
| LYM963 | 74026.2 | — | — | — | 3.2 | 0.09 | 26 | — | — | — |
| LYM916 | 73238.1 | — | — | — | 3.0 | 0.18 | 21 | — | — | — |
| LYM916 | 73240.2 | — | — | — | 3.0 | 0.17 | 20 | — | — | — |
| LYM905 | 73802.5 | — | — | — | 3.0 | 0.24 | 18 | — | — | — |
| LYM892 | 73724.4 | — | — | — | 3.3 | 0.07 | 29 | 0.3 | 0.22 | 12 |
| LYM889 | 73794.2 | — | — | — | 3.0 | 0.23 | 18 | — | — | — |
| LYM881 | 73592.1 | — | — | — | 3.1 | 0.13 | 23 | — | — | — |
| LYM881 | 73597.2 | — | — | — | 3.1 | 0.12 | 25 | 0.3 | 0.17 | 14 |
| LYM837 | 73665.4 | — | — | — | 2.9 | 0.28 | 16 | — | — | — |
| LYM828 | 73785.1 | — | — | — | — | — | — | 0.3 | 0.29 | 11 |
| LYM828 | 73789.2 | 0.7 | 0.28 | 17 | — | — | — | — | — | — |
| LYM821 | 73991.4 | — | — | — | 3.0 | 0.21 | 19 | 0.3 | 0.29 | 10 |
| LYM821 | 73992.1 | 0.7 | 0.25 | 17 | 3.1 | 0.11 | 25 | 0.3 | 0.30 | 11 |
| LYM821 | 73992.2 | — | — | — | 3.0 | 0.18 | 20 | — | — | — |
| LYM815 | 74087.2 | — | — | — | 3.1 | 0.10 | 25 | 0.3 | 0.18 | 13 |
| LYM815 | 74087.3 | — | — | — | 3.0 | 0.19 | 20 | — | — | — |
| LYM807 | 73978.2 | — | — | — | 3.7 | L | 47 | 0.3 | 0.07 | 19 |
| LYM807 | 73980.3 | — | — | — | 3.3 | 0.06 | 29 | 0.3 | 0.19 | 13 |
| LYM795 | 73958.3 | — | — | — | 3.2 | 0.09 | 26 | 0.3 | 0.29 | 11 |
| LYM795 | 73960.2 | — | — | — | 3.2 | 0.09 | 27 | 0.3 | 0.19 | 14 |
| LYM795 | 73961.3 | — | — | — | 3.2 | 0.10 | 25 | — | — | — |
| LYM795 | 73963.1 | — | — | — | 3.0 | 0.24 | 17 | — | — | — |
| LYM779 | 73192.2 | — | — | — | 3.0 | 0.21 | 19 | — | — | — |
| LYM779 | 73193.2 | — | — | — | — | — | — | 0.3 | 0.26 | 11 |
| LYM766 | 74062.1 | — | — | — | 3.0 | 0.23 | 18 | — | — | — |
| LYM766 | 74065.3 | — | — | — | 2.9 | 0.29 | 16 | — | — | — |
| LYM763 | 73457.2 | — | — | — | 3.2 | 0.10 | 26 | 0.3 | 0.21 | 13 |
| LYM763 | 73457.3 | — | — | — | 3.2 | 0.06 | 29 | 0.3 | 0.16 | 14 |
| LYM763 | 73458.2 | — | — | — | 3.0 | 0.19 | 20 | — | — | — |
| LYM763 | 73458.5 | — | — | — | 3.4 | 0.04 | 34 | 0.3 | 0.08 | 17 |
| LYM763 | 73459.1 | — | — | — | 3.0 | 0.25 | 18 | — | — | — |
| LYM1009 | 73141.2 | — | — | — | 3.3 | 0.05 | 32 | 0.3 | 0.21 | 13 |
| CONT. | — | 0.6 | — | — | 2.5 | — | — | 0.3 | — | — |

TABLE 105-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM999 | 75018.1 | 0.7 | 0.12 | 17 | 6.5 | 0.19 | 19 | 0.4 | 0.24 | 10 |
| LYM999 | 75018.2 | — | — | — | 6.6 | 0.15 | 21 | 0.4 | 0.29 | 9 |
| LYM999 | 75019.3 | 0.7 | 0.09 | 17 | — | — | — | — | — | — |
| LYM999 | 75019.4 | 0.8 | 0.01 | 27 | 6.3 | 0.27 | 16 | 0.4 | 0.20 | 12 |
| LYM999 | 75022.1 | — | — | — | 7.3 | 0.02 | 35 | 0.4 | 0.13 | 14 |
| LYM992 | 74648.1 | 0.7 | 0.04 | 21 | — | — | — | — | — | — |
| LYM992 | 74649.4 | 0.7 | 0.14 | 18 | 7.2 | 0.04 | 32 | 0.4 | 0.16 | 14 |
| LYM992 | 74651.2 | 0.7 | 0.23 | 12 | — | — | — | — | — | — |
| LYM992 | 74653.4 | — | — | — | 6.5 | 0.19 | 20 | 0.4 | 0.15 | 13 |
| LYM990 | 74643.2 | 0.7 | 0.14 | 16 | 6.7 | 0.11 | 24 | 0.4 | 0.16 | 13 |
| LYM990 | 74643.3 | 0.7 | 0.24 | 12 | 6.7 | 0.11 | 24 | 0.4 | 0.24 | 11 |
| LYM990 | 74644.1 | 0.7 | 0.08 | 17 | 7.1 | 0.05 | 30 | 0.4 | 0.07 | 17 |
| LYM990 | 74644.2 | — | — | — | 7.8 | L | 43 | 0.5 | 0.02 | 23 |
| LYM982 | 74709.1 | 0.7 | 0.16 | 14 | — | — | — | — | — | — |
| LYM982 | 74709.3 | 0.7 | 0.16 | 16 | — | — | — | — | — | — |
| LYM982 | 74709.4 | 0.7 | 0.08 | 17 | 7.8 | L | 43 | 0.4 | 0.05 | 18 |
| LYM982 | 74710.3 | — | — | — | 6.3 | 0.26 | 16 | 0.4 | 0.18 | 12 |
| LYM959 | 74666.2 | — | — | — | — | — | — | 0.4 | 0.04 | 18 |
| LYM959 | 74666.5 | 0.7 | 0.16 | 17 | — | — | — | — | — | — |
| LYM959 | 74669.4 | 0.7 | 0.05 | 20 | 6.4 | 0.23 | 18 | 0.4 | 0.28 | 10 |
| LYM959 | 74671.2 | 0.8 | L | 29 | — | — | — | — | — | — |
| LYM943 | 74697.1 | 0.7 | 0.11 | 16 | — | — | — | — | — | — |
| LYM943 | 74701.1 | — | — | — | 6.5 | 0.19 | 19 | 0.4 | 0.19 | 12 |
| LYM935 | 74654.1 | 0.7 | 0.05 | 20 | — | — | — | — | — | — |
| LYM935 | 74657.1 | 0.7 | 0.14 | 14 | — | — | — | — | — | — |
| LYM935 | 74659.2 | 0.7 | 0.15 | 15 | — | — | — | — | — | — |
| LYM922 | 75075.1 | — | — | — | 7.0 | 0.05 | 30 | 0.4 | 0.05 | 18 |
| LYM922 | 75078.1 | 0.7 | 0.22 | 13 | 6.9 | 0.10 | 26 | 0.4 | 0.22 | 12 |
| LYM922 | 75080.1 | 0.8 | 0.01 | 29 | — | — | — | — | — | — |
| LYM922 | 75080.2 | 0.7 | 0.12 | 15 | — | — | — | 0.4 | 0.19 | 12 |
| LYM915 | 74956.1 | 0.7 | 0.27 | 12 | 7.3 | 0.02 | 35 | 0.4 | 0.03 | 20 |
| LYM915 | 74957.1 | 0.7 | 0.04 | 21 | — | — | — | — | — | — |
| LYM915 | 74958.2 | 0.8 | 0.03 | 24 | — | — | — | — | — | — |
| LYM915 | 74958.4 | 0.7 | 0.06 | 21 | 8.2 | L | 51 | 0.5 | L | 26 |
| LYM915 | 74959.3 | 0.7 | 0.11 | 17 | 6.8 | 0.09 | 26 | 0.4 | 0.20 | 12 |
| LYM904 | 74018.1 | — | — | — | — | — | — | 0.4 | 0.28 | 10 |
| LYM904 | 74021.1 | — | — | — | 6.9 | 0.07 | 27 | 0.4 | 0.04 | 19 |
| LYM904 | 74021.2 | 0.8 | L | 28 | — | — | — | — | — | — |
| LYM904 | 74023.2 | 0.7 | 0.18 | 15 | — | — | — | — | — | — |
| LYM847 | 75048.1 | — | — | — | 6.5 | 0.19 | 20 | — | — | — |
| LYM847 | 75052.1 | 0.7 | 0.27 | 12 | 6.9 | 0.07 | 27 | 0.4 | 0.04 | 19 |
| LYM847 | 75052.2 | — | — | — | 7.8 | L | 44 | 0.5 | 0.02 | 22 |
| LYM847 | 75052.4 | 0.7 | 0.29 | 10 | — | — | — | — | — | — |
| LYM842 | 74012.1 | 0.7 | 0.14 | 17 | — | — | — | — | — | — |
| LYM842 | 74012.3 | 0.7 | 0.05 | 19 | — | — | — | — | — | — |
| LYM842 | 74012.4 | — | — | — | — | — | — | 0.4 | 0.23 | 11 |
| LYM842 | 74017.7 | — | — | — | 6.3 | 0.26 | 17 | — | — | — |
| LYM839 | 74995.2 | 0.7 | 0.11 | 18 | 6.5 | 0.20 | 19 | — | — | — |
| LYM839 | 74996.1 | 0.7 | 0.26 | 11 | — | — | — | — | — | — |
| LYM839 | 74996.2 | 0.7 | 0.08 | 19 | — | — | — | — | — | — |
| LYM839 | 74996.3 | 0.7 | 0.27 | 11 | 7.5 | 0.02 | 38 | 0.4 | 0.13 | 15 |
| LYM839 | 74996.5 | — | — | — | 6.6 | 0.15 | 21 | 0.4 | 0.12 | 14 |
| LYM826 | 74619.2 | 0.7 | 0.10 | 18 | — | — | — | — | — | — |
| LYM826 | 74620.3 | — | — | — | 6.5 | 0.17 | 20 | 0.4 | 0.15 | 13 |
| LYM826 | 74623.2 | — | — | — | 6.7 | 0.11 | 24 | 0.4 | 0.08 | 15 |
| LYM808 | 74612.1 | — | — | — | 6.5 | 0.20 | 19 | 0.4 | 0.09 | 15 |
| LYM808 | 74613.5 | 0.7 | 0.04 | 20 | 6.5 | 0.19 | 19 | — | — | — |
| LYM808 | 74615.1 | 0.7 | 0.11 | 18 | — | — | — | — | — | — |
| LYM808 | 74617.2 | — | — | — | 6.5 | 0.19 | 20 | — | — | — |
| LYM808 | 74617.3 | 0.8 | 0.03 | 23 | 7.0 | 0.06 | 29 | 0.4 | 0.18 | 12 |
| LYM805 | 74546.1 | 0.7 | 0.09 | 17 | 6.5 | 0.17 | 20 | — | — | — |
| LYM805 | 74547.2 | 0.7 | 0.25 | 13 | 8.3 | L | 53 | 0.5 | 0.01 | 24 |
| LYM805 | 74550.2 | 0.7 | 0.17 | 15 | 6.4 | 0.20 | 19 | — | — | — |
| LYM751 | 74536.4 | 0.8 | L | 30 | 6.8 | 0.09 | 25 | 0.4 | 0.25 | 10 |
| LYM751 | 74539.2 | — | — | — | 6.5 | 0.20 | 20 | — | — | — |
| LYM1005 | 74978.1 | 0.8 | 0.02 | 24 | 8.6 | L | 58 | 0.5 | L | 26 |
| LYM1005 | 74978.3 | 0.8 | 0.02 | 26 | 8.7 | L | 61 | 0.5 | 0.03 | 23 |
| LYM1005 | 74979.1 | — | — | — | 6.8 | 0.09 | 25 | 0.4 | 0.05 | 18 |
| LYM1005 | 74979.2 | — | — | — | 6.9 | 0.08 | 27 | 0.4 | 0.06 | 18 |
| LYM1005 | 74982.4 | 0.7 | 0.20 | 14 | — | — | — | — | — | — |
| CONT. | — | 0.6 | — | — | 5.4 | — | — | 0.4 | — | — |

TABLE 105-continued

Genes showing improved plant performance at Normal growth conditions under regulation of At6669 promoter

| Gene Name | Event # | RGR Of Leaf Number | | | RGR Of Plot Coverage | | | RGR Of Rosette Diameter | | |
|---|---|---|---|---|---|---|---|---|---|---|
| | | Ave. | P-Val. | % Incr. | Ave. | P-Val. | % Incr. | Ave. | P-Val. | % Incr. |
| LYM991 | 74207.2 | — | — | — | 5.5 | 0.12 | 25 | 0.3 | 0.21 | 11 |
| LYM989 | 74222.1 | — | — | — | 5.3 | 0.26 | 19 | — | — | — |
| LYM989 | 74222.3 | — | — | — | 5.4 | 0.17 | 22 | — | — | — |
| LYM989 | 74224.1 | — | — | — | 5.3 | 0.21 | 20 | — | — | — |
| LYM957 | 74203.5 | — | — | — | 5.6 | 0.13 | 27 | — | — | — |
| LYM957 | 74203.6 | — | — | — | 5.8 | 0.09 | 31 | 0.3 | 0.12 | 15 |
| LYM952 | 74250.2 | — | — | — | 6.1 | 0.03 | 37 | 0.3 | 0.21 | 11 |
| LYM952 | 74250.3 | — | — | — | 5.4 | 0.21 | 21 | — | — | — |
| LYM952 | 74251.2 | 0.8 | 0.18 | 18 | 5.4 | 0.18 | 21 | — | — | — |
| LYM952 | 74251.4 | — | — | — | 5.8 | 0.06 | 32 | 0.4 | 0.09 | 16 |
| LYM949 | 73521.2 | — | — | — | 5.5 | 0.14 | 24 | — | — | — |
| LYM911 | 73838.2 | — | — | — | 5.6 | 0.12 | 26 | — | — | — |
| LYM891 | 73720.2 | — | — | — | 5.4 | 0.21 | 21 | — | — | — |
| LYM874 | 73584.2 | — | — | — | 5.2 | 0.30 | 16 | — | — | — |
| LYM874 | 73585.1 | — | — | — | 6.6 | L | 49 | 0.4 | 0.04 | 19 |
| LYM871 | 74166.1 | — | — | — | 5.3 | 0.22 | 20 | — | — | — |
| LYM871 | 74167.2 | — | — | — | 5.7 | 0.07 | 30 | 0.4 | 0.04 | 18 |
| LYM870 | 74424.3 | — | — | — | 5.3 | 0.21 | 20 | — | — | — |
| LYM858 | 74406.1 | — | — | — | 5.3 | 0.25 | 19 | — | — | — |
| LYM853 | 73700.4 | — | — | — | 5.2 | 0.26 | 18 | — | — | — |
| LYM851 | 74392.1 | — | — | — | 5.5 | 0.13 | 25 | — | — | — |
| LYM851 | 74393.2 | — | — | — | 6.1 | 0.03 | 38 | 0.4 | 0.03 | 19 |
| LYM816 | 74334.2 | — | — | — | 5.5 | 0.14 | 24 | 0.3 | 0.29 | 9 |
| LYM816 | 74335.1 | — | — | — | 6.0 | 0.03 | 36 | 0.3 | 0.10 | 14 |
| LYM769 | 73599.1 | — | — | — | 5.2 | 0.28 | 17 | — | — | — |
| LYM769 | 73600.2 | — | — | — | 6.5 | 0.01 | 46 | 0.4 | 0.05 | 19 |
| LYM769 | 73600.4 | — | — | — | 5.8 | 0.06 | 31 | 0.3 | 0.12 | 14 |
| LYM769 | 73601.1 | — | — | — | 5.4 | 0.19 | 21 | — | — | — |
| LYM758 | 74050.4 | — | — | — | 5.6 | 0.09 | 27 | 0.3 | 0.11 | 14 |
| LYM758 | 74104.4 | — | — | — | 5.3 | 0.24 | 19 | — | — | — |
| LYM1006 | 74258.3 | — | — | — | 5.2 | 0.26 | 18 | — | — | — |
| LYM1006 | 74259.1 | — | — | — | 5.5 | 0.13 | 25 | 0.3 | 0.30 | 9 |
| LYM1006 | 74263.1 | — | — | — | — | — | — | 0.3 | 0.29 | 9 |
| LYM1006 | 74263.4 | — | — | — | 5.2 | 0.26 | 18 | — | — | — |
| CONT. | — | 0.7 | — | — | 4.4 | — | — | 0.3 | — | — |

Table 105.
"CONT."—Control; "Ave."—Average; "% Incr." = % increment; "p-val."—p-value, L—p < 0.01.

Example 21

Evaluating Transgenic *Arabidopsis* Under Normal Conditions Using In Vitro Assays [Tissue Culture T2 and T1 Plants, Tc-T2 and TC-T1 Assays]

Surface sterilized seeds were sown in basal media [50% Murashige-Skoog medium (MS) supplemented with 0.8% plant agar as solidifying agent] in the presence of Kanamycin (used as a selecting agent). After sowing, plates were transferred for 2-3 days for stratification at 4° C. and then grown at 25° C. under 12-hour light 12-hour dark daily cycles for 7 to 10 days. At this time point, seedlings randomly chosen were to carefully transferred to plates containing ½ MS media (15 mM N). For experiments performed in $T_2$ lines, each plate contained 5 seedlings of the same transgenic event, and 3-4 different plates (replicates) for each event. For each polynucleotide of the invention at least four-five independent transformation events were analyzed from each construct. For experiments performed in $T_1$ lines, each plate contained 5 seedlings of 5 independent transgenic events and 3-4 different plates (replicates) were planted. In total, for $T_1$ lines, 20 independent events were evaluated. Plants expressing the polynucleotides of the invention were compared to the average measurement of the control plants (empty vector or GUS reporter gene under the same promoter) used in the same experiment.

Digital imaging—A laboratory image acquisition system, which consists of a digital reflex camera (Canon EOS 300D) attached with a 55 mm focal length lens (Canon EF-S series), mounted on a reproduction device (Kaiser RS), which includes 4 light units (4×150 Watts light bulb) and located in a darkroom, was used for capturing images of plantlets sawn in agar plates.

The image capturing process was repeated every 3-4 days starting at day 1 till day 10 (see for example the images in FIGS. 3A-F). An image analysis system was used, which consists of a personal desktop computer (Intel P4 3.0 GHz processor) and a public domain program-ImageJ 1.39 [Java based image processing program which was developed at the U.S. National Institutes of Health and freely available on the internet at Hypertext Transfer Protocol://rsbweb (dot) nih (dot) gov/]. Images were captured in resolution of 10 Mega Pixels (3888×2592 pixels) and stored in a low compression JPEG (Joint Photographic Experts Group standard) format. Next, analyzed data was saved to text files and processed using the JMP statistical analysis software (SAS institute).

Seedling analysis—Using the digital analysis seedling data is calculated, including leaf area, root coverage and root length.

The relative growth rate for the various seedling parameters was calculated according to the following Formulas XX (RGR leaf area, below), V (RGR root coverage, described above) and XXI (RGR root length, below).

Relative growth rate of leaf area=Regression coefficient of leaf area along time course.  Formula XX:

Relative growth rate of root length=Regression coefficient of root length along time course.  Formula XXI:

At the end of the experiment, plantlets were removed from the media and weighed for the determination of plant fresh weight. Plantlets were then dried for 24 hours at 60° C., and weighed again to measure plant dry weight for later statistical analysis. The fresh and dry weights are provided for each *Arabidopsis* plant. Growth rate was determined by comparing the leaf area coverage, root coverage and root length, between each couple of sequential photographs, and results were used to resolve the effect of the gene introduced on plant vigor under optimal conditions. Similarly, the effect of the gene introduced on biomass accumulation, under optimal conditions, was determined by comparing the plants' fresh and dry weight to that of control plants (containing an empty vector or the GUS reporter gene under the same promoter). From every construct created, 3-5 independent transformation events were examined in replicates.

Statistical analyses—To identify genes conferring significantly improved plant vigor or enlarged root architecture, the results obtained from the transgenic plants were compared to those obtained from control plants. To identify outperforming genes and constructs, results from the independent transformation events tested were analyzed separately. To evaluate the effect of a gene event over a control the data was analyzed by Student's t-test and the p value was calculated. Results were considered significant if p≤0.1. The JMP statistics software package was used (Version 5.2.1, SAS Institute Inc., Cary, N.C., USA).

Experimental Results:

Tables 106-108 summarize the observed phenotypes of transgenic plants expressing the gene constructs using the TC-T2 Assays.

The genes presented in Table 106 showed a significant improvement as they produced larger plant biomass (plant fresh and dry weight) in T2 generation when grown under normal growth conditions, compared to control plants which were grown under identical conditions. The genes were cloned under the regulation of a constitutive promoter (At6669, SEQ ID NO:10575).

The evaluation of each gene was carried out by testing the performance of different number of events. Some of the genes were evaluated in more than one tissue culture assay. The results obtained in these second experiments were significantly positive as well.

TABLE 106

Genes showing improved plant performance at Normal growth conditions under regulation of At6669 promoter

| Gene Name | Event # | Dry Weight [mg] | | | Fresh Weight [mg] | | |
| --- | --- | --- | --- | --- | --- | --- | --- |
| | | Ave. | P-Val. | % Incr. | Ave. | P-Val. | % Incr. |
| LYM994 | 75658.2 | 5.3 | 0.23 | 14 | — | — | — |
| LYM994 | 75659.1 | — | — | — | 109.2 | 0.19 | 16 |
| LYM994 | 75659.3 | 5.8 | 0.23 | 24 | — | — | — |
| LYM983 | 76016.1 | 7.4 | 0.06 | 59 | 151.2 | 0.02 | 61 |
| LYM983 | 76016.2 | 7.8 | L | 67 | 133.1 | 0.03 | 41 |
| LYM983 | 76017.2 | 9.3 | 0.15 | 100 | 184.8 | 0.13 | 96 |
| LYM983 | 76020.2 | 8.3 | 0.04 | 79 | 156.2 | 0.06 | 66 |
| LYM961 | 75593.2 | 10.1 | 0.05 | 118 | 169.1 | 0.05 | 79 |
| LYM961 | 75594.2 | 7.0 | L | 50 | 136.7 | 0.01 | 45 |
| LYM948 | 75639.3 | 8.8 | 0.02 | 88 | 177.1 | L | 88 |
| LYM948 | 75643.1 | 6.8 | 0.09 | 46 | 131.6 | 0.23 | 40 |
| LYM948 | 75643.2 | 9.2 | L | 98 | 174.5 | L | 85 |
| LYM946 | 75675.10 | 5.9 | 0.20 | 25 | — | — | — |
| LYM946 | 75675.4 | 7.8 | L | 66 | 143.9 | L | 53 |
| LYM946 | 75677.3 | 5.9 | 0.27 | 27 | 115.3 | 0.26 | 22 |
| LYM946 | 75677.4 | 7.9 | 0.11 | 69 | 142.6 | 0.03 | 51 |
| LYM934 | 75928.4 | 6.9 | 0.14 | 49 | — | — | — |
| LYM934 | 75928.5 | 9.0 | L | 93 | 166.4 | L | 77 |
| LYM934 | 75929.1 | 6.2 | 0.19 | 32 | 116.1 | 0.21 | 23 |
| LYM914 | 75369.1 | 9.3 | L | 99 | 169.3 | L | 80 |
| LYM914 | 75371.4 | 5.6 | 0.10 | 21 | — | — | — |
| LYM914 | 75372.2 | 7.5 | 0.01 | 61 | 136.8 | 0.02 | 45 |
| LYM914 | 75372.3 | 5.9 | 0.19 | 27 | — | — | — |
| LYM906 | 76071.3 | 7.3 | 0.13 | 58 | 153.1 | 0.08 | 63 |
| LYM906 | 76072.1 | 6.2 | 0.16 | 32 | 116.8 | 0.11 | 24 |
| LYM906 | 76072.2 | 6.3 | 0.09 | 36 | 118.0 | 0.09 | 25 |
| LYM888_H1 | 76068.3 | 7.1 | 0.05 | 53 | 144.7 | 0.04 | 54 |
| LYM888_H1 | 76068.5 | 11.4 | L | 145 | 206.6 | L | 119 |
| LYM865 | 75475.2 | 6.1 | 0.20 | 31 | 116.6 | 0.20 | 24 |
| LYM845 | 75742.1 | 5.8 | 0.14 | 24 | 118.2 | 0.09 | 25 |
| LYM845 | 75742.2 | 5.7 | 0.24 | 23 | — | — | — |
| LYM830_H4 | 76061.1 | 11.8 | 0.03 | 154 | 223.6 | 0.06 | 137 |
| LYM830_H4 | 76064.1 | 10.8 | L | 131 | 191.7 | L | 104 |
| LYM830_H4 | 76065.1 | 7.6 | 0.15 | 62 | 168.4 | 0.10 | 79 |
| LYM765 | 75603.1 | 9.1 | L | 95 | 176.9 | L | 88 |
| LYM765 | 75604.2 | 7.6 | 0.04 | 64 | 177.2 | 0.12 | 88 |
| LYM765 | 75606.2 | 5.8 | 0.06 | 24 | 111.0 | 0.17 | 18 |
| LYM765 | 75606.4 | 6.6 | 0.23 | 42 | 134.0 | 0.16 | 42 |
| LYM1002 | 75636.4 | 9.5 | L | 104 | 180.4 | L | 92 |
| LYM1002 | 75636.5 | — | — | — | 126.1 | 0.26 | 34 |
| LYM1002 | 75637.1 | 6.3 | 0.12 | 36 | 122.2 | 0.06 | 30 |
| CONT. | — | 4.7 | — | — | 94.2 | — | — |
| LYM998 | 74219.1 | 10.7 | L | 71 | 204.1 | L | 69 |
| LYM972 | 74510.1 | 8.2 | 0.22 | 31 | 162.4 | 0.17 | 35 |
| LYM966 | 74524.1 | 7.2 | 0.12 | 16 | 147.4 | 0.07 | 22 |
| LYM954 | 74496.2 | 8.3 | 0.03 | 33 | 161.6 | 0.04 | 34 |
| LYM920 | 74464.1 | 7.5 | 0.09 | 21 | 146.0 | 0.06 | 21 |
| LYM886 | 74446.4 | 7.4 | 0.12 | 19 | 145.6 | 0.09 | 21 |
| LYM886 | 74448.4 | 8.6 | 0.24 | 39 | 161.9 | 0.22 | 34 |
| LYM857 | 74396.2 | — | — | — | 144.8 | 0.08 | 20 |
| LYM857 | 74400.1 | 7.1 | 0.30 | 14 | 151.9 | 0.30 | 26 |
| LYM811 | 74385.2 | 9.8 | 0.06 | 57 | 201.5 | 0.02 | 67 |
| LYM811 | 74386.1 | 8.4 | 0.11 | 35 | 168.7 | 0.02 | 40 |
| LYM811 | 74388.3 | 8.7 | 0.13 | 40 | 177.7 | 0.09 | 47 |
| LYM783 | 74373.2 | 9.2 | 0.05 | 48 | 170.6 | 0.04 | 41 |
| LYM783 | 74374.1 | 12.2 | 0.06 | 97 | 216.3 | 0.07 | 79 |
| LYM1004 | 74336.2 | — | — | — | 146.9 | 0.29 | 22 |
| LYM1004 | 74336.3 | 8.0 | 0.05 | 28 | 171.8 | L | 42 |
| LYM1004 | 74340.1 | 7.2 | 0.16 | 16 | 156.7 | 0.26 | 30 |
| CONT. | — | 6.2 | — | — | 120.7 | — | — |
| LYM798 | 75664.1 | 10.1 | L | 97 | 188.1 | L | 79 |
| LYM798 | 75664.4 | — | — | — | 124.3 | 0.10 | 18 |
| LYM798 | 75665.3 | 10.0 | L | 93 | 186.0 | 0.01 | 77 |
| CONT. | — | 5.2 | — | — | 105.3 | — | — |
| LYM977 | 73616.2 | 5.0 | 0.28 | 41 | — | — | — |
| LYM977 | 73617.1 | — | — | — | 71.3 | 0.23 | 16 |
| LYM977 | 73618.2 | 5.4 | L | 53 | 90.8 | L | 48 |
| LYM977 | 73621.3 | 4.8 | 0.14 | 35 | 71.5 | 0.11 | 17 |
| LYM976 | 74030.1 | 5.4 | 0.04 | 54 | 100.7 | L | 64 |
| LYM976 | 74033.1 | 4.1 | 0.11 | 17 | — | — | — |
| LYM976 | 74034.1 | 4.8 | 0.04 | 35 | 88.1 | 0.14 | 44 |
| LYM976 | 74034.2 | 5.6 | 0.04 | 58 | 95.7 | 0.12 | 56 |
| LYM976 | 74034.3 | 5.9 | 0.11 | 68 | 101.9 | 0.09 | 66 |
| LYM958 | 73556.3 | 4.2 | 0.22 | 21 | 73.5 | 0.27 | 20 |
| LYM958 | 73556.4 | 6.2 | 0.03 | 77 | 101.8 | 0.07 | 66 |
| LYM958 | 73560.3 | 5.7 | 0.08 | 61 | 104.6 | 0.14 | 71 |
| LYM958 | 73560.5 | — | — | — | 81.9 | 0.24 | 34 |

TABLE 106-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
| --- | --- | --- | --- | --- | --- | --- | --- |
| LYM958 | 73560.6 | 4.7 | 0.08 | 33 | 87.2 | 0.19 | 42 |
| LYM944 | 73294.2 | 6.2 | 0.04 | 77 | 109.0 | 0.05 | 78 |
| LYM944 | 73294.3 | 4.4 | 0.24 | 24 | 76.0 | 0.12 | 24 |
| LYM944 | 73295.2 | 6.6 | 0.03 | 89 | 116.8 | 0.03 | 91 |
| LYM944 | 73296.3 | — | — | — | 75.8 | 0.20 | 24 |
| LYM856 | 74139.2 | 4.4 | 0.03 | 24 | 92.0 | 0.03 | 50 |
| LYM856 | 74140.2 | 6.7 | L | 89 | 118.5 | L | 94 |
| LYM856 | 74140.4 | 5.1 | 0.03 | 45 | 86.5 | 0.02 | 41 |
| LYM856 | 74141.1 | 5.3 | 0.13 | 50 | 95.4 | 0.15 | 56 |
| LYM846 | 73606.3 | 5.2 | 0.09 | 46 | — | — | — |
| LYM846 | 73608.5 | 5.1 | L | 44 | 91.2 | L | 49 |
| LYM846 | 73609.1 | 4.9 | 0.26 | 38 | 88.5 | 0.23 | 45 |
| LYM846 | 73609.3 | 6.4 | L | 82 | 105.0 | 0.02 | 71 |
| LYM846 | 73609.5 | 4.2 | 0.24 | 18 | — | — | — |
| LYM832 | 73660.3 | 4.6 | 0.11 | 31 | — | — | — |
| LYM832 | 73660.6 | 5.2 | 0.11 | 48 | 84.5 | 0.10 | 38 |
| LYM832 | 73663.1 | 5.0 | 0.02 | 43 | 82.6 | 0.14 | 35 |
| LYM823 | 73655.2 | 5.0 | 0.04 | 40 | 75.9 | 0.13 | 24 |
| LYM823 | 73655.4 | 4.6 | 0.12 | 32 | 84.1 | 0.26 | 37 |
| LYM823 | 73655.5 | 5.3 | 0.06 | 50 | 97.1 | 0.07 | 59 |
| LYM823 | 73657.2 | 6.8 | 0.01 | 92 | 121.6 | L | 99 |
| LYM823 | 73657.3 | 5.0 | 0.04 | 43 | 84.8 | 0.02 | 39 |
| LYM818 | 74132.1 | 4.5 | 0.07 | 28 | 77.2 | 0.06 | 26 |
| LYM818 | 74132.2 | 5.1 | 0.16 | 44 | — | — | — |
| LYM818 | 74133.2 | 4.9 | 0.13 | 38 | 82.9 | 0.18 | 35 |
| LYM818 | 74136.1 | 5.9 | L | 67 | 103.2 | 0.12 | 69 |
| LYM818 | 74136.3 | 5.5 | 0.03 | 57 | 93.7 | 0.07 | 53 |
| LYM814 | 73648.2 | 4.5 | 0.14 | 28 | 87.1 | 0.13 | 42 |
| LYM814 | 73648.4 | 5.3 | 0.17 | 51 | — | — | — |
| LYM814 | 73649.3 | 4.8 | 0.15 | 35 | 84.2 | 0.26 | 37 |
| LYM814 | 73651.3 | 5.5 | L | 56 | 104.0 | 0.05 | 70 |
| LYM777 | 73941.3 | 6.5 | 0.04 | 84 | 114.2 | 0.07 | 86 |
| LYM777 | 73942.2 | 5.3 | 0.17 | 51 | — | — | — |
| LYM777 | 73943.1 | 4.6 | 0.03 | 32 | — | — | — |
| LYM777 | 73943.4 | 4.0 | 0.27 | 13 | — | — | — |
| LYM760 | 73934.2 | 4.9 | 0.03 | 39 | 76.0 | 0.20 | 24 |
| LYM760 | 73935.6 | 4.6 | 0.23 | 30 | 91.5 | 0.03 | 49 |
| LYM760 | 73939.4 | 4.1 | 0.29 | 17 | — | — | — |
| LYM753 | 74037.2 | 6.9 | 0.06 | 97 | 125.0 | 0.03 | 104 |
| LYM753 | 74039.4 | 4.8 | 0.09 | 35 | 91.6 | 0.01 | 50 |
| LYM753 | 74039.5 | 6.5 | 0.05 | 85 | 104.8 | L | 71 |
| LYM753 | 74040.3 | 4.5 | 0.22 | 28 | 79.1 | 0.26 | 29 |
| LYM752 | 73214.1 | 5.6 | 0.08 | 58 | 92.9 | 0.04 | 52 |
| LYM752 | 73215.2 | 7.5 | 0.28 | 113 | 135.9 | 0.26 | 122 |
| LYM752 | 73218.1 | — | — | — | 68.7 | 0.20 | 12 |
| LYM752 | 73218.3 | 4.5 | 0.03 | 28 | 77.6 | 0.03 | 27 |
| CONT. | — | 3.5 | — | — | 61.2 | — | — |
| LYM997 | 74694.1 | 7.4 | 0.05 | 56 | 115.7 | 0.09 | 40 |
| LYM997 | 74695.4 | 5.5 | 0.12 | 16 | 93.9 | 0.19 | 14 |
| LYM982 | 74709.1 | 6.9 | 0.22 | 46 | — | — | — |
| LYM982 | 74709.4 | 5.9 | 0.29 | 23 | 110.0 | 0.05 | 33 |
| LYM982 | 74713.2 | 5.2 | 0.26 | 9 | — | — | — |
| LYM980 | 74589.1 | 5.7 | 0.04 | 19 | 95.4 | 0.09 | 16 |
| LYM980 | 74593.5 | 5.6 | 0.03 | 19 | — | — | — |
| LYM935 | 74654.1 | 5.3 | 0.17 | 12 | — | — | — |
| LYM935 | 74655.1 | 6.0 | 0.15 | 25 | 106.8 | 0.15 | 29 |
| LYM935 | 74659.1 | 5.2 | 0.28 | 11 | — | — | — |
| LYM930 | 73779.3 | 7.3 | 0.03 | 55 | 123.9 | 0.02 | 50 |
| LYM930 | 73782.4 | 5.8 | 0.06 | 22 | 106.8 | 0.03 | 29 |
| LYM930 | 73783.1 | 6.0 | 0.12 | 26 | 106.7 | 0.15 | 29 |
| LYM908 | 74637.4 | 5.9 | 0.05 | 23 | 95.7 | 0.27 | 16 |
| LYM857 | 74396.2 | 6.2 | L | 29 | 107.5 | 0.03 | 30 |
| LYM857 | 74400.1 | 8.8 | L | 86 | 148.4 | L | 80 |
| LYM857 | 74401.2 | 6.4 | 0.14 | 35 | 99.2 | 0.19 | 20 |
| LYM820 | 74585.1 | 8.7 | 0.01 | 82 | 150.8 | L | 83 |
| LYM820 | 74585.4 | 6.6 | 0.03 | 39 | 114.0 | L | 38 |
| LYM820 | 74587.1 | 6.8 | L | 43 | 112.8 | L | 37 |
| LYM783 | 74372.1 | 7.0 | 0.12 | 47 | 117.1 | 0.18 | 42 |
| LYM783 | 74377.2 | 7.3 | 0.06 | 53 | 116.0 | 0.10 | 41 |
| LYM762 | 73149.1 | 5.6 | 0.06 | 17 | 97.2 | 0.06 | 18 |
| LYM762 | 73149.3 | 9.1 | 0.08 | 91 | 140.3 | 0.05 | 70 |
| CONT. | — | 4.8 | — | — | 82.5 | — | — |
| LYM936 | 74482.1 | 8.5 | 0.19 | 19 | — | — | — |
| LYM882 | 74442.1 | 8.4 | 0.21 | 17 | — | — | — |
| LYM802 | 74437.3 | 8.2 | 0.24 | 15 | — | — | — |
| LYM782 | 74810.1 | 9.2 | 0.02 | 30 | 190.9 | 0.03 | 32 |
| LYM771 | 74528.1 | 10.0 | L | 40 | 173.5 | 0.18 | 20 |
| LYM771 | 74529.1 | 11.2 | 0.04 | 57 | 196.9 | 0.10 | 37 |
| LYM771 | 74530.2 | 10.9 | 0.03 | 53 | 189.9 | 0.18 | 32 |
| LYM771 | 74532.1 | 8.6 | 0.21 | 21 | — | — | — |
| CONT. | — | 7.1 | — | — | 144.3 | — | — |
| LYM992 | 74648.1 | 5.6 | 0.11 | 70 | 107.8 | 0.16 | 64 |
| LYM992 | 74649.4 | 5.0 | L | 53 | 96.1 | L | 46 |
| LYM992 | 74651.2 | 4.9 | 0.01 | 48 | 95.7 | 0.14 | 46 |
| LYM992 | 74653.4 | 4.0 | 0.04 | 22 | 79.3 | 0.09 | 21 |
| LYM953 | 74486.3 | 4.2 | 0.06 | 28 | 79.3 | 0.11 | 21 |
| LYM953 | 74487.1 | 4.0 | 0.22 | 22 | — | — | — |
| LYM953 | 74491.2 | — | — | — | 108.9 | 0.26 | 66 |
| LYM942 | 74661.3 | 4.1 | 0.18 | 24 | 88.6 | 0.19 | 35 |
| LYM942 | 74661.5 | — | — | — | 80.6 | 0.23 | 23 |
| LYM942 | 74665.4 | 3.8 | 0.13 | 16 | 78.0 | 0.19 | 19 |
| LYM936 | 74480.1 | — | — | — | 73.9 | 0.26 | 12 |
| LYM936 | 74482.1 | 4.5 | 0.29 | 36 | 93.6 | 0.23 | 42 |
| LYM936 | 74482.2 | 4.3 | 0.21 | 30 | 91.9 | 0.13 | 40 |
| LYM936 | 74483.1 | 5.1 | L | 54 | 101.2 | L | 54 |
| LYM936 | 74484.1 | 4.6 | 0.01 | 41 | 105.5 | L | 61 |
| LYM882 | 74439.2 | 4.5 | 0.03 | 36 | 92.4 | 0.04 | 41 |
| LYM882 | 74440.1 | 3.6 | 0.24 | 10 | — | — | — |
| LYM879 | 74602.1 | 5.3 | 0.07 | 61 | 106.0 | 0.09 | 61 |
| LYM879 | 74602.5 | — | — | — | 88.7 | 0.26 | 35 |
| LYM879 | 74604.2 | — | — | — | 102.5 | 0.08 | 56 |
| LYM879 | 74604.5 | 4.3 | 0.10 | 31 | 83.8 | 0.10 | 28 |
| LYM879 | 74605.1 | 3.8 | 0.11 | 14 | 81.3 | 0.04 | 24 |
| LYM840 | 73546.2 | 4.9 | 0.16 | 47 | 111.5 | 0.13 | 70 |
| LYM840 | 73547.1 | 4.3 | 0.15 | 32 | — | — | — |
| LYM840 | 73547.2 | 5.1 | 0.07 | 55 | 102.0 | 0.09 | 55 |
| LYM840 | 73548.1 | 3.9 | 0.21 | 17 | 76.8 | 0.30 | 17 |
| LYM840 | 73549.1 | 4.4 | 0.04 | 33 | 93.0 | 0.03 | 41 |
| LYM799 | 73690.1 | 4.1 | 0.21 | 23 | — | — | — |
| LYM796 | 74571.2 | 4.9 | 0.06 | 49 | 105.2 | L | 60 |
| LYM796 | 74571.3 | 4.9 | 0.19 | 48 | 102.7 | 0.18 | 56 |
| LYM796 | 74573.1 | 6.9 | 0.08 | 108 | 133.2 | 0.06 | 103 |
| LYM796 | 74575.1 | 4.2 | 0.01 | 27 | 94.5 | 0.02 | 44 |
| LYM757 | 74427.1 | 3.9 | 0.22 | 17 | 80.4 | 0.07 | 22 |
| LYM757 | 74427.4 | 5.8 | 0.05 | 76 | 111.9 | 0.03 | 70 |
| LYM757 | 74428.1 | 6.2 | 0.03 | 89 | 129.7 | 0.05 | 97 |
| LYM757 | 74429.2 | 6.7 | 0.02 | 104 | 131.4 | L | 100 |
| LYM757 | 74429.3 | 4.7 | 0.02 | 42 | 102.6 | L | 56 |
| CONT. | — | 3.3 | — | — | 65.7 | — | — |
| LYM805 | 74547.1 | 9.2 | 0.22 | 37 | 167.6 | 0.17 | 37 |
| LYM805 | 74548.1 | 13.1 | 0.02 | 96 | 232.1 | 0.02 | 90 |
| LYM805 | 74550.2 | 9.1 | 0.09 | 35 | 174.2 | 0.02 | 43 |
| LYM782 | 74810.1 | 8.3 | 0.22 | 24 | — | — | — |
| LYM782 | 74814.1 | 9.7 | 0.04 | 44 | 173.1 | 0.04 | 42 |
| CONT. | — | 6.7 | — | — | 122.0 | — | — |
| LYM956 | 74498.2 | 6.8 | 0.10 | 19 | — | — | — |
| LYM927 | 73769.1 | 8.1 | 0.05 | 42 | — | — | — |
| LYM927 | 73770.2 | 7.5 | 0.12 | 31 | — | — | — |
| LYM787 | 74568.3 | 6.4 | 0.22 | 12 | — | — | — |
| CONT. | — | 5.7 | — | — | — | — | — |
| LYM955 | 75360.2 | — | — | — | 145.1 | 0.14 | 34 |
| LYM955 | 75360.3 | 8.3 | 0.11 | 53 | 159.1 | L | 47 |
| LYM955 | 75360.6 | 7.8 | 0.26 | 42 | 152.8 | 0.21 | 41 |
| LYM921 | 75376.1 | 7.3 | 0.06 | 34 | 140.3 | 0.11 | 30 |
| LYM774 | 75699.1 | 7.7 | 0.02 | 40 | 166.1 | L | 54 |
| LYM774 | 75700.1 | 7.7 | 0.02 | 41 | 181.1 | 0.01 | 68 |
| LYM774 | 75701.4 | 9.3 | 0.11 | 70 | 210.6 | 0.06 | 95 |
| LYM756 | 75528.2 | 8.9 | 0.04 | 62 | 166.6 | 0.10 | 54 |
| LYM756 | 75528.3 | 8.5 | 0.10 | 55 | 168.6 | 0.05 | 56 |
| CONT. | — | 5.5 | — | — | 108.1 | — | — |
| LYM925 | 73760.2 | 8.6 | 0.09 | 73 | 163.1 | 0.07 | 75 |
| LYM925 | 73763.3 | 6.0 | 0.21 | 20 | — | — | — |
| LYM924 | 73757.4 | 10.4 | 0.01 | 110 | 187.5 | 0.03 | 101 |
| LYM924 | 73758.1 | 8.8 | 0.01 | 76 | 151.8 | 0.02 | 62 |

TABLE 106-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYM924 | 73758.3 | 9.3 | 0.03 | 88 | 165.6 | 0.01 | 77 |
| LYM919 | 73748.2 | 6.4 | 0.16 | 29 | 120.3 | 0.14 | 29 |
| LYM919 | 73753.2 | — | — | — | 119.2 | 0.27 | 28 |
| LYM912 | 73746.2 | 6.3 | 0.25 | 27 | — | — | — |
| LYM912 | 73747.4 | 7.4 | 0.13 | 50 | 146.2 | 0.05 | 56 |
| LYM883 | 73874.3 | 7.8 | 0.08 | 58 | 157.2 | 0.04 | 68 |
| LYM880 | 73589.2 | 7.5 | 0.07 | 51 | 130.1 | 0.13 | 39 |
| LYM880 | 73590.3 | 6.8 | 0.01 | 37 | 122.6 | 0.06 | 31 |
| LYM880 | 73590.4 | 6.2 | 0.12 | 26 | 109.7 | 0.28 | 17 |
| LYM859 | 73892.2 | — | — | — | 106.1 | 0.19 | 14 |
| LYM859 | 73893.3 | 6.1 | 0.27 | 22 | — | — | — |
| LYM846 | 73609.1 | 7.8 | 0.07 | 57 | 132.8 | 0.23 | 42 |
| LYM846 | 73609.3 | 7.6 | 0.16 | 54 | 136.8 | 0.20 | 46 |
| LYM832 | 73663.4 | 8.4 | L | 69 | 152.8 | 0.10 | 63 |
| LYM823 | 73655.2 | 8.3 | 0.02 | 67 | 146.2 | 0.06 | 56 |
| LYM823 | 73655.4 | 8.4 | L | 70 | 157.1 | 0.02 | 68 |
| LYM823 | 73655.5 | 7.2 | 0.09 | 46 | 133.0 | 0.14 | 42 |
| LYM823 | 73657.3 | 9.3 | L | 87 | 169.7 | 0.06 | 82 |
| LYM814 | 73649.3 | 5.9 | 0.18 | 18 | — | — | — |
| LYM814 | 73649.5 | 6.7 | 0.07 | 35 | 125.0 | 0.12 | 34 |
| LYM777 | 73942.2 | 6.0 | 0.30 | 20 | — | — | — |
| LYM777 | 73943.1 | 8.8 | L | 77 | 189.1 | L | 102 |
| LYM777 | 73943.4 | 6.9 | 0.10 | 39 | — | — | — |
| LYM752 | 73218.3 | 6.5 | 0.07 | 31 | 124.7 | 0.11 | 33 |
| CONT. | — | 5.0 | — | — | 93.4 | — | — |
| LYM975 | 74368.2 | 6.5 | 0.17 | 21 | 130.4 | 0.05 | 36 |
| LYM975 | 74369.1 | 9.5 | L | 77 | 148.6 | 0.04 | 54 |
| LYM975 | 74370.2 | 9.1 | L | 68 | 162.7 | 0.02 | 69 |
| LYM929 | 74473.3 | 7.6 | 0.06 | 41 | 153.1 | 0.09 | 59 |
| LYM912 | 73742.2 | 7.7 | 0.19 | 42 | 127.9 | 0.27 | 33 |
| LYM912 | 73745.5 | 8.9 | 0.15 | 66 | 157.9 | 0.24 | 64 |
| LYM912 | 73746.2 | 9.2 | 0.06 | 71 | 144.5 | 0.18 | 50 |
| LYM912 | 73747.4 | 6.3 | 0.22 | 17 | — | — | — |
| LYM852 | 73888.5 | 6.3 | 0.18 | 18 | — | — | — |
| LYM852 | 73890.3 | 10.2 | 0.06 | 90 | 166.1 | 0.13 | 73 |
| LYM841 | 73672.1 | 6.6 | 0.17 | 23 | — | — | — |
| LYM800 | 74579.2 | — | — | — | 121.9 | 0.27 | 27 |
| LYM786 | 74379.2 | 8.1 | L | 51 | 135.1 | 0.04 | 40 |
| LYM754 | 74543.6 | — | — | — | 136.1 | 0.08 | 41 |
| CONT. | — | 5.4 | — | — | 96.2 | — | — |
| LYM995 | 76196.4 | — | — | — | 101.8 | 0.19 | 21 |
| LYM995 | 76197.3 | 4.6 | 0.14 | 20 | — | — | — |
| LYM995 | 76200.1 | 5.9 | 0.05 | 53 | 127.1 | 0.10 | 52 |
| LYM994 | 75658.2 | 5.3 | 0.08 | 37 | 111.5 | 0.03 | 33 |
| LYM994 | 75659.1 | 5.7 | 0.13 | 48 | 125.0 | 0.13 | 49 |
| LYM994 | 75659.2 | 6.1 | L | 58 | 128.9 | 0.11 | 54 |
| LYM983 | 76016.1 | 5.0 | 0.18 | 29 | 104.2 | 0.05 | 24 |
| LYM983 | 76016.2 | — | — | — | 102.1 | 0.21 | 22 |
| LYM983 | 76017.2 | 6.9 | 0.12 | 79 | 147.5 | 0.10 | 76 |
| LYM983 | 76019.4 | 4.9 | 0.27 | 27 | — | — | — |
| LYM965 | 75726.1 | — | — | — | 100.6 | 0.22 | 20 |
| LYM965 | 75728.2 | 5.5 | 0.16 | 44 | 125.3 | 0.22 | 50 |
| LYM965 | 75730.4 | 5.4 | 0.20 | 40 | 123.3 | 0.08 | 47 |
| LYM961 | 75591.1 | 5.3 | 0.23 | 38 | — | — | — |
| LYM961 | 75594.2 | 5.3 | 0.14 | 39 | 119.5 | 0.13 | 43 |
| LYM961 | 75594.4 | 5.4 | 0.02 | 40 | 113.8 | 0.01 | 36 |
| LYM948 | 75639.3 | 5.9 | 0.02 | 53 | 124.4 | 0.02 | 49 |
| LYM948 | 75640.1 | 5.4 | 0.08 | 40 | 117.9 | 0.07 | 41 |
| LYM948 | 75643.1 | 5.9 | 0.02 | 53 | 127.5 | L | 52 |
| LYM948 | 75643.2 | 6.8 | 0.02 | 77 | 137.9 | L | 65 |
| LYM946 | 75675.4 | 5.5 | 0.04 | 42 | 121.5 | L | 45 |
| LYM946 | 75677.3 | 5.6 | 0.03 | 45 | 120.5 | 0.04 | 44 |
| LYM946 | 75677.4 | 5.0 | 0.10 | 29 | — | — | — |
| LYM934 | 75928.2 | 7.2 | 0.11 | 87 | 150.4 | 0.10 | 79 |
| LYM934 | 75928.3 | 4.6 | 0.24 | 19 | 107.2 | 0.10 | 28 |
| LYM934 | 75928.4 | — | — | — | 106.1 | 0.10 | 27 |
| LYM934 | 75928.5 | — | — | — | 112.2 | 0.25 | 34 |
| LYM914 | 75369.1 | — | — | — | 107.3 | 0.25 | 28 |
| LYM914 | 75371.4 | 5.0 | 0.16 | 30 | 101.9 | 0.11 | 22 |
| LYM914 | 75372.3 | 4.7 | 0.21 | 22 | — | — | — |
| LYM865 | 75471.1 | 4.9 | 0.25 | 27 | 105.4 | 0.27 | 26 |
| LYM865 | 75471.4 | 5.5 | 0.08 | 44 | 126.0 | 0.13 | 50 |
| LYM865 | 75475.2 | 5.2 | 0.04 | 36 | 113.2 | L | 35 |
| LYM865 | 75475.3 | — | — | — | 111.9 | 0.13 | 33 |
| LYM865 | 75475.4 | 5.1 | 0.03 | 33 | 102.0 | 0.08 | 22 |
| LYM845 | 75742.1 | 5.4 | 0.02 | 40 | 115.8 | 0.02 | 38 |
| LYM798 | 75663.3 | 6.8 | 0.01 | 77 | 138.8 | L | 66 |
| LYM798 | 75664.1 | — | — | — | 103.2 | 0.27 | 23 |
| LYM798 | 75664.4 | 4.7 | 0.19 | 23 | 107.2 | 0.08 | 28 |
| LYM798 | 75665.1 | 6.0 | L | 55 | 127.1 | 0.01 | 52 |
| LYM774 | 75700.1 | — | — | — | 96.2 | 0.26 | 15 |
| LYM774 | 75700.2 | — | — | — | 106.6 | 0.23 | 27 |
| LYM774 | 75700.3 | 5.3 | 0.14 | 38 | 123.3 | L | 47 |
| LYM774 | 75701.4 | 4.6 | 0.28 | 19 | 104.0 | 0.17 | 24 |
| LYM765 | 75603.1 | 5.5 | 0.09 | 42 | 130.1 | 0.02 | 55 |
| LYM765 | 75604.2 | 6.0 | L | 55 | 123.6 | L | 48 |
| LYM765 | 75606.2 | 6.2 | 0.08 | 60 | 133.3 | 0.08 | 59 |
| LYM765 | 75606.4 | 4.6 | 0.21 | 19 | — | — | — |
| LYM1002 | 75636.2 | 6.2 | 0.02 | 62 | 140.3 | L | 67 |
| LYM1002 | 75636.5 | 4.8 | 0.10 | 23 | 101.4 | 0.10 | 21 |
| CONT. | — | 3.9 | — | — | 83.8 | — | — |
| LYM955 | 75360.2 | — | — | — | 125.1 | 0.19 | 12 |
| LYM955 | 75360.4 | — | — | — | 130.3 | 0.20 | 17 |
| LYM945 | 75585.2 | 7.3 | 0.02 | 29 | 146.4 | 0.02 | 31 |
| LYM945 | 75585.4 | 7.7 | 0.01 | 37 | 157.3 | L | 41 |
| LYM945 | 75587.1 | 6.8 | 0.09 | 20 | 140.6 | 0.02 | 26 |
| LYM945 | 75587.2 | — | — | — | 134.7 | 0.09 | 21 |
| LYM945 | 75587.3 | — | — | — | 135.4 | 0.18 | 21 |
| LYM941 | 75582.1 | — | — | — | 140.9 | 0.11 | 26 |
| LYM941 | 75583.1 | 8.9 | 0.16 | 58 | 178.5 | 0.14 | 60 |
| LYM926 | 75575.1 | 7.1 | 0.24 | 26 | 132.1 | 0.10 | 19 |
| LYM926 | 75577.2 | 7.4 | 0.26 | 31 | 147.0 | 0.19 | 32 |
| LYM921 | 75376.2 | — | — | — | 128.0 | 0.06 | 15 |
| LYM890 | 75722.5 | 6.6 | 0.11 | 16 | 134.6 | 0.04 | 21 |
| LYM890 | 75723.5 | 7.4 | 0.08 | 32 | 164.5 | 0.02 | 48 |
| LYM801 | 75557.4 | — | — | — | 129.9 | 0.24 | 17 |
| LYM799 | 73689.7 | 6.3 | 0.29 | 12 | — | — | — |
| LYM793 | 75551.2 | — | — | — | 126.6 | 0.20 | 14 |
| LYM793 | 75553.1 | — | — | — | 130.2 | 0.04 | 17 |
| LYM793 | 75553.2 | 7.6 | L | 35 | 132.6 | 0.16 | 19 |
| LYM788 | 75544.1 | 8.1 | L | 44 | 175.0 | L | 57 |
| LYM788 | 75544.4 | 8.1 | L | 45 | 130.7 | 0.11 | 17 |
| LYM788 | 75547.1 | — | — | — | 135.6 | 0.15 | 22 |
| LYM780 | 75063.4 | 9.5 | 0.12 | 69 | 160.3 | 0.16 | 44 |
| LYM776 | 75599.4 | — | — | — | 136.9 | 0.10 | 23 |
| LYM768 | 75538.1 | 12.8 | 0.02 | 128 | 223.3 | 0.03 | 100 |
| LYM768 | 75539.1 | 7.4 | 0.05 | 31 | 156.6 | L | 41 |
| LYM768 | 75540.1 | 6.9 | 0.06 | 22 | 132.6 | 0.02 | 19 |
| LYM756 | 75526.1 | 7.4 | 0.14 | 32 | 169.0 | 0.04 | 52 |
| CONT. | — | 5.6 | — | — | 111.4 | — | — |
| LYM979 | 74244.2 | 5.0 | 0.04 | 56 | 63.9 | 0.22 | 36 |
| LYM979 | 74244.3 | 4.5 | 0.04 | 43 | — | — | — |
| CONT. | — | 3.2 | — | — | 47.1 | — | — |
| LYM977 | 73616.2 | 6.6 | 0.17 | 37 | — | — | — |
| LYM977 | 73617.5 | 6.3 | 0.22 | 31 | — | — | — |
| LYM977 | 73618.2 | 7.2 | 0.09 | 49 | 149.9 | 0.07 | 55 |
| LYM976 | 74030.1 | 8.2 | 0.01 | 69 | 157.2 | 0.03 | 63 |
| LYM976 | 74033.1 | 8.1 | 0.11 | 66 | 167.2 | 0.07 | 73 |
| LYM976 | 74034.1 | 7.0 | 0.08 | 45 | 137.5 | 0.17 | 42 |
| LYM975 | 74369.1 | 7.6 | 0.06 | 57 | 141.0 | 0.12 | 46 |
| LYM975 | 74370.2 | 9.2 | 0.02 | 91 | 172.7 | 0.07 | 79 |
| LYM944 | 73294.2 | 8.2 | 0.22 | 70 | 164.8 | 0.03 | 71 |
| LYM930 | 73778.1 | 7.7 | 0.06 | 59 | 136.8 | 0.17 | 42 |
| LYM928 | 73775.4 | 6.4 | 0.22 | 32 | — | — | — |
| LYM928 | 73777.2 | 7.0 | 0.14 | 45 | 149.5 | 0.06 | 55 |
| LYM928 | 73777.5 | 8.0 | 0.06 | 64 | 143.0 | 0.19 | 48 |
| LYM925 | 73760.3 | 6.2 | 0.29 | 28 | — | — | — |
| LYM925 | 73763.4 | 8.0 | 0.03 | 65 | 152.7 | 0.05 | 58 |
| LYM883 | 73874.3 | — | — | — | 124.4 | 0.28 | 29 |
| LYM883 | 73878.2 | 10.5 | L | 118 | 178.6 | L | 85 |
| LYM859 | 73896.1 | 7.9 | 0.03 | 63 | 150.3 | 0.05 | 56 |
| LYM856 | 74139.2 | 6.3 | 0.22 | 31 | 128.6 | 0.21 | 33 |
| LYM856 | 74140.4 | 8.5 | 0.04 | 76 | 156.3 | 0.06 | 62 |
| LYM848 | 73695.1 | 7.8 | 0.03 | 61 | 138.4 | 0.15 | 43 |

TABLE 106-continued

Genes showing improved plant performance at Normal growth conditions under regulation of At6669 promoter

| Gene Name | Event # | Dry Weight [mg] Ave. | P-Val. | % Incr. | Fresh Weight [mg] Ave. | P-Val. | % Incr. |
|---|---|---|---|---|---|---|---|
| LYM818 | 74132.1 | 10.0 | L | 107 | 172.2 | 0.04 | 78 |
| LYM818 | 74132.2 | 7.3 | 0.14 | 52 | 138.5 | 0.19 | 43 |
| LYM818 | 74134.1 | 6.2 | 0.27 | 28 | — | — | — |
| LYM818 | 74136.3 | 7.9 | 0.03 | 63 | 143.2 | 0.08 | 48 |
| LYM760 | 73935.6 | 7.2 | 0.12 | 49 | 138.0 | 0.16 | 43 |
| LYM760 | 73939.3 | 6.9 | 0.13 | 42 | 128.8 | 0.25 | 33 |
| LYM753 | 74039.4 | — | — | — | 126.8 | 0.25 | 31 |
| CONT. | — | 4.8 | — | — | 96.5 | — | — |
| LYM988 | 75013.2 | 7.8 | L | 102 | 126.3 | L | 77 |
| LYM988 | 75013.3 | 6.7 | 0.01 | 75 | 119.9 | 0.08 | 68 |
| LYM988 | 75014.1 | 7.4 | 0.04 | 93 | 127.2 | 0.04 | 79 |
| LYM988 | 75014.2 | 7.1 | 0.04 | 86 | 123.4 | L | 73 |
| LYM988 | 75014.5 | — | — | — | 83.8 | 0.10 | 18 |
| LYM960 | 75008.1 | 5.7 | 0.05 | 48 | 105.9 | 0.05 | 49 |
| LYM960 | 75009.1 | 8.2 | 0.02 | 114 | 131.9 | 0.01 | 85 |
| LYM960 | 75010.1 | 9.3 | L | 143 | 163.2 | L | 129 |
| LYM960 | 75010.2 | 5.4 | 0.19 | 40 | 105.2 | 0.15 | 48 |
| LYM960 | 75011.1 | 6.9 | L | 79 | 129.8 | L | 82 |
| LYM876 | 75902.1 | 7.1 | L | 86 | 125.7 | L | 77 |
| LYM876 | 75903.2 | 5.9 | 0.04 | 54 | 109.4 | L | 54 |
| LYM876 | 75904.2 | 5.8 | 0.10 | 51 | — | — | — |
| LYM862 | 75907.2 | — | — | — | 94.3 | 0.30 | 32 |
| LYM843 | 75293.1 | 5.4 | 0.01 | 40 | 109.8 | 0.02 | 54 |
| LYM843 | 75293.2 | — | — | — | 115.9 | 0.29 | 63 |
| LYM836 | 75567.2 | 6.0 | L | 58 | 108.3 | L | 52 |
| LYM836 | 75568.1 | 5.2 | 0.17 | 35 | 109.4 | 0.04 | 54 |
| LYM836 | 75569.6 | 7.4 | L | 92 | 118.3 | 0.02 | 66 |
| LYM836 | 75570.2 | 4.9 | 0.10 | 28 | 83.3 | 0.20 | 17 |
| LYM836 | 75571.2 | 8.0 | L | 108 | 139.9 | L | 97 |
| LYM819 | 75564.1 | 6.8 | 0.12 | 77 | 116.8 | 0.12 | 64 |
| LYM819 | 75564.2 | 6.1 | 0.16 | 59 | 97.8 | 0.26 | 37 |
| LYM819 | 75564.3 | 6.1 | 0.11 | 59 | 114.3 | 0.11 | 61 |
| LYM819 | 75565.1 | 4.7 | 0.16 | 22 | 83.7 | 0.07 | 18 |
| CONT. | — | 3.8 | — | — | 71.2 | — | — |

Table 106. "CONT."—Control; "Ave."—Average; "% Incr." = % increment; "p-val."—p-value, L—p < 0.01.

The genes presented in Tables 107 and 108 show a significant improvement in plant performance since they produced a larger leaf biomass (leaf area) and root biomass (root length and root coverage) (Table 107) and a higher relative growth rate of leaf area, root coverage and root length (Table 108) when grown under normal growth conditions, compared to control plants grown under identical growth conditions. Plants to producing larger root biomass have better possibilities to absorb larger amount of nitrogen from soil. Plants producing larger leaf biomass have better ability to produce assimilates. The genes were cloned under the regulation of a constitutive promoter (At6669, SEQ ID NO:10575). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 107

Genes showing improved plant performance at Normal growth conditions under regulation of At6669 promoter

| Gene Name | Event # | Leaf Area [cm²] Ave. | P-Val. | % Incr. | Roots Coverage [cm²] Ave. | P-Val. | % Incr. | Roots Length [cm] Ave. | P-Val. | % Incr. |
|---|---|---|---|---|---|---|---|---|---|---|
| LYM994 | 75658.2 | 0.5 | 0.09 | 15 | 5.6 | 0.05 | 25 | — | — | — |
| LYM994 | 75659.2 | — | — | — | 6.0 | 0.02 | 35 | 6.9 | L | 21 |
| LYM994 | 75659.3 | 0.5 | 0.26 | 13 | 5.8 | 0.06 | 29 | 6.5 | 0.03 | 14 |
| LYM983 | 76016.1 | 0.7 | 0.04 | 40 | 6.8 | 0.10 | 52 | 6.3 | 0.08 | 10 |
| LYM983 | 76016.2 | 0.7 | L | 42 | 7.5 | 0.01 | 67 | 6.8 | L | 19 |
| LYM983 | 76017.2 | 0.7 | 0.09 | 58 | 7.4 | 0.09 | 67 | 7.1 | L | 24 |
| LYM983 | 76019.4 | — | — | — | — | — | — | 6.2 | 0.06 | 9 |
| LYM983 | 76020.2 | 0.7 | 0.03 | 49 | — | — | — | — | — | — |
| LYM961 | 75593.2 | 0.7 | 0.01 | 58 | 7.5 | L | 69 | 6.6 | L | 16 |
| LYM961 | 75594.2 | 0.6 | L | 26 | 6.1 | 0.10 | 38 | — | — | — |
| LYM948 | 75639.3 | 0.7 | L | 41 | 6.9 | 0.04 | 55 | 6.3 | 0.21 | 9 |
| LYM948 | 75643.2 | 0.7 | L | 48 | — | — | — | 6.1 | 0.10 | 7 |
| LYM946 | 75675.10 | 0.5 | 0.19 | 12 | — | — | — | — | — | — |
| LYM946 | 75675.4 | 0.6 | L | 23 | — | — | — | — | — | — |
| LYM946 | 75677.4 | 0.6 | 0.03 | 30 | 7.1 | 0.03 | 59 | 6.6 | L | 15 |
| LYM934 | 75928.2 | — | — | — | — | — | — | 6.6 | L | 15 |
| LYM934 | 75928.4 | 0.6 | 0.13 | 21 | — | — | — | 6.1 | 0.17 | 6 |
| LYM934 | 75928.5 | 0.6 | 0.01 | 36 | 6.4 | L | 44 | 6.3 | 0.02 | 11 |
| LYM934 | 75929.1 | 0.6 | 0.09 | 28 | 6.4 | 0.15 | 43 | 6.6 | 0.10 | 15 |
| LYM914 | 75369.1 | 0.7 | L | 51 | 5.2 | 0.16 | 17 | — | — | — |
| LYM914 | 75371.4 | 0.5 | 0.21 | 11 | 5.2 | 0.18 | 17 | — | — | — |
| LYM914 | 75372.1 | 0.5 | 0.24 | 11 | — | — | — | — | — | — |
| LYM914 | 75372.2 | 0.6 | L | 38 | 6.7 | 0.04 | 51 | 6.8 | 0.07 | 18 |
| LYM914 | 75372.3 | 0.5 | 0.28 | 13 | — | — | — | — | — | — |
| LYM906 | 76071.3 | 0.7 | 0.03 | 41 | — | — | — | — | — | — |
| LYM906 | 76072.1 | 0.6 | 0.07 | 18 | — | — | — | — | — | — |
| LYM906 | 76075.1 | 0.5 | 0.12 | 14 | — | — | — | — | — | — |
| LYM888_H1 | 76068.3 | 0.6 | L | 31 | — | — | — | — | — | — |
| LYM888_H1 | 76068.5 | 0.8 | L | 65 | 8.4 | 0.02 | 89 | 6.4 | 0.05 | 12 |

TABLE 107-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM865 | 75471.1 | — | — | — | — | — | — | 6.4 | 0.09 | 12 |
| LYM865 | 75471.4 | — | — | — | — | — | — | 6.1 | 0.29 | 7 |
| LYM865 | 75475.2 | 0.6 | 0.02 | 28 | 7.0 | 0.02 | 57 | 6.9 | L | 20 |
| LYM865 | 75475.3 | — | — | — | — | — | — | 6.2 | 0.11 | 9 |
| LYM845 | 75742.1 | 0.5 | 0.19 | 13 | 5.8 | 0.15 | 29 | 6.2 | 0.19 | 8 |
| LYM845 | 75742.2 | 0.5 | 0.21 | 12 | 7.4 | L | 65 | 6.7 | 0.01 | 17 |
| LYM845 | 75745.3 | 0.5 | 0.29 | 7 | — | — | — | — | — | — |
| LYM830_H4 | 76061.1 | 0.8 | 0.02 | 68 | 7.2 | 0.11 | 62 | — | — | — |
| LYM830_H4 | 76064.1 | 0.8 | L | 62 | 7.5 | L | 69 | 6.7 | L | 17 |
| LYM830_H4 | 76065.1 | 0.7 | 0.06 | 39 | 7.0 | 0.06 | 57 | 6.6 | 0.02 | 16 |
| LYM765 | 75603.1 | 0.7 | L | 58 | 8.6 | L | 93 | 7.3 | L | 27 |
| LYM765 | 75604.2 | 0.6 | 0.06 | 32 | — | — | — | — | — | — |
| LYM765 | 75606.2 | 0.5 | 0.18 | 9 | 5.4 | 0.24 | 21 | — | — | — |
| LYM765 | 75606.4 | 0.6 | 0.15 | 21 | — | — | — | — | — | — |
| LYM1002 | 75636.4 | 0.7 | L | 43 | 7.6 | L | 70 | 6.6 | L | 15 |
| LYM1002 | 75637.1 | 0.6 | 0.01 | 24 | 6.0 | 0.17 | 34 | 6.7 | L | 18 |
| CONT. | — | 0.5 | — | — | 4.5 | — | — | 5.7 | — | — |
| LYM998 | 74217.4 | — | — | — | 11.7 | 0.08 | 18 | — | — | — |
| LYM998 | 74219.1 | 0.8 | 0.03 | 27 | 13.6 | 0.04 | 37 | — | — | — |
| LYM998 | 74219.2 | — | — | — | 12.4 | 0.02 | 24 | 8.4 | 0.25 | 4 |
| LYM972 | 74510.1 | 0.8 | 0.16 | 19 | — | — | — | — | — | — |
| LYM966 | 74524.1 | 0.7 | 0.16 | 16 | 11.2 | 0.30 | 13 | — | — | — |
| LYM954 | 74496.2 | 0.7 | 0.21 | 16 | 13.7 | 0.03 | 38 | 8.5 | 0.03 | 5 |
| LYM920 | 74464.1 | 0.7 | 0.29 | 8 | 11.6 | 0.03 | 17 | 8.4 | 0.15 | 4 |
| LYM917 | 74456.1 | — | — | — | — | — | — | 8.5 | L | 6 |
| LYM886 | 74446.4 | 0.7 | 0.09 | 13 | — | — | — | — | — | — |
| LYM886 | 74447.6 | — | — | — | 11.0 | 0.21 | 11 | 8.5 | 0.02 | 5 |
| LYM886 | 74448.4 | — | — | — | 11.7 | 0.23 | 18 | — | — | — |
| LYM857 | 74398.2 | — | — | — | — | — | — | 8.4 | 0.13 | 3 |
| LYM857 | 74400.1 | — | — | — | 12.4 | 0.03 | 25 | 8.4 | 0.02 | 4 |
| LYM811 | 74385.2 | 0.9 | 0.02 | 47 | 14.8 | 0.01 | 49 | 8.6 | 0.02 | 7 |
| LYM811 | 74386.1 | 0.7 | 0.14 | 16 | 13.1 | 0.12 | 32 | 8.5 | 0.05 | 5 |
| LYM811 | 74388.2 | — | — | — | 12.3 | 0.24 | 23 | 8.7 | 0.03 | 7 |
| LYM811 | 74388.3 | 0.8 | 0.07 | 23 | 12.3 | 0.18 | 24 | — | — | — |
| LYM783 | 74373.2 | — | — | — | 13.9 | 0.11 | 40 | 8.4 | 0.28 | 3 |
| LYM783 | 74374.1 | 0.9 | 0.12 | 39 | 16.8 | L | 69 | 8.8 | 0.01 | 9 |
| LYM1004 | 74336.2 | 0.8 | 0.04 | 22 | — | — | — | — | — | — |
| LYM1004 | 74336.3 | 0.7 | 0.13 | 14 | 12.9 | L | 30 | 8.5 | 0.02 | 5 |
| LYM1004 | 74338.2 | — | — | — | 11.4 | 0.22 | 15 | — | — | — |
| LYM1004 | 74340.1 | — | — | — | 13.5 | 0.05 | 36 | 8.6 | 0.02 | 6 |
| CONT. | — | 0.6 | — | — | 9.9 | — | — | 8.1 | — | — |
| LYM798 | 75664.1 | 0.9 | L | 43 | 8.8 | 0.13 | 20 | — | — | — |
| LYM798 | 75664.4 | 0.6 | 0.19 | 6 | — | — | — | — | — | — |
| LYM798 | 75665.3 | 0.9 | L | 52 | 10.7 | L | 45 | — | — | — |
| CONT. | — | 0.6 | — | — | 7.4 | — | — | — | — | — |
| LYM977 | 73617.5 | 0.5 | 0.07 | 22 | — | — | — | — | — | — |
| LYM977 | 73618.2 | 0.5 | 0.03 | 30 | 9.5 | 0.03 | 21 | — | — | — |
| LYM976 | 74030.1 | 0.5 | 0.03 | 35 | — | — | — | — | — | — |
| LYM976 | 74033.1 | 0.5 | 0.08 | 17 | — | — | — | — | — | — |
| LYM976 | 74034.1 | 0.5 | 0.05 | 26 | 10.6 | 0.07 | 35 | — | — | — |
| LYM976 | 74034.2 | 0.5 | 0.16 | 37 | — | — | — | — | — | — |
| LYM976 | 74034.3 | 0.5 | 0.10 | 38 | — | — | — | — | — | — |
| LYM958 | 73556.3 | 0.5 | 0.26 | 17 | 11.4 | 0.03 | 46 | 8.8 | 0.02 | 9 |
| LYM958 | 73556.4 | 0.6 | 0.05 | 41 | 9.6 | 0.18 | 23 | — | — | — |
| LYM944 | 73294.2 | 0.6 | 0.14 | 40 | 11.3 | 0.19 | 44 | — | — | — |
| LYM944 | 73294.3 | — | — | — | 9.1 | 0.13 | 16 | — | — | — |
| LYM944 | 73295.2 | 0.6 | 0.04 | 47 | 13.5 | L | 73 | 8.8 | L | 10 |
| LYM856 | 74139.2 | 0.5 | 0.14 | 17 | — | — | — | — | — | — |
| LYM856 | 74140.2 | 0.6 | L | 55 | 11.4 | 0.02 | 46 | 8.5 | 0.24 | 5 |
| LYM856 | 74140.4 | 0.5 | L | 37 | 9.1 | 0.17 | 17 | 8.4 | 0.23 | 4 |
| LYM856 | 74141.1 | 0.6 | 0.15 | 40 | — | — | — | 8.4 | 0.29 | 4 |
| LYM846 | 73606.3 | 0.5 | 0.04 | 35 | — | — | — | — | — | — |
| LYM846 | 73608.5 | 0.5 | L | 37 | 10.3 | L | 32 | — | — | — |
| LYM846 | 73609.1 | 0.5 | 0.20 | 24 | 10.6 | 0.21 | 36 | — | — | — |
| LYM846 | 73609.3 | 0.5 | 0.07 | 33 | 11.0 | 0.14 | 41 | — | — | — |
| LYM846 | 73609.5 | — | — | — | 9.8 | 0.14 | 25 | — | — | — |
| LYM832 | 73660.6 | 0.5 | 0.03 | 34 | 9.3 | 0.21 | 19 | 8.4 | 0.19 | 5 |
| LYM832 | 73663.1 | 0.5 | 0.07 | 24 | 10.0 | 0.06 | 28 | — | — | — |
| LYM823 | 73655.2 | 0.5 | 0.15 | 14 | — | — | — | — | — | — |
| LYM823 | 73655.4 | 0.5 | 0.29 | 16 | 9.8 | 0.28 | 25 | — | — | — |
| LYM823 | 73655.5 | 0.5 | 0.05 | 35 | — | — | — | — | — | — |

TABLE 107-continued

Genes showing improved plant performance at Normal growth conditions under regulation of At6669 promoter

| | | Leaf Area [cm²] | | | Roots Coverage [cm²] | | | Roots Length [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LYM823 | 73657.2 | 0.6 | 0.02 | 63 | 12.2 | L | 56 | 8.8 | 0.02 | 9 |
| LYM823 | 73657.3 | 0.5 | 0.20 | 23 | 9.0 | 0.23 | 15 | — | — | — |
| LYM818 | 74132.1 | 0.5 | 0.08 | 17 | 9.7 | 0.19 | 24 | 8.4 | 0.18 | 5 |
| LYM818 | 74133.2 | 0.5 | 0.28 | 16 | — | — | — | — | — | — |
| LYM818 | 74136.1 | 0.6 | 0.01 | 43 | 9.3 | 0.28 | 19 | — | — | — |
| LYM818 | 74136.3 | 0.5 | 0.05 | 37 | 11.6 | L | 49 | 8.7 | L | 8 |
| LYM814 | 73648.2 | 0.5 | 0.09 | 23 | 10.0 | 0.02 | 28 | 8.6 | 0.10 | 7 |
| LYM814 | 73648.4 | 0.5 | 0.10 | 35 | — | — | — | — | — | — |
| LYM814 | 73651.3 | 0.6 | 0.02 | 40 | 10.3 | 0.15 | 32 | — | — | — |
| LYM777 | 73941.3 | 0.6 | 0.01 | 50 | 9.8 | 0.12 | 25 | — | — | — |
| LYM777 | 73942.2 | — | — | — | — | — | — | 8.5 | 0.22 | 5 |
| LYM777 | 73943.1 | 0.4 | 0.18 | 13 | — | — | — | 8.5 | 0.06 | 6 |
| LYM760 | 73934.2 | 0.5 | 0.06 | 22 | 9.3 | 0.20 | 19 | — | — | — |
| LYM760 | 73935.6 | 0.5 | 0.18 | 20 | 9.9 | 0.11 | 27 | 8.4 | 0.26 | 4 |
| LYM760 | 73939.4 | — | — | — | — | — | — | 8.4 | 0.22 | 5 |
| LYM753 | 74037.2 | 0.6 | 0.12 | 51 | — | — | — | — | — | — |
| LYM753 | 74039.5 | 0.6 | 0.02 | 55 | 10.5 | 0.02 | 35 | — | — | — |
| LYM753 | 74040.3 | — | — | — | 9.6 | 0.14 | 23 | — | — | — |
| LYM752 | 73214.1 | 0.5 | 0.07 | 32 | — | — | — | — | — | — |
| LYM752 | 73215.2 | 0.6 | 0.29 | 57 | — | — | — | — | — | — |
| CONT. | — | 0.4 | — | — | 7.8 | — | — | 8.1 | — | — |
| LYM997 | 74691.2 | — | — | — | — | — | — | 8.3 | 0.06 | 8 |
| LYM997 | 74692.2 | — | — | — | — | — | — | 7.9 | 0.21 | 3 |
| LYM997 | 74694.1 | 0.6 | 0.03 | 37 | 10.2 | 0.06 | 35 | 8.2 | 0.07 | 8 |
| LYM990 | 74643.2 | 0.5 | 0.15 | 13 | — | — | — | 8.3 | L | 8 |
| LYM982 | 74709.1 | 0.6 | 0.10 | 29 | — | — | — | — | — | — |
| LYM982 | 74709.3 | 0.6 | 0.01 | 21 | 9.8 | 0.06 | 29 | 7.9 | 0.23 | 3 |
| LYM980 | 74589.1 | — | — | — | 8.8 | 0.26 | 15 | — | — | — |
| LYM980 | 74593.2 | — | — | — | — | — | — | 8.1 | 0.18 | 5 |
| LYM980 | 74593.5 | 0.6 | L | 26 | — | — | — | 8.0 | 0.12 | 5 |
| LYM935 | 74654.1 | — | — | — | — | — | — | 7.9 | 0.26 | 3 |
| LYM935 | 74655.1 | 0.6 | 0.20 | 17 | — | — | — | — | — | — |
| LYM930 | 73779.3 | 0.6 | 0.12 | 32 | 9.5 | 0.07 | 25 | — | — | — |
| LYM930 | 73783.1 | 0.6 | 0.09 | 23 | — | — | — | — | — | — |
| LYM857 | 74396.2 | — | — | — | 9.0 | 0.13 | 19 | — | — | — |
| LYM857 | 74398.1 | — | — | — | — | — | — | 8.3 | 0.05 | 8 |
| LYM857 | 74400.1 | 0.7 | L | 45 | 10.0 | 0.01 | 32 | — | — | — |
| LYM820 | 74585.1 | 0.7 | 0.04 | 47 | 11.5 | L | 51 | 8.2 | L | 8 |
| LYM820 | 74587.1 | 0.6 | 0.02 | 27 | 9.2 | 0.21 | 21 | 8.0 | 0.19 | 4 |
| LYM783 | 74372.1 | — | — | — | 9.7 | 0.16 | 28 | — | — | — |
| LYM783 | 74377.2 | 0.6 | 0.08 | 33 | 11.7 | 0.09 | 54 | 8.2 | 0.07 | 7 |
| LYM762 | 73148.4 | — | — | — | 8.5 | 0.15 | 11 | 8.0 | 0.18 | 5 |
| LYM762 | 73149.1 | — | — | — | 8.7 | 0.16 | 14 | — | — | — |
| LYM762 | 73149.3 | 0.8 | 0.05 | 61 | 9.4 | 0.13 | 24 | — | — | — |
| CONT. | — | 0.5 | — | — | 7.6 | — | — | 7.7 | — | — |
| LYM882 | 74442.1 | 0.8 | 0.08 | 14 | 14.7 | 0.10 | 17 | 8.7 | 0.10 | 4 |
| LYM802 | 74437.3 | 0.8 | 0.07 | 17 | — | — | — | 8.8 | 0.06 | 5 |
| LYM782 | 74810.1 | 0.8 | L | 22 | — | — | — | — | — | — |
| LYM771 | 74528.1 | 0.8 | 0.02 | 19 | — | — | — | — | — | — |
| LYM771 | 74529.1 | 0.9 | 0.04 | 32 | 14.7 | 0.10 | 18 | 8.6 | 0.17 | 4 |
| LYM771 | 74530.2 | 0.9 | 0.03 | 27 | — | — | — | — | — | — |
| LYM771 | 74532.1 | 0.8 | 0.17 | 14 | — | — | — | — | — | — |
| CONT. | — | 0.7 | — | — | 12.5 | — | — | 8.3 | — | — |
| LYM992 | 74648.1 | 0.5 | 0.05 | 66 | 7.1 | L | 56 | 7.4 | 0.04 | 8 |
| LYM992 | 74649.3 | 0.4 | 0.13 | 24 | — | — | — | 7.3 | 0.18 | 7 |
| LYM992 | 74649.4 | 0.5 | L | 55 | 6.1 | 0.03 | 34 | 7.5 | 0.03 | 10 |
| LYM992 | 74651.2 | 0.5 | 0.01 | 57 | 6.2 | 0.01 | 35 | — | — | — |
| LYM992 | 74653.4 | 0.4 | L | 36 | 5.9 | 0.18 | 30 | — | — | — |
| LYM953 | 74486.3 | 0.4 | L | 37 | 6.3 | 0.01 | 38 | 8.2 | L | 19 |
| LYM953 | 74487.1 | 0.4 | 0.04 | 26 | — | — | — | — | — | — |
| LYM953 | 74488.1 | 0.5 | 0.02 | 48 | — | — | — | — | — | — |
| LYM953 | 74491.2 | 0.5 | 0.16 | 75 | 7.2 | 0.26 | 57 | 7.8 | 0.03 | 15 |
| LYM942 | 74661.3 | 0.4 | 0.05 | 35 | — | — | — | — | — | — |
| LYM942 | 74661.5 | 0.4 | 0.05 | 30 | — | — | — | — | — | — |
| LYM942 | 74665.4 | 0.4 | 0.02 | 31 | — | — | — | 7.4 | 0.03 | 8 |
| LYM936 | 74482.1 | 0.4 | 0.12 | 45 | — | — | — | 7.6 | 0.22 | 11 |
| LYM936 | 74482.2 | 0.4 | 0.14 | 30 | 6.5 | 0.30 | 43 | — | — | — |
| LYM936 | 74483.1 | 0.5 | L | 66 | 6.1 | L | 33 | 7.3 | 0.14 | 7 |
| LYM936 | 74484.1 | 0.4 | L | 42 | 7.4 | L | 61 | 7.5 | 0.16 | 10 |
| LYM882 | 74439.2 | 0.4 | 0.01 | 40 | — | — | — | — | — | — |
| LYM882 | 74440.1 | 0.4 | 0.09 | 14 | — | — | — | — | — | — |

TABLE 107-continued

Genes showing improved plant performance at Normal growth conditions under regulation of At6669 promoter

| | | Leaf Area [cm²] | | | Roots Coverage [cm²] | | | Roots Length [cm] | | |
|---|---|---|---|---|---|---|---|---|---|---|
| Gene Name | Event # | Ave. | P-Val. | % Incr. | Ave. | P-Val. | % Incr. | Ave. | P-Val. | % Incr. |
| LYM882 | 74442.2 | 0.4 | 0.16 | 23 | — | — | — | — | — | — |
| LYM879 | 74602.1 | 0.5 | 0.03 | 66 | 6.5 | 0.07 | 41 | 7.7 | 0.04 | 12 |
| LYM879 | 74602.5 | 0.4 | 0.20 | 14 | 5.4 | 0.20 | 17 | — | — | — |
| LYM879 | 74604.2 | 0.5 | 0.08 | 53 | 6.7 | 0.19 | 46 | 7.9 | 0.02 | 15 |
| LYM879 | 74604.5 | 0.4 | 0.04 | 30 | 5.7 | 0.18 | 24 | 7.6 | 0.02 | 12 |
| LYM879 | 74605.1 | 0.4 | L | 28 | 5.6 | 0.08 | 22 | 7.6 | L | 12 |
| LYM840 | 73546.2 | 0.5 | 0.06 | 46 | 6.8 | 0.11 | 50 | — | — | — |
| LYM840 | 73547.1 | 0.4 | 0.19 | 23 | 6.5 | 0.10 | 41 | 7.4 | 0.21 | 9 |
| LYM840 | 73547.2 | 0.5 | 0.05 | 60 | 6.3 | 0.02 | 38 | 7.6 | 0.04 | 11 |
| LYM840 | 73548.1 | 0.4 | 0.01 | 32 | 6.0 | 0.14 | 30 | 7.5 | 0.03 | 10 |
| LYM840 | 73549.1 | 0.4 | L | 38 | 7.5 | L | 64 | 7.3 | 0.30 | 7 |
| LYM796 | 74571.2 | 0.5 | L | 59 | 5.7 | 0.10 | 24 | 7.6 | 0.03 | 11 |
| LYM796 | 74571.3 | 0.5 | 0.05 | 67 | — | — | — | 7.5 | 0.05 | 10 |
| LYM796 | 74573.1 | 0.6 | 0.03 | 109 | 7.1 | 0.07 | 55 | 7.7 | L | 12 |
| LYM796 | 74575.1 | 0.4 | L | 39 | 6.1 | 0.14 | 32 | — | — | — |
| LYM757 | 74427.1 | 0.4 | 0.02 | 19 | — | — | — | — | — | — |
| LYM757 | 74427.4 | 0.6 | L | 83 | 6.4 | 0.05 | 40 | 7.7 | L | 13 |
| LYM757 | 74428.1 | 0.6 | 0.02 | 82 | 7.9 | 0.03 | 72 | 7.8 | L | 14 |
| LYM757 | 74429.2 | 0.6 | L | 83 | 8.4 | L | 85 | 8.3 | L | 22 |
| LYM757 | 74429.3 | 0.4 | 0.01 | 43 | 6.9 | 0.02 | 51 | 7.8 | L | 14 |
| CONT. | — | 0.3 | — | — | 4.6 | — | — | 6.8 | — | — |
| LYM834 | 74629.6 | — | — | — | — | — | — | 7.4 | 0.19 | 4 |
| LYM805 | 74547.1 | 0.8 | 0.17 | 26 | — | — | — | — | — | — |
| LYM805 | 74547.2 | 0.7 | 0.25 | 13 | 9.2 | 0.15 | 18 | 8.0 | L | 12 |
| LYM805 | 74548.1 | 1.0 | L | 63 | 13.2 | L | 70 | 8.1 | 0.01 | 14 |
| LYM805 | 74549.2 | — | — | — | — | — | — | 7.5 | 0.17 | 5 |
| LYM805 | 74550.2 | 0.9 | 0.01 | 36 | 11.3 | 0.02 | 45 | 8.2 | L | 15 |
| LYM796 | 74571.5 | — | — | — | — | — | — | 7.5 | 0.30 | 5 |
| LYM782 | 74810.1 | 0.8 | 0.07 | 24 | 10.3 | 0.10 | 32 | 8.2 | L | 15 |
| LYM782 | 74812.2 | — | — | — | — | — | — | 7.6 | 0.27 | 8 |
| LYM782 | 74814.1 | 0.9 | L | 47 | 10.7 | 0.05 | 37 | 7.8 | L | 10 |
| CONT. | — | 0.6 | — | — | 7.8 | — | — | 7.1 | — | — |
| LYM967 | 74506.2 | — | — | — | 8.9 | 0.28 | 30 | — | — | — |
| LYM956 | 74498.2 | 0.7 | 0.07 | 15 | — | — | — | — | — | — |
| LYM927 | 73769.1 | 0.7 | L | 28 | 10.3 | L | 52 | 8.2 | 0.15 | 4 |
| LYM927 | 73770.2 | — | — | — | 9.4 | 0.11 | 38 | — | — | — |
| LYM899 | 74823.1 | — | — | — | 8.2 | 0.27 | 20 | — | — | — |
| LYM899 | 74826.3 | 0.7 | 0.04 | 18 | 9.0 | 0.04 | 33 | — | — | — |
| LYM802 | 74434.1 | — | — | — | — | — | — | 8.2 | 0.28 | 4 |
| LYM787 | 74568.3 | 0.7 | 0.05 | 16 | 8.1 | 0.09 | 19 | — | — | — |
| LYM770 | 74519.1 | 0.7 | 0.15 | 23 | — | — | — | — | — | — |
| CONT. | — | 0.6 | — | — | 6.8 | — | — | 7.9 | — | — |
| LYM955 | 75360.2 | 0.7 | 0.14 | 16 | — | — | — | — | — | — |
| LYM955 | 75360.3 | 0.8 | 0.02 | 34 | 10.9 | L | 32 | 7.6 | 0.13 | 5 |
| LYM955 | 75360.6 | 0.7 | 0.20 | 23 | 9.9 | 0.05 | 21 | — | — | — |
| LYM921 | 75376.1 | 0.7 | 0.11 | 24 | — | — | — | — | — | — |
| LYM774 | 75699.1 | 0.7 | 0.02 | 23 | — | — | — | — | — | — |
| LYM774 | 75700.1 | 0.8 | L | 40 | 10.5 | 0.10 | 28 | — | — | — |
| LYM774 | 75701.4 | 0.8 | 0.03 | 36 | — | — | — | — | — | — |
| LYM756 | 75528.2 | 0.8 | 0.17 | 30 | — | — | — | — | — | — |
| LYM756 | 75528.3 | 0.8 | 0.03 | 39 | 10.1 | 0.14 | 23 | — | — | — |
| CONT. | — | 0.6 | — | — | 8.2 | — | — | 7.3 | — | — |
| LYM925 | 73760.2 | 0.7 | 0.07 | 45 | 11.0 | 0.12 | 47 | — | — | — |
| LYM925 | 73765.2 | — | — | — | 8.7 | 0.14 | 17 | 8.5 | 0.01 | 10 |
| LYM924 | 73757.4 | 0.7 | L | 58 | 12.3 | 0.04 | 65 | 8.2 | 0.24 | 6 |
| LYM924 | 73758.1 | 0.7 | 0.03 | 57 | 14.2 | L | 89 | 8.6 | L | 12 |
| LYM924 | 73758.3 | 0.8 | L | 65 | 12.5 | L | 67 | 8.4 | 0.06 | 9 |
| LYM919 | 73748.2 | 0.6 | 0.02 | 34 | 9.2 | 0.10 | 23 | — | — | — |
| LYM912 | 73746.2 | 0.5 | 0.20 | 17 | 8.7 | 0.17 | 16 | — | — | — |
| LYM912 | 73747.4 | 0.6 | 0.20 | 27 | 11.5 | 0.05 | 53 | 8.3 | 0.08 | 7 |
| LYM883 | 73874.3 | 0.7 | 0.08 | 42 | 18.4 | L | 146 | 8.5 | 0.02 | 10 |
| LYM883 | 73876.2 | — | — | — | 10.9 | L | 46 | — | — | — |
| LYM883 | 73878.2 | — | — | — | 12.0 | 0.02 | 60 | — | — | — |
| LYM880 | 73589.2 | 0.6 | 0.04 | 30 | 9.8 | 0.06 | 31 | — | — | — |
| LYM880 | 73590.3 | 0.6 | 0.04 | 20 | 9.0 | 0.11 | 19 | — | — | — |
| LYM880 | 73590.4 | 0.6 | 0.04 | 29 | 9.8 | 0.07 | 30 | 8.5 | 0.02 | 9 |
| LYM859 | 73892.2 | 0.5 | 0.27 | 11 | — | — | — | 8.2 | 0.15 | 6 |
| LYM859 | 73896.1 | 0.6 | 0.29 | 22 | — | — | — | 8.2 | 0.21 | 6 |
| LYM848 | 73697.1 | — | — | — | — | — | — | 8.2 | 0.16 | 6 |
| LYM848 | 73698.6 | — | — | — | 9.5 | 0.26 | 27 | — | — | — |
| LYM846 | 73609.1 | 0.7 | 0.02 | 51 | 10.6 | L | 41 | 8.4 | 0.03 | 8 |

TABLE 107-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM846 | 73609.3 | 0.6 | 0.19 | 30 | — | — | — | — | — | — |
| LYM846 | 73609.5 | 0.5 | 0.12 | 19 | 9.1 | 0.15 | 22 | — | — | — |
| LYM832 | 73660.6 | — | — | — | — | — | — | 8.2 | 0.13 | 7 |
| LYM832 | 73663.4 | 0.6 | 0.16 | 38 | 10.6 | 0.24 | 42 | — | — | — |
| LYM823 | 73655.2 | 0.6 | L | 41 | — | — | — | — | — | — |
| LYM823 | 73655.4 | 0.6 | L | 34 | 9.6 | 0.03 | 28 | — | — | — |
| LYM823 | 73655.5 | 0.6 | 0.04 | 36 | 10.1 | 0.06 | 34 | — | — | — |
| LYM823 | 73657.3 | 0.7 | 0.02 | 53 | 10.1 | 0.15 | 34 | — | — | — |
| LYM814 | 73649.1 | 0.5 | 0.24 | 11 | 9.7 | 0.01 | 29 | 8.0 | 0.23 | 4 |
| LYM814 | 73649.5 | 0.6 | 0.04 | 26 | — | — | — | — | — | — |
| LYM777 | 73941.2 | 0.6 | 0.09 | 26 | 9.8 | 0.02 | 31 | — | — | — |
| LYM777 | 73942.2 | 0.5 | 0.25 | 18 | — | — | — | — | — | — |
| LYM777 | 73943.1 | 0.6 | L | 39 | 11.5 | L | 53 | 8.3 | 0.05 | 8 |
| LYM777 | 73943.4 | 0.6 | 0.08 | 36 | 10.8 | 0.11 | 44 | 8.2 | 0.11 | 6 |
| LYM752 | 73215.2 | — | — | — | 9.9 | 0.06 | 33 | 8.4 | 0.02 | 9 |
| LYM752 | 73218.3 | 0.5 | 0.30 | 13 | — | — | — | — | — | — |
| CONT. | — | 0.5 | — | — | 7.5 | — | — | 7.7 | — | — |
| LYM998 | 74217.1 | — | — | — | — | — | — | 7.6 | 0.13 | 8 |
| LYM998 | 74217.4 | — | — | — | — | — | — | 7.8 | 0.08 | 9 |
| LYM998 | 74219.3 | — | — | — | — | — | — | 7.5 | 0.29 | 5 |
| LYM975 | 74368.2 | — | — | — | — | — | — | 7.7 | 0.05 | 8 |
| LYM975 | 74369.1 | 0.8 | 0.01 | 42 | 12.2 | L | 63 | 8.1 | L | 15 |
| LYM975 | 74370.1 | — | — | — | — | — | — | 7.9 | 0.08 | 11 |
| LYM975 | 74370.2 | 0.8 | L | 43 | 11.8 | 0.01 | 57 | 8.2 | 0.02 | 15 |
| LYM972 | 74510.1 | — | — | — | — | — | — | 7.9 | 0.07 | 12 |
| LYM972 | 74515.6 | — | — | — | — | — | — | 7.5 | 0.29 | 5 |
| LYM929 | 74473.3 | 0.7 | 0.03 | 33 | 9.4 | 0.21 | 25 | 7.6 | 0.09 | 7 |
| LYM924 | 73755.3 | — | — | — | — | — | — | 7.7 | 0.08 | 8 |
| LYM919 | 73748.1 | — | — | — | 9.7 | 0.19 | 30 | 7.7 | 0.07 | 9 |
| LYM919 | 73748.2 | 0.6 | 0.24 | 13 | — | — | — | — | — | — |
| LYM919 | 73748.4 | — | — | — | — | — | — | 7.7 | 0.11 | 9 |
| LYM919 | 73750.6 | — | — | — | — | — | — | 7.7 | 0.07 | 9 |
| LYM919 | 73753.2 | — | — | — | 9.6 | 0.19 | 27 | 8.3 | 0.02 | 17 |
| LYM912 | 73742.2 | 0.7 | 0.25 | 25 | 9.8 | 0.21 | 30 | 8.0 | L | 12 |
| LYM912 | 73745.5 | 0.7 | 0.24 | 34 | 11.1 | 0.24 | 48 | 8.0 | 0.08 | 12 |
| LYM912 | 73746.2 | 0.7 | 0.10 | 33 | 10.7 | 0.15 | 43 | — | — | — |
| LYM912 | 73747.4 | — | — | — | 9.7 | 0.08 | 30 | 7.8 | 0.04 | 10 |
| LYM852 | 73890.3 | 0.8 | 0.11 | 51 | 11.4 | 0.08 | 52 | 8.2 | 0.02 | 15 |
| LYM841 | 73672.1 | — | — | — | 9.8 | 0.28 | 30 | — | — | — |
| LYM841 | 73673.2 | — | — | — | — | — | — | 7.5 | 0.26 | 6 |
| LYM805 | 74549.2 | — | — | — | — | — | — | 7.7 | 0.05 | 9 |
| LYM786 | 74379.2 | 0.7 | L | 36 | 9.0 | 0.27 | 19 | 7.5 | 0.17 | 6 |
| LYM762 | 73151.3 | — | — | — | — | — | — | 7.7 | 0.27 | 8 |
| LYM754 | 74540.1 | — | — | — | — | — | — | 7.8 | 0.03 | 9 |
| CONT. | — | 0.5 | — | — | 7.5 | — | — | 7.1 | — | — |
| LYM995 | 76196.4 | 0.5 | 0.27 | 16 | 7.2 | 0.10 | 37 | 6.4 | 0.03 | 17 |
| LYM995 | 76197.3 | 0.5 | 0.17 | 13 | — | — | — | 6.1 | 0.13 | 11 |
| LYM995 | 76200.1 | 0.6 | 0.09 | 28 | 6.4 | 0.26 | 22 | 6.2 | 0.14 | 15 |
| LYM994 | 75658.2 | 0.6 | 0.06 | 30 | 6.4 | 0.15 | 22 | 6.6 | 0.03 | 21 |
| LYM994 | 75659.1 | 0.5 | 0.03 | 26 | — | — | — | 6.2 | 0.10 | 14 |
| LYM994 | 75659.10 | 0.5 | 0.23 | 13 | — | — | — | — | — | — |
| LYM994 | 75659.2 | 0.5 | 0.05 | 20 | 6.5 | 0.18 | 24 | — | — | — |
| LYM983 | 76016.1 | 0.5 | 0.30 | 13 | — | — | — | — | — | — |
| LYM983 | 76016.2 | 0.5 | 0.17 | 16 | — | — | — | — | — | — |
| LYM983 | 76017.2 | 0.7 | 0.03 | 60 | 7.2 | 0.06 | 37 | 6.4 | 0.05 | 17 |
| LYM983 | 76019.4 | — | — | — | — | — | — | 6.2 | 0.17 | 14 |
| LYM965 | 75728.2 | 0.5 | 0.19 | 24 | — | — | — | — | — | — |
| LYM965 | 75729.1 | 0.5 | 0.11 | 21 | — | — | — | — | — | — |
| LYM965 | 75730.4 | 0.6 | 0.02 | 29 | 6.2 | 0.18 | 19 | 6.2 | 0.10 | 14 |
| LYM961 | 75593.2 | 0.6 | 0.21 | 37 | — | — | — | — | — | — |
| LYM961 | 75594.2 | 0.6 | 0.03 | 27 | — | — | — | — | — | — |
| LYM961 | 75594.4 | 0.5 | L | 22 | — | — | — | — | — | — |
| LYM948 | 75639.3 | 0.5 | 0.15 | 20 | 7.3 | 0.15 | 40 | 6.5 | 0.12 | 20 |
| LYM948 | 75640.1 | 0.6 | 0.03 | 31 | — | — | — | — | — | — |
| LYM948 | 75643.1 | 0.6 | L | 43 | — | — | — | — | — | — |
| LYM948 | 75643.2 | 0.6 | L | 49 | — | — | — | — | — | — |
| LYM946 | 75675.4 | 0.5 | 0.14 | 14 | — | — | — | — | — | — |
| LYM946 | 75677.3 | 0.5 | 0.05 | 24 | — | — | — | — | — | — |
| LYM934 | 75928.2 | 0.7 | 0.04 | 53 | — | — | — | 6.2 | 0.28 | 14 |
| LYM934 | 75928.3 | 0.5 | 0.14 | 16 | — | — | — | 6.0 | 0.18 | 10 |
| LYM934 | 75928.4 | 0.6 | 0.07 | 27 | — | — | — | — | — | — |

TABLE 107-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM934 | 75928.5 | 0.6 | 0.20 | 32 | — | — | — | 7.0 | 0.05 | 29 |
| LYM914 | 75369.1 | 0.5 | 0.19 | 22 | — | — | — | — | — | — |
| LYM914 | 75371.4 | 0.5 | 0.14 | 19 | 6.3 | 0.29 | 20 | — | — | — |
| LYM914 | 75372.3 | 0.5 | 0.25 | 9 | — | — | — | — | — | — |
| LYM865 | 75471.4 | 0.6 | 0.06 | 34 | 6.8 | 0.07 | 30 | 6.5 | 0.04 | 19 |
| LYM865 | 75475.2 | 0.6 | L | 29 | 6.4 | 0.12 | 23 | 6.4 | 0.05 | 17 |
| LYM865 | 75475.3 | 0.6 | 0.22 | 33 | — | — | — | — | — | — |
| LYM865 | 75475.4 | 0.5 | 0.13 | 12 | — | — | — | — | — | — |
| LYM845 | 75742.1 | 0.6 | 0.03 | 28 | — | — | — | 6.1 | 0.14 | 11 |
| LYM845 | 75742.2 | 0.5 | 0.24 | 24 | — | — | — | — | — | — |
| LYM845 | 75745.3 | — | — | — | 7.4 | 0.02 | 41 | 6.6 | 0.03 | 22 |
| LYM798 | 75663.3 | 0.6 | L | 43 | — | — | — | — | — | — |
| LYM798 | 75663.5 | 0.6 | 0.05 | 31 | — | — | — | — | — | — |
| LYM798 | 75664.1 | 0.5 | 0.11 | 23 | — | — | — | — | — | — |
| LYM798 | 75664.4 | 0.5 | 0.02 | 27 | — | — | — | — | — | — |
| LYM798 | 75665.1 | 0.6 | L | 35 | — | — | — | 6.0 | 0.21 | 11 |
| LYM774 | 75700.1 | 0.5 | 0.05 | 16 | — | — | — | — | — | — |
| LYM774 | 75700.2 | 0.5 | 0.06 | 25 | — | — | — | — | — | — |
| LYM774 | 75700.3 | 0.5 | 0.02 | 25 | — | — | — | — | — | — |
| LYM765 | 75603.1 | 0.6 | 0.03 | 28 | — | — | — | — | — | — |
| LYM765 | 75604.2 | 0.6 | L | 30 | 8.4 | L | 60 | 6.8 | L | 24 |
| LYM1002 | 75636.2 | 0.5 | 0.04 | 26 | 6.8 | 0.13 | 30 | 5.9 | 0.26 | 9 |
| LYM1002 | 75636.4 | 0.5 | 0.20 | 21 | — | — | — | — | — | — |
| LYM1002 | 75636.5 | 0.5 | 0.10 | 14 | — | — | — | — | — | — |
| CONT. | — | 0.4 | — | — | 5.2 | — | — | 5.4 | — | — |
| LYM955 | 75357.2 | 0.6 | 0.25 | 11 | — | — | — | — | — | — |
| LYM955 | 75360.2 | 0.6 | 0.07 | 14 | — | — | — | — | — | — |
| LYM955 | 75360.3 | 0.6 | L | 21 | — | — | — | 6.7 | 0.19 | 6 |
| LYM955 | 75360.4 | 0.6 | 0.03 | 20 | — | — | — | — | — | — |
| LYM945 | 75585.2 | 0.7 | 0.02 | 33 | — | — | — | — | — | — |
| LYM945 | 75585.4 | 0.8 | L | 41 | — | — | — | — | — | — |
| LYM945 | 75587.1 | 0.7 | L | 34 | — | — | — | — | — | — |
| LYM945 | 75587.2 | 0.6 | 0.03 | 19 | — | — | — | 6.9 | 0.02 | 9 |
| LYM945 | 75587.3 | 0.6 | 0.04 | 11 | — | — | — | — | — | — |
| LYM941 | 75582.1 | 0.6 | 0.02 | 18 | — | — | — | — | — | — |
| LYM941 | 75583.1 | 0.9 | 0.03 | 76 | — | — | — | — | — | — |
| LYM941 | 75583.4 | 0.6 | 0.18 | 21 | — | — | — | — | — | — |
| LYM926 | 75575.1 | 0.7 | 0.02 | 29 | — | — | — | — | — | — |
| LYM926 | 75577.1 | 0.6 | L | 21 | — | — | — | — | — | — |
| LYM926 | 75577.2 | 0.8 | 0.04 | 48 | — | — | — | — | — | — |
| LYM926 | 75577.5 | 0.6 | 0.03 | 19 | — | — | — | — | — | — |
| LYM921 | 75376.2 | 0.7 | 0.03 | 25 | — | — | — | 6.9 | 0.03 | 9 |
| LYM921 | 75379.1 | 0.6 | 0.03 | 15 | — | — | — | — | — | — |
| LYM890 | 75721.1 | — | — | — | — | — | — | 7.1 | 0.01 | 12 |
| LYM890 | 75721.2 | 0.7 | 0.02 | 25 | — | — | — | — | — | — |
| LYM890 | 75722.5 | 0.7 | 0.01 | 22 | — | — | — | — | — | — |
| LYM890 | 75723.2 | — | — | — | — | — | — | 6.9 | 0.16 | 9 |
| LYM890 | 75723.5 | 0.7 | 0.02 | 30 | — | — | — | — | — | — |
| LYM801 | 75556.2 | — | — | — | — | — | — | 6.7 | 0.06 | 6 |
| LYM801 | 75557.4 | 0.7 | L | 28 | — | — | — | — | — | — |
| LYM801 | 75557.5 | — | — | — | — | — | — | 6.7 | 0.16 | 5 |
| LYM801 | 75557.6 | 0.6 | L | 20 | — | — | — | — | — | — |
| LYM793 | 75549.4 | 0.6 | 0.18 | 7 | — | — | — | 7.1 | L | 12 |
| LYM793 | 75551.2 | 0.6 | 0.14 | 21 | — | — | — | — | — | — |
| LYM793 | 75553.1 | 0.6 | 0.02 | 19 | — | — | — | — | — | — |
| LYM793 | 75553.2 | 0.7 | L | 37 | — | — | — | — | — | — |
| LYM788 | 75543.3 | 0.6 | 0.10 | 15 | — | — | — | — | — | — |
| LYM788 | 75544.1 | 0.8 | L | 54 | — | — | — | — | — | — |
| LYM788 | 75544.4 | 0.7 | 0.02 | 34 | — | — | — | — | — | — |
| LYM788 | 75547.1 | 0.7 | 0.07 | 28 | — | — | — | — | — | — |
| LYM780 | 75063.4 | 0.8 | 0.04 | 50 | — | — | — | — | — | — |
| LYM776 | 75597.4 | — | — | — | — | — | — | 6.9 | 0.17 | 9 |
| LYM776 | 75597.5 | 0.6 | 0.01 | 13 | — | — | — | — | — | — |
| LYM776 | 75599.4 | 0.7 | 0.04 | 29 | — | — | — | — | — | — |
| LYM768 | 75537.1 | 0.6 | 0.10 | 13 | — | — | — | — | — | — |
| LYM768 | 75537.5 | 0.6 | 0.08 | 14 | — | — | — | — | — | — |
| LYM768 | 75538.1 | 0.9 | 0.02 | 73 | 8.6 | 0.14 | 28 | — | — | — |
| LYM768 | 75539.1 | 0.8 | L | 52 | — | — | — | — | — | — |
| LYM768 | 75540.1 | 0.8 | 0.01 | 40 | — | — | — | 6.7 | 0.20 | 6 |
| LYM767 | 75534.1 | 0.6 | 0.05 | 19 | — | — | — | 6.6 | 0.23 | 4 |
| LYM767 | 75535.1 | 0.7 | L | 38 | — | — | — | — | — | — |

TABLE 107-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM756 | 75526.1 | 0.7 | 0.04 | 30 | — | — | — | — | — | — |
| LYM756 | 75528.1 | 0.6 | 0.13 | 14 | — | — | — | — | — | — |
| LYM756 | 75528.4 | 0.7 | 0.09 | 22 | — | — | — | — | — | — |
| CONT. | — | 0.5 | — | — | 6.7 | — | — | 6.3 | — | — |
| LYM979 | 74244.2 | 0.5 | 0.05 | 40 | 7.9 | 0.02 | 53 | 8.0 | 0.01 | 13 |
| LYM979 | 74244.3 | 0.5 | 0.06 | 23 | 6.5 | 0.21 | 25 | — | — | — |
| LYM834 | 74624.2 | — | — | — | 6.6 | L | 27 | 7.8 | 0.02 | 9 |
| LYM834 | 74625.4 | 0.4 | 0.22 | 18 | 7.2 | 0.13 | 40 | 7.7 | 0.06 | 8 |
| LYM834 | 74629.6 | — | — | — | 6.1 | 0.23 | 19 | 7.8 | 0.02 | 10 |
| CONT. | — | 0.4 | — | — | 5.2 | — | — | 7.1 | — | — |
| LYM977 | 73616.2 | 0.6 | 0.13 | 28 | 10.3 | 0.08 | 51 | 8.0 | 0.09 | 13 |
| LYM977 | 73617.1 | 0.6 | 0.26 | 27 | 10.7 | L | 57 | 7.7 | 0.05 | 9 |
| LYM977 | 73617.5 | 0.6 | 0.17 | 25 | 12.1 | L | 77 | 8.6 | L | 21 |
| LYM977 | 73618.2 | 0.7 | 0.03 | 45 | 11.5 | L | 68 | 8.3 | L | 16 |
| LYM977 | 73621.3 | — | — | — | 9.7 | 0.21 | 43 | 7.6 | 0.28 | 7 |
| LYM976 | 74030.1 | 0.7 | 0.01 | 51 | 11.3 | L | 66 | 8.0 | 0.04 | 13 |
| LYM976 | 74033.1 | 0.7 | 0.05 | 51 | 13.1 | 0.02 | 92 | 8.0 | 0.09 | 12 |
| LYM976 | 74034.1 | 0.6 | 0.05 | 37 | 10.3 | 0.01 | 51 | 7.7 | 0.14 | 9 |
| LYM976 | 74034.2 | 0.6 | 0.24 | 24 | 8.8 | 0.20 | 29 | 7.7 | 0.18 | 9 |
| LYM976 | 74034.3 | — | — | — | 10.7 | 0.17 | 57 | — | — | — |
| LYM975 | 74367.3 | 0.6 | 0.18 | 24 | 9.8 | 0.02 | 44 | 8.0 | 0.02 | 13 |
| LYM975 | 74369.1 | 0.7 | 0.06 | 40 | 11.3 | L | 66 | 8.0 | 0.02 | 13 |
| LYM975 | 74370.1 | — | — | — | 8.9 | 0.07 | 31 | 8.2 | 0.01 | 15 |
| LYM975 | 74370.2 | 0.8 | L | 69 | 12.2 | L | 79 | 8.3 | L | 17 |
| LYM958 | 73556.4 | — | — | — | 9.6 | 0.03 | 40 | 7.9 | 0.04 | 11 |
| LYM958 | 73560.3 | — | — | — | — | — | — | 7.6 | 0.27 | 7 |
| LYM958 | 73560.5 | — | — | — | — | — | — | 7.5 | 0.28 | 6 |
| LYM958 | 73560.6 | 0.6 | 0.24 | 29 | — | — | — | — | — | — |
| LYM944 | 73294.2 | 0.7 | 0.01 | 53 | 10.7 | 0.02 | 57 | 7.9 | 0.03 | 11 |
| LYM944 | 73295.2 | — | — | — | 9.4 | 0.28 | 38 | 8.0 | 0.09 | 13 |
| LYM944 | 73296.3 | — | — | — | 9.9 | 0.15 | 45 | 7.8 | 0.05 | 10 |
| LYM930 | 73778.1 | 0.7 | 0.07 | 42 | 11.3 | 0.04 | 66 | 8.0 | 0.05 | 12 |
| LYM930 | 73779.3 | 0.7 | 0.12 | 47 | 10.5 | 0.09 | 54 | 8.0 | 0.02 | 13 |
| LYM930 | 73781.3 | 0.6 | 0.10 | 30 | — | — | — | — | — | — |
| LYM930 | 73782.4 | 0.6 | 0.19 | 27 | — | — | — | — | — | — |
| LYM928 | 73772.1 | 0.6 | 0.24 | 23 | 9.5 | 0.09 | 39 | 7.8 | 0.04 | 10 |
| LYM928 | 73775.1 | — | — | — | 9.0 | 0.07 | 31 | 7.8 | 0.15 | 10 |
| LYM928 | 73775.4 | 0.6 | 0.17 | 28 | 10.2 | 0.06 | 49 | 7.9 | 0.03 | 11 |
| LYM928 | 73777.2 | 0.7 | 0.04 | 45 | 8.7 | 0.25 | 28 | 7.6 | 0.18 | 8 |
| LYM928 | 73777.5 | 0.7 | 0.02 | 54 | 12.6 | 0.05 | 85 | 8.2 | 0.08 | 15 |
| LYM925 | 73760.3 | 0.6 | 0.09 | 32 | 10.3 | 0.14 | 51 | — | — | — |
| LYM925 | 73763.3 | — | — | — | 10.0 | 0.28 | 47 | — | — | — |
| LYM925 | 73763.4 | 0.6 | 0.12 | 34 | 10.3 | L | 51 | 7.8 | 0.04 | 10 |
| LYM925 | 73765.2 | 0.6 | 0.17 | 33 | 9.5 | 0.11 | 39 | 8.0 | 0.13 | 13 |
| LYM883 | 73874.3 | 0.6 | 0.17 | 26 | 13.5 | 0.03 | 98 | 8.1 | L | 14 |
| LYM883 | 73875.4 | — | — | — | 11.1 | 0.04 | 63 | 8.0 | 0.02 | 13 |
| LYM883 | 73876.2 | — | — | — | 11.2 | 0.23 | 64 | — | — | — |
| LYM883 | 73878.2 | 0.8 | L | 70 | 24.7 | L | 262 | 8.2 | L | 16 |
| LYM859 | 73892.1 | — | — | — | 9.6 | 0.04 | 41 | — | — | — |
| LYM859 | 73893.3 | — | — | — | 9.9 | 0.16 | 45 | 7.9 | 0.11 | 11 |
| LYM859 | 73896.1 | 0.7 | 0.05 | 40 | 11.0 | L | 61 | 7.8 | 0.15 | 10 |
| LYM856 | 74139.2 | — | — | — | 9.1 | 0.07 | 33 | — | — | — |
| LYM856 | 74140.2 | 0.6 | 0.18 | 28 | 9.2 | 0.06 | 35 | 7.9 | 0.06 | 11 |
| LYM856 | 74140.4 | 0.7 | 0.01 | 55 | 12.3 | L | 80 | 8.1 | 0.01 | 15 |
| LYM848 | 73695.1 | 0.7 | 0.02 | 45 | 11.0 | L | 62 | 7.7 | 0.13 | 9 |
| LYM848 | 73697.1 | — | — | — | — | — | — | 7.5 | 0.27 | 6 |
| LYM848 | 73698.7 | — | — | — | 8.9 | 0.27 | 31 | — | — | — |
| LYM818 | 74132.1 | 0.7 | L | 59 | 13.8 | L | 103 | 8.2 | 0.01 | 16 |
| LYM818 | 74132.2 | 0.7 | 0.11 | 45 | 10.3 | 0.04 | 52 | — | — | — |
| LYM818 | 74134.1 | 0.6 | 0.10 | 36 | 11.0 | 0.01 | 62 | 8.1 | L | 15 |
| LYM818 | 74136.3 | 0.7 | 0.03 | 49 | 12.6 | 0.03 | 85 | 8.2 | 0.02 | 16 |
| LYM760 | 73934.2 | 0.6 | 0.23 | 25 | 11.3 | L | 65 | 8.6 | L | 21 |
| LYM760 | 73935.1 | 0.6 | 0.21 | 31 | 10.0 | 0.06 | 47 | 7.6 | 0.25 | 7 |
| LYM760 | 73935.6 | 0.7 | 0.05 | 39 | 11.7 | 0.01 | 72 | 8.2 | L | 15 |
| LYM760 | 73939.3 | 0.6 | 0.06 | 39 | 9.7 | 0.07 | 42 | 7.9 | 0.05 | 12 |
| LYM760 | 73939.4 | — | — | — | — | — | — | 7.8 | 0.22 | 11 |
| LYM753 | 74037.2 | — | — | — | 9.0 | 0.07 | 32 | 8.0 | 0.02 | 13 |
| LYM753 | 74037.5 | — | — | — | 8.9 | 0.17 | 31 | 8.0 | 0.01 | 13 |
| LYM753 | 74039.4 | — | — | — | 9.3 | 0.08 | 36 | — | — | — |
| LYM753 | 74040.3 | — | — | — | 8.5 | 0.28 | 25 | 7.9 | 0.19 | 12 |
| CONT. | — | 0.5 | — | — | 6.8 | — | — | 7.1 | — | — |

TABLE 107-continued

Genes showing improved plant performance at Normal growth conditions under regulation of At6669 promoter

| Gene Name | Event # | Leaf Area [cm²] | | | Roots Coverage [cm²] | | | Roots Length [cm] | | |
|---|---|---|---|---|---|---|---|---|---|---|
| | | Ave. | P-Val. | % Incr. | Ave. | P-Val. | % Incr. | Ave. | P-Val. | % Incr. |
| LYM988 | 75013.2 | 0.7 | L | 62 | 6.8 | L | 58 | 6.1 | 0.14 | 8 |
| LYM988 | 75013.3 | 0.7 | 0.03 | 47 | — | — | — | — | — | — |
| LYM988 | 75014.1 | 0.7 | L | 63 | 7.4 | 0.02 | 72 | 6.3 | 0.05 | 11 |
| LYM988 | 75014.2 | 0.7 | 0.01 | 48 | 7.8 | 0.02 | 80 | 6.3 | 0.05 | 10 |
| LYM988 | 75014.5 | 0.6 | L | 23 | 6.0 | 0.01 | 37 | 6.2 | 0.21 | 10 |
| LYM960 | 75008.1 | 0.7 | L | 52 | 6.6 | 0.02 | 53 | — | — | — |
| LYM960 | 75009.1 | 0.8 | L | 66 | 9.5 | 0.02 | 118 | 6.5 | L | 14 |
| LYM960 | 75010.1 | 0.9 | L | 107 | 11.2 | L | 157 | 7.1 | L | 25 |
| LYM960 | 75010.2 | 0.7 | 0.08 | 42 | 5.9 | 0.19 | 36 | — | — | — |
| LYM960 | 75011.1 | 0.8 | L | 67 | 9.9 | L | 129 | 6.6 | L | 17 |
| LYM876 | 75902.1 | 0.7 | L | 57 | 6.6 | 0.02 | 52 | 6.3 | 0.23 | 11 |
| LYM876 | 75903.2 | 0.7 | L | 53 | 8.4 | L | 93 | 6.7 | 0.02 | 17 |
| LYM876 | 75904.1 | — | — | — | 5.2 | 0.26 | 21 | — | — | — |
| LYM876 | 75904.2 | 0.6 | 0.09 | 30 | 10.0 | 0.01 | 131 | 7.2 | L | 26 |
| LYM876 | 75905.4 | — | — | — | 6.8 | 0.01 | 57 | 6.6 | L | 17 |
| LYM862 | 75906.2 | 0.5 | 0.18 | 19 | 6.7 | 0.07 | 54 | 6.0 | 0.28 | 6 |
| LYM862 | 75910.1 | — | — | — | 6.8 | 0.04 | 58 | 6.8 | L | 21 |
| LYM843 | 75292.3 | — | — | — | 5.5 | L | 27 | 6.3 | L | 12 |
| LYM843 | 75293.1 | 0.7 | L | 49 | 7.3 | L | 69 | 6.4 | 0.07 | 13 |
| LYM843 | 75293.2 | 0.6 | 0.22 | 41 | 6.5 | 0.19 | 50 | — | — | — |
| LYM843 | 75293.6 | — | — | — | 7.0 | 0.06 | 62 | 6.4 | 0.09 | 13 |
| LYM836 | 75567.2 | 0.6 | L | 36 | 8.3 | L | 90 | 6.5 | 0.02 | 15 |
| LYM836 | 75568.1 | 0.7 | L | 46 | 7.8 | 0.01 | 79 | 7.0 | L | 24 |
| LYM836 | 75569.6 | 0.8 | L | 71 | 7.4 | L | 70 | 6.9 | L | 23 |
| LYM836 | 75570.2 | 0.6 | L | 21 | 8.7 | L | 102 | 7.2 | L | 26 |
| LYM836 | 75571.2 | 0.7 | L | 58 | 9.8 | L | 127 | 6.9 | L | 22 |
| LYM819 | 75564.1 | 0.6 | 0.07 | 39 | 8.4 | 0.01 | 93 | 6.4 | L | 14 |
| LYM819 | 75564.2 | 0.6 | 0.09 | 37 | 5.6 | 0.23 | 28 | — | — | — |
| LYM819 | 75564.3 | 0.7 | 0.02 | 63 | 6.9 | 0.04 | 60 | 6.2 | 0.20 | 10 |
| LYM819 | 75565.1 | — | — | — | 5.5 | L | 26 | — | — | — |
| CONT. | — | 0.5 | — | — | 4.3 | — | — | 5.7 | — | — |

Table 107. "CONT."—Control; "Ave."—Average; "% Incr." = % increment; "p-val."—p-value, L—p < 0.01.

TABLE 108

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM994 | 75658.2 | 0.1 | 0.05 | 25 | 0.7 | 0.08 | 26 | 0.6 | 0.07 | 15 |
| LYM994 | 75659.1 | — | — | — | — | — | — | 0.5 | 0.26 | 8 |
| LYM994 | 75659.10 | — | — | — | 0.6 | 0.20 | 21 | 0.6 | 0.06 | 16 |
| LYM994 | 75659.2 | 0.1 | 0.23 | 15 | 0.7 | 0.02 | 38 | 0.6 | L | 28 |
| LYM994 | 75659.3 | 0.1 | 0.14 | 20 | 0.7 | 0.06 | 31 | 0.6 | L | 22 |
| LYM983 | 76016.1 | 0.1 | L | 59 | 0.8 | L | 56 | 0.6 | L | 21 |
| LYM983 | 76016.2 | 0.1 | L | 59 | 0.9 | L | 73 | 0.6 | L | 29 |
| LYM983 | 76017.2 | 0.1 | L | 73 | 0.9 | L | 69 | 0.7 | L | 30 |
| LYM983 | 76019.4 | — | — | — | — | — | — | 0.6 | 0.02 | 17 |
| LYM983 | 76020.2 | 0.1 | L | 67 | — | — | — | 0.6 | 0.17 | 10 |
| LYM961 | 75593.2 | 0.1 | L | 69 | 0.9 | L | 73 | 0.6 | L | 23 |
| LYM961 | 75594.2 | 0.1 | L | 35 | 0.7 | 0.03 | 40 | 0.6 | 0.16 | 11 |
| LYM948 | 75639.3 | 0.1 | L | 51 | 0.8 | L | 58 | 0.6 | 0.05 | 16 |
| LYM948 | 75643.1 | 0.1 | 0.25 | 16 | — | — | — | — | — | — |
| LYM948 | 75643.2 | 0.1 | L | 68 | 0.7 | 0.12 | 32 | 0.6 | L | 21 |
| LYM946 | 75675.10 | 0.1 | 0.04 | 30 | — | — | — | — | — | — |
| LYM946 | 75675.4 | 0.1 | L | 36 | — | — | — | 0.5 | 0.24 | 9 |
| LYM946 | 75677.3 | 0.1 | 0.22 | 16 | — | — | — | — | — | — |
| LYM946 | 75677.4 | 0.1 | L | 45 | 0.9 | L | 64 | 0.6 | L | 23 |
| LYM934 | 75928.2 | — | — | — | 0.6 | 0.19 | 23 | 0.6 | L | 20 |
| LYM934 | 75928.3 | 0.1 | 0.15 | 19 | — | — | — | — | — | — |
| LYM934 | 75928.4 | 0.1 | 0.02 | 35 | — | — | — | 0.6 | L | 19 |
| LYM934 | 75928.5 | 0.1 | L | 45 | 0.8 | L | 46 | 0.6 | 0.07 | 12 |
| LYM934 | 75929.1 | 0.1 | L | 44 | 0.8 | 0.02 | 49 | 0.7 | L | 35 |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM914 | 75369.1 | 0.1 | L | 65 | 0.6 | 0.20 | 20 | 0.5 | 0.27 | 9 |
| LYM914 | 75371.4 | 0.1 | 0.16 | 18 | 0.6 | 0.18 | 20 | 0.6 | 0.06 | 13 |
| LYM914 | 75372.1 | 0.1 | 0.19 | 17 | — | — | — | — | — | — |
| LYM914 | 75372.2 | 0.1 | L | 54 | 0.8 | L | 52 | 0.7 | L | 32 |
| LYM914 | 75372.3 | 0.1 | 0.09 | 25 | — | — | — | — | — | — |
| LYM906 | 76071.3 | 0.1 | L | 60 | 0.6 | 0.23 | 21 | 0.6 | 0.05 | 14 |
| LYM906 | 76072.1 | 0.1 | 0.04 | 26 | — | — | — | — | — | — |
| LYM906 | 76072.2 | 0.1 | 0.09 | 24 | 0.7 | 0.12 | 32 | — | — | — |
| LYM906 | 76075.1 | 0.1 | 0.09 | 22 | — | — | — | — | — | — |
| LYM888_H1 | 76068.3 | 0.1 | L | 47 | — | — | — | — | — | — |
| LYM888_H1 | 76068.5 | 0.1 | L | 86 | 1.0 | L | 94 | 0.6 | L | 27 |
| LYM888_H1 | 76068.6 | 0.1 | 0.14 | 20 | — | — | — | 0.6 | 0.14 | 15 |
| LYM865 | 75471.1 | 0.0 | 0.27 | 13 | — | — | — | 0.6 | 0.03 | 16 |
| LYM865 | 75471.4 | 0.1 | 0.15 | 21 | — | — | — | 0.6 | 0.18 | 10 |
| LYM865 | 75475.2 | 0.1 | L | 39 | 0.8 | L | 60 | 0.6 | L | 23 |
| LYM865 | 75475.3 | — | — | — | — | — | — | 0.5 | 0.18 | 9 |
| LYM845 | 75742.1 | 0.1 | 0.10 | 22 | 0.7 | 0.08 | 30 | 0.5 | 0.23 | 9 |
| LYM845 | 75742.2 | 0.1 | 0.07 | 24 | 0.9 | L | 70 | 0.6 | 0.01 | 19 |
| LYM845 | 75745.3 | 0.1 | 0.20 | 15 | 0.6 | 0.29 | 21 | — | — | — |
| LYM830_H4 | 76061.1 | 0.1 | L | 92 | 0.9 | L | 66 | 0.6 | 0.07 | 21 |
| LYM830_H4 | 76061.2 | 0.1 | 0.17 | 19 | 0.6 | 0.28 | 19 | 0.5 | 0.27 | 7 |
| LYM830_H4 | 76064.1 | 0.1 | L | 84 | 0.9 | L | 75 | 0.7 | L | 35 |
| LYM830_H4 | 76065.1 | 0.1 | L | 53 | 0.8 | L | 60 | 0.6 | L | 29 |
| LYM765 | 75603.1 | 0.1 | L | 78 | 1.0 | L | 99 | 0.7 | L | 43 |
| LYM765 | 75604.2 | 0.1 | L | 45 | 0.6 | 0.26 | 22 | 0.6 | 0.11 | 11 |
| LYM765 | 75606.2 | 0.1 | 0.05 | 27 | 0.7 | 0.13 | 25 | 0.6 | 0.18 | 11 |
| LYM765 | 75606.3 | — | — | — | — | — | — | 0.6 | 0.13 | 10 |
| LYM765 | 75606.4 | 0.1 | 0.06 | 29 | — | — | — | — | — | — |
| LYM1002 | 75636.2 | 0.1 | 0.20 | 16 | — | — | — | — | — | — |
| LYM1002 | 75636.4 | 0.1 | L | 59 | 0.9 | L | 75 | 0.6 | L | 25 |
| LYM1002 | 75636.5 | 0.1 | 0.28 | 16 | 0.6 | 0.28 | 17 | 0.6 | 0.04 | 16 |
| LYM1002 | 75637.1 | 0.1 | L | 35 | 0.7 | 0.05 | 36 | 0.6 | L | 26 |
| CONT. | — | 0.0 | — | — | 0.5 | — | — | 0.5 | — | — |
| LYM998 | 74217.4 | — | — | — | 1.4 | 0.19 | 18 | — | — | — |
| LYM998 | 74219.1 | 0.1 | 0.05 | 26 | 1.7 | 0.01 | 39 | — | — | — |
| LYM998 | 74219.2 | — | — | — | 1.5 | 0.08 | 23 | 0.9 | 0.23 | 5 |
| LYM972 | 74510.1 | 0.1 | 0.29 | 14 | 1.4 | 0.24 | 17 | — | — | — |
| LYM966 | 74524.1 | 0.1 | 0.26 | 15 | 1.4 | 0.30 | 15 | — | — | — |
| LYM954 | 74496.2 | 0.1 | 0.26 | 16 | 1.7 | L | 40 | — | — | — |
| LYM932 | 74479.4 | — | — | — | — | — | — | 0.9 | 0.19 | 6 |
| LYM920 | 74464.1 | — | — | — | 1.4 | 0.17 | 18 | — | — | — |
| LYM886 | 74446.4 | 0.1 | 0.28 | 12 | — | — | — | — | — | — |
| LYM886 | 74448.4 | — | — | — | 1.4 | 0.23 | 17 | — | — | — |
| LYM857 | 74398.2 | — | — | — | — | — | — | 0.8 | 0.29 | 4 |
| LYM857 | 74400.1 | — | — | — | 1.5 | 0.07 | 26 | — | — | — |
| LYM811 | 74385.2 | 0.1 | L | 47 | 1.8 | L | 49 | — | — | — |
| LYM811 | 74386.1 | 0.1 | 0.23 | 16 | 1.6 | 0.05 | 32 | — | — | — |
| LYM811 | 74388.2 | — | — | — | 1.5 | 0.17 | 22 | — | — | — |
| LYM811 | 74388.3 | 0.1 | 0.12 | 20 | 1.5 | 0.10 | 25 | — | — | — |
| LYM783 | 74373.2 | 0.1 | 0.25 | 17 | 1.7 | 0.02 | 42 | — | — | — |
| LYM783 | 74374.1 | 0.1 | 0.02 | 43 | 2.0 | L | 68 | — | — | — |
| LYM1004 | 74336.2 | 0.1 | 0.22 | 16 | — | — | — | — | — | — |
| LYM1004 | 74336.3 | 0.1 | 0.21 | 16 | 1.5 | 0.05 | 27 | — | — | — |
| LYM1004 | 74340.1 | — | — | — | 1.7 | 0.02 | 37 | — | — | — |
| CONT. | — | 0.1 | — | — | 1.2 | — | — | 0.8 | — | — |
| LYM798 | 75664.1 | 0.1 | L | 47 | 1.0 | 0.20 | 20 | — | — | — |
| LYM798 | 75664.4 | 0.1 | 0.25 | 11 | — | — | — | — | — | — |
| LYM798 | 75665.3 | 0.1 | L | 57 | 1.2 | L | 45 | — | — | — |
| CONT. | — | 0.1 | — | — | 0.9 | — | — | — | — | — |
| LYM977 | 73616.2 | 0.1 | 0.19 | 27 | — | — | — | — | — | — |
| LYM977 | 73617.5 | 0.1 | 0.11 | 24 | — | — | — | — | — | — |
| LYM977 | 73618.2 | 0.1 | 0.04 | 32 | 1.1 | 0.12 | 21 | — | — | — |
| LYM976 | 74030.1 | 0.1 | 0.05 | 31 | — | — | — | — | — | — |
| LYM976 | 74034.1 | 0.0 | 0.19 | 20 | 1.2 | 0.08 | 31 | — | — | — |
| LYM976 | 74034.2 | 0.1 | 0.14 | 29 | — | — | — | — | — | — |
| LYM976 | 74034.3 | 0.1 | 0.19 | 24 | — | — | — | — | — | — |
| LYM958 | 73556.3 | 0.0 | 0.28 | 17 | 1.4 | 0.01 | 47 | 0.9 | 0.07 | 11 |
| LYM958 | 73556.4 | 0.1 | 0.05 | 35 | 1.1 | 0.20 | 21 | — | — | — |
| LYM958 | 73560.6 | — | — | — | 1.1 | 0.21 | 21 | — | — | — |
| LYM944 | 73294.2 | 0.1 | 0.14 | 30 | 1.3 | 0.05 | 42 | — | — | — |
| LYM944 | 73294.3 | — | — | — | 1.1 | 0.30 | 16 | — | — | — |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM944 | 73295.2 | 0.1 | 0.01 | 45 | 1.6 | L | 73 | — | — | — |
| LYM856 | 74140.2 | 0.1 | L | 53 | 1.3 | L | 42 | — | — | — |
| LYM856 | 74140.4 | 0.1 | 0.03 | 36 | 1.1 | 0.25 | 17 | — | — | — |
| LYM856 | 74141.1 | 0.1 | 0.10 | 34 | — | — | — | — | — | — |
| LYM846 | 73606.3 | 0.1 | 0.04 | 33 | — | — | — | — | — | — |
| LYM846 | 73608.5 | 0.1 | 0.02 | 35 | 1.3 | 0.03 | 33 | — | — | — |
| LYM846 | 73609.1 | — | — | — | 1.3 | 0.08 | 37 | — | — | — |
| LYM846 | 73609.3 | 0.1 | 0.06 | 31 | 1.3 | 0.05 | 39 | — | — | — |
| LYM846 | 73609.5 | — | — | — | 1.2 | 0.11 | 26 | — | — | — |
| LYM832 | 73660.6 | 0.1 | 0.02 | 38 | 1.1 | 0.21 | 19 | 0.9 | 0.30 | 6 |
| LYM832 | 73663.1 | 0.1 | 0.08 | 28 | 1.2 | 0.07 | 30 | — | — | — |
| LYM823 | 73655.2 | 0.0 | 0.16 | 20 | — | — | — | — | — | — |
| LYM823 | 73655.5 | 0.1 | 0.10 | 27 | — | — | — | — | — | — |
| LYM823 | 73657.2 | 0.1 | L | 62 | 1.5 | L | 55 | — | — | — |
| LYM823 | 73657.3 | 0.1 | 0.14 | 25 | 1.1 | 0.30 | 16 | — | — | — |
| LYM818 | 74132.1 | 0.0 | 0.30 | 15 | 1.2 | 0.12 | 25 | — | — | — |
| LYM818 | 74136.1 | 0.1 | 0.01 | 42 | 1.1 | 0.23 | 20 | — | — | — |
| LYM818 | 74136.3 | 0.1 | 0.02 | 39 | 1.4 | L | 49 | — | — | — |
| LYM814 | 73648.2 | 0.1 | 0.15 | 22 | 1.2 | 0.07 | 29 | 0.9 | 0.12 | 9 |
| LYM814 | 73648.4 | 0.1 | 0.07 | 32 | — | — | — | — | — | — |
| LYM814 | 73651.3 | 0.1 | 0.03 | 36 | 1.2 | 0.08 | 30 | — | — | — |
| LYM777 | 73941.3 | 0.1 | L | 47 | 1.2 | 0.11 | 25 | — | — | — |
| LYM777 | 73942.2 | — | — | — | 1.2 | 0.23 | 23 | — | — | — |
| LYM777 | 73943.1 | 0.0 | 0.29 | 15 | — | — | — | — | — | — |
| LYM760 | 73934.2 | 0.1 | 0.11 | 24 | 1.1 | 0.22 | 19 | — | — | — |
| LYM760 | 73935.6 | 0.1 | 0.16 | 23 | 1.2 | 0.09 | 28 | 0.9 | 0.23 | 8 |
| LYM753 | 74037.2 | 0.1 | 0.03 | 49 | 1.2 | 0.26 | 25 | — | — | — |
| LYM753 | 74039.5 | 0.1 | L | 51 | 1.2 | 0.05 | 29 | — | — | — |
| LYM753 | 74040.3 | — | — | — | 1.1 | 0.28 | 17 | — | — | — |
| LYM752 | 73214.1 | 0.1 | 0.07 | 31 | — | — | — | — | — | — |
| LYM752 | 73215.1 | — | — | — | 1.2 | 0.25 | 25 | — | — | — |
| LYM752 | 73215.2 | 0.1 | 0.15 | 52 | 1.2 | 0.28 | 24 | — | — | — |
| CONT. | — | 0.0 | — | — | 0.9 | — | — | 0.8 | — | — |
| LYM997 | 74694.1 | 0.1 | 0.01 | 36 | 1.2 | 0.02 | 35 | — | — | — |
| LYM997 | 74695.4 | — | — | — | 1.0 | 0.28 | 15 | — | — | — |
| LYM990 | 74642.2 | — | — | — | 1.1 | 0.24 | 23 | — | — | — |
| LYM990 | 74643.2 | 0.1 | 0.09 | 21 | — | — | — | — | — | — |
| LYM982 | 74709.1 | 0.1 | 0.11 | 24 | — | — | — | — | — | — |
| LYM982 | 74709.3 | 0.1 | 0.10 | 20 | 1.2 | 0.03 | 30 | — | — | — |
| LYM982 | 74709.4 | — | — | — | 1.1 | 0.17 | 20 | — | — | — |
| LYM980 | 74589.1 | — | — | — | 1.0 | 0.29 | 15 | 0.8 | 0.24 | 8 |
| LYM980 | 74590.1 | 0.1 | 0.21 | 19 | — | — | — | — | — | — |
| LYM980 | 74593.5 | 0.1 | 0.02 | 29 | — | — | — | 0.8 | 0.21 | 7 |
| LYM935 | 74655.1 | 0.1 | 0.10 | 23 | — | — | — | — | — | — |
| LYM935 | 74657.1 | — | — | — | — | — | — | 0.8 | 0.21 | 7 |
| LYM930 | 73779.3 | 0.1 | 0.03 | 34 | 1.1 | 0.05 | 27 | — | — | — |
| LYM930 | 73783.1 | 0.1 | 0.12 | 22 | — | — | — | — | — | — |
| LYM857 | 74396.2 | — | — | — | 1.1 | 0.13 | 20 | — | — | — |
| LYM857 | 74398.1 | — | — | — | — | — | — | 0.8 | 0.13 | 9 |
| LYM857 | 74400.1 | 0.1 | L | 51 | 1.2 | L | 33 | — | — | — |
| LYM857 | 74401.2 | 0.1 | 0.19 | 20 | 1.1 | 0.22 | 22 | — | — | — |
| LYM820 | 74585.1 | 0.1 | L | 50 | 1.4 | L | 53 | — | — | — |
| LYM820 | 74585.4 | 0.1 | 0.17 | 18 | — | — | — | — | — | — |
| LYM820 | 74587.1 | 0.1 | 0.03 | 29 | 1.1 | 0.12 | 22 | — | — | — |
| LYM783 | 74372.1 | 0.1 | 0.16 | 23 | 1.2 | 0.06 | 28 | — | — | — |
| LYM783 | 74377.2 | 0.1 | 0.02 | 35 | 1.4 | L | 55 | — | — | — |
| LYM762 | 73149.1 | — | — | — | 1.0 | 0.25 | 14 | — | — | — |
| LYM762 | 73149.3 | 0.1 | L | 66 | 1.1 | 0.11 | 23 | — | — | — |
| LYM762 | 73149.5 | 0.1 | 0.29 | 18 | — | — | — | — | — | — |
| CONT. | — | 0.0 | — | — | 0.9 | — | — | 0.7 | — | — |
| LYM954 | 74492.1 | — | — | — | — | — | — | 0.9 | 0.24 | 6 |
| LYM882 | 74442.1 | — | — | — | 1.8 | 0.16 | 19 | 0.9 | 0.01 | 12 |
| LYM802 | 74437.3 | 0.1 | 0.23 | 16 | — | — | — | 0.9 | 0.10 | 8 |
| LYM802 | 74437.4 | — | — | — | — | — | — | 0.9 | 0.14 | 8 |
| LYM782 | 74810.1 | 0.1 | 0.13 | 20 | — | — | — | — | — | — |
| LYM771 | 74528.1 | 0.1 | 0.19 | 17 | — | — | — | — | — | — |
| LYM771 | 74529.1 | 0.1 | 0.03 | 32 | 1.8 | 0.14 | 18 | 0.9 | 0.23 | 7 |
| LYM771 | 74530.2 | 0.1 | 0.08 | 25 | — | — | — | 0.9 | 0.27 | 6 |
| CONT. | — | 0.1 | — | — | 1.5 | — | — | 0.8 | — | — |
| LYM992 | 74648.1 | 0.1 | L | 76 | 0.8 | L | 53 | 0.7 | 0.15 | 9 |
| LYM992 | 74649.3 | 0.0 | 0.09 | 28 | — | — | — | — | — | — |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM992 | 74649.4 | 0.0 | L | 57 | 0.7 | L | 35 | 0.7 | 0.10 | 11 |
| LYM992 | 74651.2 | 0.1 | L | 70 | 0.8 | L | 38 | 0.7 | 0.12 | 12 |
| LYM992 | 74653.4 | 0.0 | 0.03 | 36 | 0.7 | 0.05 | 31 | — | — | — |
| LYM953 | 74486.3 | 0.0 | L | 45 | 0.8 | L | 39 | 0.8 | L | 21 |
| LYM953 | 74487.1 | 0.0 | 0.03 | 33 | — | — | — | — | — | — |
| LYM953 | 74488.1 | 0.0 | L | 47 | — | — | — | — | — | — |
| LYM953 | 74491.2 | 0.1 | 0.01 | 87 | 0.8 | 0.04 | 55 | 0.8 | 0.06 | 13 |
| LYM942 | 74661.3 | 0.0 | 0.03 | 37 | — | — | — | — | — | — |
| LYM942 | 74661.5 | 0.0 | 0.02 | 35 | — | — | — | — | — | — |
| LYM942 | 74665.4 | 0.0 | 0.06 | 28 | — | — | — | 0.7 | 0.30 | 6 |
| LYM936 | 74482.1 | 0.0 | 0.03 | 48 | 0.7 | 0.18 | 21 | — | — | — |
| LYM936 | 74482.2 | 0.0 | 0.03 | 39 | 0.8 | 0.06 | 43 | — | — | — |
| LYM936 | 74483.1 | 0.1 | L | 73 | 0.7 | L | 34 | 0.7 | 0.05 | 12 |
| LYM936 | 74484.1 | 0.0 | L | 54 | 0.9 | L | 65 | 0.7 | 0.06 | 13 |
| LYM882 | 74439.2 | 0.0 | L | 48 | — | — | — | — | — | — |
| LYM882 | 74440.2 | — | — | — | 0.6 | 0.28 | 13 | — | — | — |
| LYM882 | 74442.2 | 0.0 | 0.13 | 24 | — | — | — | — | — | — |
| LYM879 | 74602.1 | 0.1 | L | 79 | 0.8 | L | 44 | 0.7 | 0.08 | 11 |
| LYM879 | 74602.5 | 0.0 | 0.25 | 17 | 0.6 | 0.14 | 19 | — | — | — |
| LYM879 | 74604.2 | 0.0 | 0.01 | 54 | 0.8 | 0.03 | 42 | — | — | — |
| LYM879 | 74604.5 | 0.0 | 0.04 | 33 | 0.7 | 0.06 | 25 | 0.7 | 0.16 | 8 |
| LYM879 | 74605.1 | 0.0 | 0.03 | 30 | 0.7 | 0.05 | 22 | 0.7 | 0.10 | 10 |
| LYM840 | 73546.2 | 0.0 | L | 51 | 0.8 | 0.01 | 46 | — | — | — |
| LYM840 | 73547.1 | 0.0 | 0.06 | 33 | 0.8 | L | 44 | 0.7 | 0.10 | 11 |
| LYM840 | 73547.2 | 0.1 | L | 69 | 0.7 | L | 37 | 0.7 | 0.17 | 9 |
| LYM840 | 73548.1 | 0.0 | 0.04 | 33 | 0.7 | 0.03 | 32 | 0.7 | 0.13 | 9 |
| LYM840 | 73549.1 | 0.0 | L | 40 | 0.9 | L | 66 | — | — | — |
| LYM796 | 74571.2 | 0.0 | L | 63 | 0.7 | 0.05 | 23 | 0.7 | 0.17 | 9 |
| LYM796 | 74571.3 | 0.1 | L | 67 | 0.7 | 0.16 | 27 | 0.7 | 0.25 | 7 |
| LYM796 | 74573.1 | 0.1 | L | 109 | 0.8 | L | 54 | — | — | — |
| LYM796 | 74575.1 | 0.0 | L | 49 | 0.7 | 0.03 | 35 | — | — | — |
| LYM757 | 74427.1 | 0.0 | 0.11 | 22 | — | — | — | — | — | — |
| LYM757 | 74427.4 | 0.1 | L | 80 | 0.8 | L | 41 | 0.7 | 0.23 | 8 |
| LYM757 | 74428.1 | 0.1 | L | 93 | 0.9 | L | 68 | 0.7 | 0.10 | 11 |
| LYM757 | 74429.2 | 0.1 | L | 92 | 1.0 | L | 88 | 0.8 | L | 22 |
| LYM757 | 74429.3 | 0.0 | L | 56 | 0.8 | L | 53 | 0.7 | 0.05 | 13 |
| CONT. | — | 0.0 | — | — | 0.5 | — | — | 0.7 | — | — |
| LYM805 | 74547.1 | 0.1 | 0.21 | 26 | — | — | — | — | — | — |
| LYM805 | 74547.2 | — | — | — | — | — | — | 0.8 | L | 16 |
| LYM805 | 74548.1 | 0.1 | L | 70 | 1.6 | L | 69 | 0.8 | L | 16 |
| LYM805 | 74549.2 | — | — | — | — | — | — | 0.8 | L | 16 |
| LYM805 | 74550.2 | 0.1 | 0.04 | 41 | 1.4 | 0.03 | 43 | 0.8 | L | 17 |
| LYM796 | 74571.5 | — | — | — | — | — | — | 0.8 | 0.23 | 7 |
| LYM782 | 74810.1 | 0.1 | 0.14 | 28 | 1.2 | 0.14 | 29 | 0.8 | L | 18 |
| LYM782 | 74812.2 | — | — | — | — | — | — | 0.8 | 0.17 | 9 |
| LYM782 | 74814.1 | 0.1 | 0.01 | 52 | 1.3 | 0.09 | 33 | 0.8 | 0.02 | 14 |
| CONT. | — | 0.1 | — | — | 0.9 | — | — | 0.7 | — | — |
| LYM967 | 74506.2 | — | — | — | 1.0 | 0.10 | 29 | — | — | — |
| LYM956 | 74498.2 | 0.1 | 0.10 | 20 | — | — | — | — | — | — |
| LYM956 | 74500.1 | 0.1 | 0.25 | 17 | — | — | — | — | — | — |
| LYM927 | 73769.1 | 0.1 | L | 38 | 1.2 | L | 51 | 0.8 | 0.10 | 10 |
| LYM927 | 73770.2 | — | — | — | 1.1 | L | 43 | 0.8 | 0.25 | 8 |
| LYM899 | 74823.1 | — | — | — | 1.0 | 0.10 | 25 | 0.8 | 0.07 | 14 |
| LYM899 | 74826.3 | 0.1 | 0.13 | 20 | 1.0 | 0.04 | 28 | — | — | — |
| LYM820 | 74587.1 | — | — | — | 1.0 | 0.10 | 28 | — | — | — |
| LYM787 | 74568.3 | 0.1 | 0.08 | 22 | 1.0 | 0.08 | 21 | — | — | — |
| LYM787 | 74569.1 | — | — | — | 0.9 | 0.30 | 15 | — | — | — |
| LYM771 | 74529.1 | — | — | — | 1.0 | 0.20 | 23 | 0.8 | 0.28 | 8 |
| LYM770 | 74519.1 | 0.1 | 0.16 | 21 | 1.0 | 0.19 | 23 | 0.8 | 0.21 | 8 |
| CONT. | — | 0.1 | — | — | 0.8 | — | — | 0.7 | — | — |
| LYM955 | 75360.2 | 0.1 | 0.07 | 21 | — | — | — | — | — | — |
| LYM955 | 75360.3 | 0.1 | L | 40 | 1.3 | L | 32 | — | — | — |
| LYM955 | 75360.6 | 0.1 | 0.05 | 28 | 1.1 | 0.13 | 18 | — | — | — |
| LYM921 | 75376.1 | 0.1 | 0.02 | 28 | — | — | — | — | — | — |
| LYM774 | 75699.1 | 0.1 | L | 31 | — | — | — | — | — | — |
| LYM774 | 75700.1 | 0.1 | L | 42 | 1.2 | 0.04 | 30 | — | — | — |
| LYM774 | 75701.4 | 0.1 | L | 46 | 1.1 | 0.18 | 19 | — | — | — |
| LYM756 | 75528.2 | 0.1 | 0.08 | 28 | 1.1 | 0.26 | 16 | — | — | — |
| LYM756 | 75528.3 | 0.1 | L | 39 | 1.2 | 0.08 | 23 | — | — | — |
| CONT. | — | 0.1 | — | — | 1.0 | — | — | — | — | — |
| LYM928 | 73772.1 | — | — | — | — | — | — | 0.8 | 0.06 | 15 |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM925 | 73760.2 | 0.1 | 0.02 | 46 | 1.3 | 0.01 | 50 | — | — | — |
| LYM925 | 73760.3 | — | — | — | 1.1 | 0.17 | 25 | — | — | — |
| LYM925 | 73763.4 | — | — | — | — | — | — | 0.7 | 0.18 | 11 |
| LYM925 | 73765.2 | — | — | — | 1.0 | 0.27 | 15 | 0.8 | 0.03 | 16 |
| LYM924 | 73757.4 | 0.1 | L | 53 | 1.4 | L | 64 | 0.7 | 0.23 | 11 |
| LYM924 | 73758.1 | 0.1 | L | 63 | 1.7 | L | 90 | 0.8 | 0.02 | 19 |
| LYM924 | 73758.3 | 0.1 | L | 66 | 1.5 | L | 67 | 0.8 | 0.08 | 14 |
| LYM919 | 73748.2 | 0.1 | 0.02 | 37 | 1.1 | 0.13 | 22 | — | — | — |
| LYM919 | 73748.4 | — | — | — | — | — | — | 0.7 | 0.27 | 9 |
| LYM919 | 73750.6 | — | — | — | — | — | — | 0.7 | 0.24 | 10 |
| LYM919 | 73753.2 | — | — | — | — | — | — | 0.8 | 0.09 | 13 |
| LYM912 | 73746.2 | 0.1 | 0.23 | 18 | 1.0 | 0.24 | 16 | — | — | — |
| LYM912 | 73747.4 | 0.1 | 0.10 | 29 | 1.4 | L | 54 | — | — | — |
| LYM883 | 73874.3 | 0.1 | 0.03 | 41 | 2.2 | L | 152 | 0.8 | 0.11 | 15 |
| LYM883 | 73875.4 | — | — | — | 1.1 | 0.17 | 28 | — | — | — |
| LYM883 | 73876.2 | — | — | — | 1.3 | L | 48 | 0.8 | 0.02 | 18 |
| LYM883 | 73878.2 | — | — | — | 1.5 | L | 65 | 0.8 | 0.19 | 13 |
| LYM883 | 73878.3 | — | — | — | 1.1 | 0.20 | 21 | — | — | — |
| LYM880 | 73589.2 | 0.1 | 0.03 | 33 | 1.2 | 0.03 | 33 | 0.7 | 0.21 | 10 |
| LYM880 | 73590.3 | 0.1 | 0.11 | 22 | 1.1 | 0.13 | 21 | — | — | — |
| LYM880 | 73590.4 | 0.1 | 0.09 | 26 | 1.1 | 0.05 | 29 | 0.8 | 0.03 | 17 |
| LYM880 | 73591.2 | — | — | — | — | — | — | 0.7 | 0.24 | 9 |
| LYM859 | 73896.1 | — | — | — | — | — | — | 0.7 | 0.17 | 10 |
| LYM848 | 73695.1 | — | — | — | — | — | — | 0.8 | 0.10 | 14 |
| LYM848 | 73697.1 | — | — | — | — | — | — | 0.8 | 0.05 | 15 |
| LYM848 | 73698.6 | — | — | — | 1.1 | 0.15 | 26 | 0.7 | 0.23 | 10 |
| LYM846 | 73609.1 | 0.1 | L | 57 | 1.2 | L | 40 | 0.8 | 0.02 | 21 |
| LYM846 | 73609.3 | 0.1 | 0.10 | 31 | 1.1 | 0.23 | 20 | — | — | — |
| LYM846 | 73609.5 | 0.1 | 0.24 | 17 | 1.1 | 0.12 | 22 | 0.8 | 0.06 | 14 |
| LYM832 | 73660.3 | — | — | — | — | — | — | 0.8 | 0.07 | 14 |
| LYM832 | 73660.6 | — | — | — | — | — | — | 0.7 | 0.18 | 11 |
| LYM832 | 73663.4 | 0.1 | 0.11 | 33 | 1.2 | 0.07 | 40 | — | — | — |
| LYM823 | 73655.2 | 0.1 | L | 40 | 1.1 | 0.27 | 21 | — | — | — |
| LYM823 | 73655.4 | 0.1 | 0.03 | 30 | 1.1 | 0.04 | 28 | — | — | — |
| LYM823 | 73655.5 | 0.1 | 0.05 | 33 | 1.2 | 0.03 | 33 | — | — | — |
| LYM823 | 73657.3 | 0.1 | L | 55 | 1.2 | 0.05 | 35 | — | — | — |
| LYM814 | 73648.2 | — | — | — | — | — | — | 0.8 | 0.04 | 14 |
| LYM814 | 73649.1 | — | — | — | 1.1 | 0.04 | 29 | 0.8 | L | 20 |
| LYM814 | 73649.5 | 0.1 | 0.10 | 24 | — | — | — | — | — | — |
| LYM777 | 73941.2 | 0.1 | 0.18 | 21 | 1.2 | 0.03 | 31 | — | — | — |
| LYM777 | 73942.2 | — | — | — | — | — | — | 0.7 | 0.23 | 9 |
| LYM777 | 73943.1 | 0.1 | L | 39 | 1.4 | L | 55 | — | — | — |
| LYM777 | 73943.4 | 0.1 | 0.03 | 37 | 1.3 | 0.02 | 45 | 0.8 | 0.01 | 20 |
| LYM752 | 73215.2 | — | — | — | 1.2 | 0.04 | 32 | 0.8 | 0.01 | 19 |
| CONT. | — | 0.0 | — | — | 0.9 | — | — | 0.7 | — | — |
| LYM998 | 74217.4 | — | — | — | — | — | — | 0.8 | 0.07 | 16 |
| LYM998 | 74219.3 | — | — | — | — | — | — | 0.8 | 0.18 | 11 |
| LYM975 | 74369.1 | 0.1 | 0.02 | 42 | 1.4 | L | 61 | — | — | — |
| LYM975 | 74370.1 | — | — | — | — | — | — | 0.8 | 0.22 | 11 |
| LYM975 | 74370.2 | 0.1 | 0.02 | 40 | 1.4 | 0.01 | 56 | 0.8 | 0.19 | 12 |
| LYM929 | 74473.3 | 0.1 | 0.08 | 31 | 1.1 | 0.23 | 26 | — | — | — |
| LYM919 | 73748.1 | — | — | — | 1.2 | 0.12 | 35 | 0.8 | 0.08 | 15 |
| LYM919 | 73750.6 | — | — | — | — | — | — | 0.8 | 0.27 | 10 |
| LYM919 | 73753.2 | — | — | — | 1.1 | 0.24 | 25 | 0.8 | 0.20 | 11 |
| LYM912 | 73742.2 | 0.1 | 0.24 | 23 | 1.1 | 0.19 | 29 | — | — | — |
| LYM912 | 73745.5 | 0.1 | 0.16 | 33 | 1.3 | 0.07 | 51 | 0.8 | 0.21 | 12 |
| LYM912 | 73746.2 | 0.1 | 0.07 | 36 | 1.3 | 0.08 | 43 | — | — | — |
| LYM912 | 73747.4 | — | — | — | 1.1 | 0.17 | 27 | — | — | — |
| LYM880 | 73590.2 | — | — | — | — | — | — | 0.8 | 0.29 | 9 |
| LYM852 | 73890.3 | 0.1 | 0.03 | 53 | 1.4 | 0.03 | 53 | — | — | — |
| LYM852 | 73891.3 | — | — | — | 1.2 | 0.25 | 32 | — | — | — |
| LYM841 | 73672.1 | — | — | — | 1.2 | 0.15 | 35 | — | — | — |
| LYM805 | 74549.2 | — | — | — | — | — | — | 0.8 | 0.26 | 10 |
| LYM800 | 74576.2 | — | — | — | — | — | — | 0.8 | 0.25 | 9 |
| LYM786 | 74379.2 | 0.1 | 0.05 | 33 | — | — | — | 0.8 | 0.19 | 11 |
| LYM786 | 74383.3 | — | — | — | — | — | — | 0.8 | 0.22 | 11 |
| CONT. | — | 0.1 | — | — | 0.9 | — | — | 0.7 | — | — |
| LYM995 | 76196.4 | — | — | — | 0.8 | 0.09 | 38 | 0.5 | 0.23 | 16 |
| LYM995 | 76197.3 | — | — | — | — | — | — | 0.5 | 0.26 | 15 |
| LYM995 | 76200.1 | 0.1 | 0.10 | 27 | — | — | — | — | — | — |
| LYM994 | 75658.2 | 0.1 | 0.09 | 26 | 0.7 | 0.29 | 21 | 0.6 | 0.12 | 22 |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM994 | 75659.1 | 0.0 | 0.17 | 20 | — | — | — | — | — | — |
| LYM994 | 75659.2 | 0.1 | 0.13 | 21 | 0.7 | 0.27 | 22 | — | — | — |
| LYM983 | 76017.2 | 0.1 | L | 56 | 0.8 | 0.09 | 36 | — | — | — |
| LYM983 | 76019.4 | — | — | — | — | — | — | 0.6 | 0.23 | 18 |
| LYM965 | 75728.2 | 0.0 | 0.29 | 19 | — | — | — | — | — | — |
| LYM965 | 75729.1 | 0.1 | 0.17 | 22 | — | — | — | — | — | — |
| LYM965 | 75730.4 | 0.1 | 0.06 | 28 | — | — | — | — | — | — |
| LYM961 | 75593.2 | 0.1 | 0.27 | 24 | — | — | — | — | — | — |
| LYM961 | 75594.2 | 0.1 | 0.06 | 29 | — | — | — | — | — | — |
| LYM961 | 75594.4 | 0.0 | 0.14 | 20 | — | — | — | — | — | — |
| LYM948 | 75639.3 | 0.0 | 0.25 | 18 | 0.8 | 0.08 | 40 | 0.6 | 0.23 | 20 |
| LYM948 | 75640.1 | 0.1 | 0.11 | 25 | — | — | — | — | — | — |
| LYM948 | 75643.1 | 0.1 | 0.03 | 34 | — | — | — | — | — | — |
| LYM948 | 75643.2 | 0.1 | L | 52 | — | — | — | — | — | — |
| LYM946 | 75675.4 | 0.0 | 0.26 | 16 | — | — | — | — | — | — |
| LYM946 | 75677.3 | 0.1 | 0.11 | 24 | — | — | — | — | — | — |
| LYM934 | 75928.2 | 0.1 | 0.02 | 49 | — | — | — | — | — | — |
| LYM934 | 75928.3 | — | — | — | — | — | — | 0.5 | 0.23 | 17 |
| LYM934 | 75928.4 | 0.1 | 0.14 | 24 | — | — | — | — | — | — |
| LYM934 | 75928.5 | 0.1 | 0.26 | 23 | — | — | — | 0.6 | 0.10 | 27 |
| LYM914 | 75369.1 | 0.1 | 0.21 | 21 | — | — | — | — | — | — |
| LYM914 | 75371.4 | 0.1 | 0.15 | 22 | 0.7 | 0.29 | 22 | — | — | — |
| LYM865 | 75471.4 | 0.1 | 0.10 | 27 | 0.8 | 0.20 | 26 | — | — | — |
| LYM865 | 75475.2 | 0.1 | 0.06 | 26 | 0.7 | 0.24 | 23 | 0.5 | 0.23 | 17 |
| LYM865 | 75475.3 | 0.1 | 0.17 | 30 | — | — | — | — | — | — |
| LYM845 | 75742.1 | 0.1 | 0.08 | 27 | — | — | — | — | — | — |
| LYM845 | 75745.3 | — | — | — | 0.8 | 0.04 | 42 | 0.5 | 0.25 | 17 |
| LYM798 | 75663.3 | 0.1 | L | 46 | — | — | — | — | — | — |
| LYM798 | 75663.5 | 0.1 | 0.08 | 28 | — | — | — | — | — | — |
| LYM798 | 75664.1 | 0.0 | 0.21 | 20 | — | — | — | — | — | — |
| LYM798 | 75664.4 | 0.1 | 0.04 | 31 | — | — | — | — | — | — |
| LYM798 | 75665.1 | 0.1 | 0.02 | 35 | — | — | — | — | — | — |
| LYM774 | 75700.2 | 0.1 | 0.10 | 25 | — | — | — | 0.6 | 0.11 | 23 |
| LYM774 | 75700.3 | 0.1 | 0.07 | 27 | — | — | — | — | — | — |
| LYM765 | 75603.1 | 0.1 | 0.03 | 35 | — | — | — | — | — | — |
| LYM765 | 75604.2 | 0.1 | 0.02 | 31 | 1.0 | L | 62 | 0.6 | 0.03 | 30 |
| LYM765 | 75606.2 | 0.0 | 0.28 | 19 | — | — | — | — | — | — |
| LYM1002 | 75636.2 | 0.1 | 0.09 | 26 | 0.8 | 0.12 | 33 | — | — | — |
| LYM1002 | 75636.4 | 0.0 | 0.28 | 18 | — | — | — | — | — | — |
| LYM1002 | 75636.5 | 0.0 | 0.30 | 15 | — | — | — | — | — | — |
| CONT. | — | 0.0 | — | — | 0.6 | — | — | 0.5 | — | — |
| LYM955 | 75357.2 | 0.1 | 0.15 | 14 | — | — | — | — | — | — |
| LYM955 | 75360.2 | 0.1 | 0.03 | 18 | — | — | — | — | — | — |
| LYM955 | 75360.3 | 0.1 | 0.02 | 19 | — | — | — | 0.6 | 0.12 | 13 |
| LYM955 | 75360.4 | 0.1 | L | 28 | — | — | — | — | — | — |
| LYM945 | 75585.2 | 0.1 | L | 37 | — | — | — | — | — | — |
| LYM945 | 75585.4 | 0.1 | L | 46 | — | — | — | — | — | — |
| LYM945 | 75587.1 | 0.1 | L | 40 | — | — | — | — | — | — |
| LYM945 | 75587.2 | 0.1 | 0.01 | 22 | — | — | — | — | — | — |
| LYM945 | 75587.3 | 0.1 | 0.06 | 14 | — | — | — | — | — | — |
| LYM941 | 75579.2 | 0.1 | 0.12 | 18 | — | — | — | — | — | — |
| LYM941 | 75582.1 | 0.1 | 0.02 | 20 | — | — | — | — | — | — |
| LYM941 | 75583.1 | 0.1 | L | 79 | — | — | — | 0.6 | 0.24 | 16 |
| LYM941 | 75583.2 | — | — | — | — | — | — | 0.6 | 0.30 | 8 |
| LYM941 | 75583.4 | 0.1 | 0.07 | 21 | — | — | — | 0.6 | 0.05 | 16 |
| LYM926 | 75575.1 | 0.1 | L | 32 | — | — | — | 0.6 | 0.09 | 15 |
| LYM926 | 75577.1 | 0.1 | L | 24 | — | — | — | — | — | — |
| LYM926 | 75577.2 | 0.1 | L | 50 | — | — | — | 0.6 | 0.06 | 20 |
| LYM926 | 75577.5 | 0.1 | 0.09 | 15 | — | — | — | 0.6 | 0.22 | 11 |
| LYM921 | 75376.2 | 0.1 | L | 28 | — | — | — | 0.6 | 0.02 | 18 |
| LYM921 | 75379.1 | 0.1 | 0.05 | 19 | — | — | — | — | — | — |
| LYM890 | 75721.1 | — | — | — | — | — | — | 0.6 | 0.10 | 14 |
| LYM890 | 75721.2 | 0.1 | L | 26 | — | — | — | — | — | — |
| LYM890 | 75722.5 | 0.1 | L | 24 | — | — | — | 0.6 | 0.24 | 10 |
| LYM890 | 75723.2 | — | — | — | — | — | — | 0.6 | 0.13 | 13 |
| LYM890 | 75723.5 | 0.1 | L | 35 | — | — | — | — | — | — |
| LYM801 | 75557.4 | 0.1 | L | 25 | — | — | — | — | — | — |
| LYM801 | 75557.6 | 0.1 | L | 25 | — | — | — | — | — | — |
| LYM801 | 75559.1 | 0.1 | 0.13 | 37 | — | — | — | — | — | — |
| LYM799 | 73688.2 | — | — | — | — | — | — | 0.6 | 0.19 | 10 |
| LYM799 | 73689.1 | — | — | — | — | — | — | 0.6 | 0.04 | 18 |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM793 | 75549.4 | 0.1 | 0.22 | 10 | — | — | — | 0.6 | 0.07 | 16 |
| LYM793 | 75551.2 | 0.1 | 0.02 | 27 | — | — | — | — | — | — |
| LYM793 | 75551.3 | 0.1 | 0.10 | 19 | — | — | — | 0.6 | 0.06 | 22 |
| LYM793 | 75553.1 | 0.1 | L | 26 | — | — | — | — | — | — |
| LYM793 | 75553.2 | 0.1 | L | 37 | — | — | — | — | — | — |
| LYM788 | 75543.2 | — | — | — | — | — | — | 0.6 | 0.18 | 11 |
| LYM788 | 75543.3 | 0.1 | 0.06 | 17 | — | — | — | — | — | — |
| LYM788 | 75544.1 | 0.1 | L | 54 | — | — | — | — | — | — |
| LYM788 | 75544.4 | 0.1 | L | 40 | — | — | — | 0.6 | 0.01 | 24 |
| LYM788 | 75547.1 | 0.1 | L | 31 | — | — | — | — | — | — |
| LYM780 | 75063.1 | 0.1 | 0.15 | 23 | — | — | — | — | — | — |
| LYM780 | 75063.4 | 0.1 | L | 59 | 0.9 | 0.25 | 15 | — | — | — |
| LYM780 | 75066.1 | — | — | — | — | — | — | 0.6 | 0.12 | 12 |
| LYM776 | 75597.2 | — | — | — | — | — | — | 0.6 | 0.06 | 18 |
| LYM776 | 75597.4 | — | — | — | — | — | — | 0.6 | 0.14 | 14 |
| LYM776 | 75597.5 | 0.1 | 0.27 | 10 | — | — | — | — | — | — |
| LYM776 | 75599.4 | 0.1 | L | 33 | — | — | — | — | — | — |
| LYM768 | 75537.1 | 0.1 | 0.17 | 13 | — | — | — | 0.6 | 0.13 | 13 |
| LYM768 | 75537.5 | 0.1 | 0.15 | 12 | — | — | — | — | — | — |
| LYM768 | 75538.1 | 0.1 | L | 70 | 1.0 | 0.02 | 30 | 0.6 | 0.07 | 14 |
| LYM768 | 75539.1 | 0.1 | L | 50 | — | — | — | 0.6 | 0.12 | 13 |
| LYM768 | 75540.1 | 0.1 | L | 43 | — | — | — | — | — | — |
| LYM767 | 75533.2 | 0.1 | 0.30 | 12 | — | — | — | — | — | — |
| LYM767 | 75534.1 | 0.1 | 0.02 | 23 | — | — | — | — | — | — |
| LYM767 | 75535.1 | 0.1 | L | 39 | — | — | — | — | — | — |
| LYM756 | 75525.8 | — | — | — | — | — | — | 0.6 | 0.15 | 11 |
| LYM756 | 75526.1 | 0.1 | L | 31 | — | — | — | — | — | — |
| LYM756 | 75528.1 | 0.1 | 0.14 | 14 | — | — | — | — | — | — |
| LYM756 | 75528.4 | 0.1 | 0.01 | 27 | — | — | — | — | — | — |
| CONT. | — | 0.1 | — | — | 0.8 | — | — | 0.5 | — | — |
| LYM979 | 74243.1 | — | — | — | 0.8 | 0.06 | 37 | 0.7 | 0.04 | 16 |
| LYM979 | 74244.2 | 0.0 | L | 46 | 0.9 | L | 61 | 0.7 | 0.01 | 18 |
| LYM979 | 74244.3 | 0.0 | 0.02 | 27 | 0.8 | 0.04 | 34 | 0.7 | L | 19 |
| LYM834 | 74624.2 | — | — | — | 0.8 | 0.02 | 29 | 0.7 | 0.13 | 9 |
| LYM834 | 74625.4 | 0.0 | 0.08 | 22 | 0.8 | 0.01 | 43 | 0.7 | 0.20 | 8 |
| LYM834 | 74629.6 | — | — | — | 0.7 | 0.16 | 19 | 0.7 | 0.17 | 9 |
| CONT. | — | 0.0 | — | — | 0.6 | — | — | 0.6 | — | — |
| LYM977 | 73616.2 | 0.1 | 0.24 | 30 | 1.3 | 0.03 | 54 | 0.8 | 0.04 | 19 |
| LYM977 | 73617.1 | — | — | — | 1.3 | 0.01 | 60 | 0.8 | 0.17 | 11 |
| LYM977 | 73617.5 | — | — | — | 1.5 | L | 80 | 0.8 | 0.01 | 21 |
| LYM977 | 73618.2 | 0.1 | 0.07 | 47 | 1.4 | L | 72 | 0.8 | 0.02 | 21 |
| LYM977 | 73621.3 | — | — | — | 1.2 | 0.11 | 43 | — | — | — |
| LYM976 | 74030.1 | 0.1 | 0.04 | 52 | 1.4 | L | 69 | 0.8 | 0.03 | 20 |
| LYM976 | 74033.1 | 0.1 | 0.07 | 50 | 1.6 | L | 95 | 0.8 | 0.13 | 14 |
| LYM976 | 74034.1 | 0.1 | 0.14 | 36 | 1.2 | 0.02 | 52 | — | — | — |
| LYM976 | 74034.2 | — | — | — | 1.0 | 0.23 | 27 | 0.8 | 0.26 | 10 |
| LYM976 | 74034.3 | — | — | — | 1.3 | 0.04 | 61 | — | — | — |
| LYM975 | 74367.3 | — | — | — | 1.2 | 0.04 | 44 | 0.8 | 0.07 | 15 |
| LYM975 | 74369.1 | 0.1 | 0.11 | 41 | 1.4 | L | 70 | 0.8 | 0.13 | 13 |
| LYM975 | 74370.1 | — | — | — | 1.1 | 0.15 | 31 | 0.8 | 0.14 | 12 |
| LYM975 | 74370.2 | 0.1 | 0.01 | 70 | 1.5 | L | 80 | 0.8 | 0.09 | 15 |
| LYM958 | 73556.4 | — | — | — | 1.2 | 0.06 | 43 | 0.8 | 0.06 | 16 |
| LYM958 | 73560.3 | — | — | — | — | — | — | 0.8 | 0.21 | 11 |
| LYM958 | 73560.5 | — | — | — | — | — | — | 0.8 | 0.28 | 10 |
| LYM958 | 73560.6 | — | — | — | — | — | — | 0.8 | 0.16 | 13 |
| LYM944 | 73294.2 | 0.1 | 0.03 | 58 | 1.3 | 0.01 | 58 | 0.8 | 0.07 | 16 |
| LYM944 | 73295.2 | — | — | — | 1.1 | 0.14 | 40 | 0.8 | 0.11 | 15 |
| LYM944 | 73296.3 | — | — | — | 1.2 | 0.08 | 44 | — | — | — |
| LYM930 | 73778.1 | 0.1 | 0.08 | 48 | 1.4 | 0.01 | 68 | 0.8 | 0.09 | 15 |
| LYM930 | 73779.3 | 0.1 | 0.09 | 50 | 1.3 | 0.03 | 54 | 0.8 | 0.14 | 13 |
| LYM930 | 73781.3 | 0.1 | 0.20 | 32 | — | — | — | — | — | — |
| LYM930 | 73782.4 | 0.1 | 0.24 | 30 | — | — | — | — | — | — |
| LYM928 | 73772.1 | — | — | — | 1.2 | 0.07 | 42 | 0.8 | 0.13 | 13 |
| LYM928 | 73775.1 | — | — | — | 1.1 | 0.12 | 34 | 0.8 | 0.09 | 15 |
| LYM928 | 73775.4 | — | — | — | 1.2 | 0.04 | 50 | 0.8 | 0.06 | 16 |
| LYM928 | 73777.2 | 0.1 | 0.08 | 46 | 1.0 | 0.24 | 27 | 0.8 | 0.15 | 12 |
| LYM928 | 73777.5 | 0.1 | 0.04 | 58 | 1.5 | L | 87 | 0.8 | 0.09 | 17 |
| LYM925 | 73760.3 | 0.1 | 0.22 | 31 | 1.3 | 0.05 | 53 | 0.8 | 0.20 | 15 |
| LYM925 | 73763.3 | 0.1 | 0.24 | 36 | 1.2 | 0.10 | 49 | 0.8 | 0.29 | 11 |
| LYM925 | 73763.4 | 0.1 | 0.17 | 37 | 1.3 | 0.01 | 53 | — | — | — |
| LYM925 | 73765.2 | 0.1 | 0.26 | 30 | 1.1 | 0.09 | 39 | 0.8 | 0.22 | 12 |

TABLE 108-continued

Genes showing improved plant performance at Normal growth conditions under regulation of At6669 promoter

| Gene Name | Event # | RGR Of Leaf Area | | | RGR Of Roots Coverage | | | RGR Of Root Length | | |
|---|---|---|---|---|---|---|---|---|---|---|
| | | Ave. | P-Val. | % Incr. | Ave. | P-Val. | % Incr. | Ave. | P-Val. | % Incr. |
| LYM883 | 73874.3 | — | — | — | 1.6 | L | 100 | 0.8 | 0.16 | 12 |
| LYM883 | 73875.4 | — | — | — | 1.4 | 0.01 | 65 | 0.8 | 0.04 | 18 |
| LYM883 | 73876.2 | — | — | — | 1.4 | 0.05 | 66 | — | — | — |
| LYM883 | 73878.2 | 0.1 | L | 70 | 3.1 | L | 273 | 0.8 | 0.07 | 16 |
| LYM859 | 73892.1 | — | — | — | 1.2 | 0.05 | 43 | — | — | — |
| LYM859 | 73893.3 | — | — | — | 1.2 | 0.07 | 47 | 0.8 | 0.27 | 10 |
| LYM859 | 73896.1 | 0.1 | 0.10 | 42 | 1.3 | L | 64 | 0.8 | 0.16 | 12 |
| LYM856 | 74139.2 | — | — | — | 1.1 | 0.10 | 35 | — | — | — |
| LYM856 | 74140.2 | — | — | — | 1.1 | 0.09 | 37 | 0.8 | 0.06 | 16 |
| LYM856 | 74140.4 | 0.1 | 0.02 | 60 | 1.5 | L | 80 | 0.8 | 0.22 | 11 |
| LYM848 | 73695.1 | 0.1 | 0.05 | 49 | 1.4 | L | 65 | 0.8 | 0.13 | 13 |
| LYM848 | 73697.1 | — | — | — | — | — | — | 0.8 | 0.26 | 10 |
| LYM848 | 73698.7 | — | — | — | 1.1 | 0.19 | 33 | — | — | — |
| LYM818 | 74132.1 | 0.1 | 0.02 | 63 | 1.7 | L | 104 | 0.8 | 0.04 | 18 |
| LYM818 | 74132.2 | 0.1 | 0.08 | 50 | 1.3 | 0.03 | 54 | 0.8 | 0.20 | 13 |
| LYM818 | 74134.1 | 0.1 | 0.14 | 39 | 1.4 | L | 66 | 0.8 | 0.04 | 18 |
| LYM818 | 74136.3 | 0.1 | 0.05 | 52 | 1.5 | L | 88 | 0.8 | 0.12 | 14 |
| LYM760 | 73934.2 | — | — | — | 1.4 | L | 68 | 0.8 | 0.04 | 18 |
| LYM760 | 73935.1 | — | — | — | 1.2 | 0.05 | 47 | — | — | — |
| LYM760 | 73935.6 | 0.1 | 0.13 | 39 | 1.4 | L | 74 | 0.8 | 0.18 | 12 |
| LYM760 | 73939.3 | 0.1 | 0.14 | 38 | 1.1 | 0.08 | 40 | — | — | — |
| LYM753 | 74037.2 | — | — | — | 1.1 | 0.14 | 32 | 0.8 | 0.06 | 16 |
| LYM753 | 74037.5 | — | — | — | 1.1 | 0.17 | 31 | 0.8 | 0.18 | 11 |
| LYM753 | 74039.4 | — | — | — | 1.1 | 0.09 | 37 | — | — | — |
| LYM753 | 74040.3 | — | — | — | 1.0 | 0.24 | 27 | 0.8 | 0.22 | 13 |
| CONT. | — | 0.0 | — | — | 0.8 | — | — | 0.7 | — | — |
| LYM988 | 75013.2 | 0.1 | L | 71 | 0.8 | L | 51 | — | — | — |
| LYM988 | 75013.3 | 0.1 | L | 56 | 0.6 | 0.26 | 12 | — | — | — |
| LYM988 | 75014.1 | 0.1 | L | 75 | 0.8 | L | 66 | 0.6 | 0.10 | 14 |
| LYM988 | 75014.2 | 0.1 | L | 53 | 0.9 | L | 74 | — | — | — |
| LYM988 | 75014.5 | 0.1 | 0.04 | 17 | 0.7 | L | 33 | — | — | — |
| LYM960 | 75008.1 | 0.1 | L | 58 | 0.8 | L | 51 | — | — | — |
| LYM960 | 75009.1 | 0.1 | L | 74 | 1.1 | L | 116 | 0.6 | 0.06 | 19 |
| LYM960 | 75010.1 | 0.1 | L | 113 | 1.3 | L | 157 | — | — | — |
| LYM960 | 75010.2 | 0.1 | L | 43 | 0.7 | 0.02 | 36 | — | — | — |
| LYM960 | 75011.1 | 0.1 | L | 69 | 1.1 | L | 125 | — | — | — |
| LYM876 | 75902.1 | 0.1 | L | 63 | 0.7 | L | 40 | — | — | — |
| LYM876 | 75903.2 | 0.1 | L | 65 | 0.9 | L | 82 | 0.6 | 0.16 | 14 |
| LYM876 | 75904.1 | — | — | — | 0.6 | 0.04 | 22 | — | — | — |
| LYM876 | 75904.2 | 0.1 | 0.01 | 34 | 1.1 | L | 125 | 0.6 | 0.26 | 12 |
| LYM876 | 75905.4 | — | — | — | 0.8 | L | 51 | — | — | — |
| LYM862 | 75906.1 | — | — | — | 0.6 | 0.20 | 23 | — | — | — |
| LYM862 | 75906.2 | 0.1 | 0.20 | 18 | 0.8 | L | 53 | — | — | — |
| LYM862 | 75907.2 | 0.1 | 0.15 | 27 | — | — | — | — | — | — |
| LYM862 | 75910.1 | — | — | — | 0.8 | L | 58 | 0.6 | 0.06 | 18 |
| LYM843 | 75292.3 | — | — | — | 0.6 | L | 26 | — | — | — |
| LYM843 | 75293.1 | 0.1 | L | 60 | 0.8 | L | 65 | 0.6 | 0.12 | 14 |
| LYM843 | 75293.2 | 0.1 | 0.04 | 46 | 0.8 | 0.02 | 50 | — | — | — |
| LYM843 | 75293.6 | — | — | — | 0.8 | L | 61 | — | — | — |
| LYM836 | 75567.2 | 0.1 | L | 42 | 0.9 | L | 82 | — | — | — |
| LYM836 | 75568.1 | 0.1 | L | 44 | 0.9 | L | 73 | — | — | — |
| LYM836 | 75569.6 | 0.1 | L | 85 | 0.8 | L | 64 | 0.7 | L | 27 |
| LYM836 | 75570.2 | 0.1 | 0.05 | 17 | 1.0 | L | 99 | 0.6 | 0.11 | 15 |
| LYM836 | 75571.2 | 0.1 | L | 65 | 1.1 | L | 116 | 0.6 | 0.16 | 13 |
| LYM819 | 75564.1 | 0.1 | L | 44 | 1.0 | L | 88 | — | — | — |
| LYM819 | 75564.2 | 0.1 | L | 43 | 0.6 | 0.05 | 27 | — | — | — |
| LYM819 | 75564.3 | 0.1 | L | 74 | 0.8 | L | 54 | — | — | — |
| LYM819 | 75565.1 | — | — | — | 0.6 | L | 22 | — | — | — |
| CONT. | — | 0.0 | — | — | 0.5 | — | — | 0.5 | — | — |

Table 108. "CONT."—Control; "Ave."—Average; "% Incr." = % increment; "p-val."—p-value, L—p < 0.01.

Results from T1 Plants

Tables 109-111 summarize the observed phenotypes of transgenic plants expressing the gene constructs using the TC-T1 Assays.

The genes presented in Tables 109-111 showed a significant improvement in plant biomass and root development since they produced a higher biomass (dry and to fresh weight, Table 109), a larger leaf and root biomass (leaf area, root length and root coverage) (Table 110), and a higher relative growth rate of leaf area, root coverage and root length (Table 111) when grown under normal growth conditions, compared to control plants grown under identical growth conditions. Plants producing larger root biomass have better possibilities to absorb larger amount of nitrogen from soil. Plants producing larger leaf biomass has better ability to produce assimilates). The genes were cloned under the regulation of a constitutive promoter (At6669; SEQ ID NO:10575). The evaluation of each gene was performed by testing the performance of different number of events. Some of the genes were evaluated in more than one tissue culture assay. This second experiment confirmed the significant increment in leaf and root performance. Event with p-value <0.1 was considered statistically significant.

TABLE 109

Genes showing improved plant performance at Normal growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYM829 | — | — | — | 248.3 | 0.30 | 26 |
| CONT. | — | — | — | 197.8 | — | — |
| LYM970 | 11.1 | 0.02 | 35 | 255.4 | 0.21 | 30 |

TABLE 109-continued

Genes showing improved plant performance at Normal growth conditions under regulation of At6669 promoter

| Gene Name | Dry Weight [mg] | | | Fresh Weight [mg] | | |
|---|---|---|---|---|---|---|
| | Ave. | P-Val. | % Incr. | Ave. | P-Val. | % Incr. |
| LYM906 | 9.9 | 0.04 | 20 | — | — | — |
| CONT. | 8.2 | — | — | 195.7 | — | — |
| LYM863 | 5.2 | 0.10 | 41 | 97.7 | L | 35 |
| LYM833 | — | — | — | 89.3 | 0.04 | 23 |
| LYM813 | 5.8 | L | 59 | 108.0 | 0.03 | 49 |
| CONT. | 3.7 | — | — | 72.3 | — | — |
| LYM910 | 9.4 | 0.20 | 20 | 186.1 | 0.19 | 20 |
| LYM902 | 9.4 | 0.09 | 21 | — | — | — |
| CONT. | 7.8 | — | — | 154.8 | — | — |
| LYM863 | 11.5 | 0.03 | 27 | 256.8 | 0.03 | 31 |
| LYM813 | 12.7 | 0.05 | 41 | 263.3 | 0.09 | 35 |
| CONT. | 9.0 | — | — | 195.7 | — | — |

Table 109.
"CONT."—Control; "Ave."—Average; "% Incr." = % increment; "p-val."—p-value, L—p < 0.01.

TABLE 110

Genes showing improved plant performance at Normal growth conditions under regulation of At6669 promoter

| Gene Name | Leaf Area [cm$^2$] | | | Roots Coverage [cm$^2$] | | | Roots Length [cm] | | |
|---|---|---|---|---|---|---|---|---|---|
| | Ave. | P-Val. | % Incr. | Ave. | P-Val. | % Incr. | Ave. | P-Val. | % Incr. |
| LYM978 | — | — | — | — | — | — | 5.9 | 0.02 | 14 |
| LYM934 | — | — | — | 6.2 | 0.13 | 20 | 6.7 | L | 30 |
| CONT. | — | — | — | 5.2 | — | — | 5.1 | — | — |
| LYM995 | 1.0 | 0.28 | 13 | — | — | — | — | — | — |
| LYM970 | 0.9 | 0.07 | 11 | — | — | — | — | — | — |
| CONT. | 0.9 | — | — | — | — | — | — | — | — |
| LYM865 | — | — | — | 4.7 | 0.02 | 41 | 5.9 | 0.04 | 25 |
| LYM863 | 0.6 | 0.01 | 27 | — | — | — | — | — | — |
| LYM833 | 0.5 | 0.02 | 22 | — | — | — | — | — | — |
| LYM813 | 0.6 | L | 46 | 4.5 | 0.09 | 35 | — | — | — |
| LYM1007_H2 | 0.5 | 0.27 | 19 | — | — | — | — | — | — |
| CONT. | 0.4 | — | — | 3.3 | — | — | 4.8 | — | — |
| LYM902 | 0.8 | 0.11 | 12 | — | — | — | — | — | — |
| CONT. | 0.7 | — | — | — | — | — | — | — | — |
| LYM993 | 1.0 | 0.22 | 12 | — | — | — | — | — | — |
| LYM863 | — | — | — | 8.1 | 0.05 | 14 | 6.3 | 0.25 | 6 |
| LYM813 | 1.1 | 0.09 | 30 | 8.7 | 0.08 | 22 | — | — | — |
| CONT. | 0.9 | — | — | 7.1 | — | — | 6.0 | — | — |
| LYM934 | 0.7 | 0.09 | 20 | 5.8 | 0.11 | 13 | 6.7 | 0.27 | 10 |
| CONT. | 0.6 | — | — | 5.1 | — | — | 6.1 | — | — |
| LYM785 | | | | 0.19 | 0.14 | 47 | | | |
| CONT. | | | | 0.13 | | | | | |
| LYM794 | 0.15 | 0.4 | 19 | | | | | | |
| CONT. | 0.13 | | | | | | | | |
| LYM838 | | | | 0.2 | 0.06 | 86 | | | |
| CONT. | | | | 0.1 | | | | | |
| LYM964_H1 | | | | | | | 1.2 | 0.13 | 11 |
| CONT. | | | | | | | 1.1 | | |

Table 110.
"CONT."—Control; "Ave."—Average; "% Incr." = % increment; "p-val."—p-value, L—p < 0.01.

TABLE 111

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LYM978 | — | — | — | — | — | — | 0.7 | 0.02 | 17 |
| LYM934 | — | — | — | 0.8 | 0.11 | 20 | 0.8 | L | 32 |

TABLE 111-continued

Genes showing improved plant performance at Normal growth conditions under regulation of At6669 promoter

| Gene Name | RGR Of Leaf Area | | | RGR Of Roots Coverage | | | RGR Of Root Length | | |
|---|---|---|---|---|---|---|---|---|---|
| | Ave. | P-Val. | % Incr. | Ave. | P-Val. | % Incr. | Ave. | P-Val. | % Incr. |
| LYM829 | — | — | — | 0.8 | 0.11 | 32 | — | — | — |
| CONT. | — | — | — | 0.6 | — | — | 0.6 | — | — |
| LYM995 | 0.1 | 0.10 | 21 | — | — | — | — | — | — |
| LYM970 | 0.1 | 0.25 | 13 | — | — | — | — | — | — |
| CONT. | 0.1 | — | — | — | — | — | — | — | — |
| LYM865 | — | — | — | 0.6 | 0.07 | 42 | 0.7 | 0.04 | 28 |
| LYM863 | 0.1 | 0.03 | 37 | — | — | — | — | — | — |
| LYM833 | 0.1 | 0.06 | 27 | — | — | — | — | — | — |
| LYM813 | 0.1 | L | 56 | 0.6 | 0.05 | 38 | — | — | — |
| LYM1007_H2 | 0.1 | 0.19 | 24 | — | — | — | — | — | — |
| CONT. | 0.0 | — | — | 0.4 | — | — | 0.5 | — | — |
| LYM910 | 0.1 | 0.28 | 12 | — | — | — | — | — | — |
| LYM902 | 0.1 | 0.24 | 13 | — | — | — | — | — | — |
| CONT. | 0.1 | — | — | — | — | — | — | — | — |
| LYM993 | 0.1 | 0.19 | 13 | — | — | — | — | — | — |
| LYM863 | 0.1 | 0.19 | 12 | 1.0 | 0.19 | 14 | 0.7 | 0.11 | 9 |
| LYM817_H1 | 0.1 | 0.24 | 11 | — | — | — | — | — | — |
| LYM813 | 0.1 | L | 35 | 1.0 | 0.05 | 23 | 0.7 | 0.30 | 1 |
| LYM1007_H2 | 0.1 | 0.14 | 17 | — | — | — | 0.7 | 0.20 | 10 |
| CONT. | 0.1 | — | — | 0.8 | — | — | 0.6 | — | — |
| LYM993 | — | — | — | 0.7 | 0.22 | 18 | — | — | — |
| LYM934 | 0.1 | 0.02 | 25 | 0.7 | 0.17 | 14 | 0.8 | 0.10 | 11 |
| CONT. | 0.1 | — | — | 0.6 | — | — | 0.7 | — | — |
| LYM1003 | | | | | | | 0.6 | 0.4 | 7.6 |
| CONT. | | | | | | | 0.5 | — | — |
| LYM964_H1 | | | | | | | 0.7 | 0.35 | 8 |
| CONT. | | | | | | | 0.6 | | |

Table 111.
"CONT."—Control; "Ave."—Average; "% Incr." = % increment; "p-val."—p-value, L—$p < 0.01$ These results demonstrate that the polynucleotides of the invention are capable of improving yield and additional valuable important agricultural traits such as increase of biomass, abiotic stress tolerance, nitrogen use efficiency, yield, vigor, fiber yield and/or quality. Thus, transformed plants showing improved fresh and dry weight demonstrate the gene capacity to improve biomass a key trait of crops for forage and plant productivity; transformed plants showing improvement of seed yield demonstrate the genes capacity to improve plant productivity; transformed plants showing improvement of plot coverage and rosette diameter demonstrate the genes capacity to improve plant drought resistance as they reduce the loss of soil water by simple evaporation and reduce the competition with weeds; hence reduce the need to use herbicides to control weeds. Transformed plants showing improvement of relative growth rate of various organs (leaf and root) demonstrate the gene capacity to promote plant growth and hence shortening the needed growth period and/or alternatively improving the utilization of available nutrients and water leading to increase of land productivity; Transformed plants showing improvement of organ number as demonstrated by the leaf number parameter exhibit a potential to improve biomass yield important for forage crops and improve the plant productivity; Transformed plants showing increased root length and coverage demonstrate the gene capacity to improve drought resistance and better utilization of fertilizers as the roots can reach larger soil volume; Transformed plants showing improvement of leaf petiole relative area and leaf blade area demonstrate the genes capacity to cope with limited light intensities results to from increasing the plant population densities and hence improve land productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (11227 sequences)

SEQ ID NO: 1 - DNA, 1450 bp, Arabidopsis thaliana
aaacctaatctcatcaccttctcttccctccactcaaatctctcctctcttctttcttcttcttcaatacaatacaatcaaaagaacagagagataaggttagagcaaaacactgtctgaaacaaacaacaaaaaaatggcttgctctaatctaacaacaatgtgggtttcatcaaaaccatctctttctgctgattcatcttccttatcattccgatctgttctcaagtgcccaactaacacttcctcacctccttcacgagcttcctctgtttcaccactccaagcgtctcttcgtgagctcagagaccgtatcgattcagtcaaaaacactcaaaagatcaccgaagctatgaagcttgtcgctgcagctaaagtcaggagagctcaagaagctgttgtcaatggacgaccattctcagaaaccctagttgaagttctttacaacatcaacgaacagcttcaaaccgatgatgtcgatgttcccttaaccaaagtcagaccggttaagaaagtagctctcgttgtcgtcaccggtgatcgtggattatgtggtggattcaacaatttcatcattaagaaagcagaggcaagaatcaaagagcttaaaggtctaggtcttgaatacacagtcattagcgtgggcaagaagggaaattcttatttcctccgtcgcccgtacatccccgtcgacaaatacctagaagccggaactttacctacggctaaagaagctcaagctgtggctgatgatgtcttctctctgtttataagtgaagaagtcgacaaagtcgagctcttgtacacaaagtttgtctctttggtcaaatcagaacccgtgatccacacgctactgcctttatcacctaaaggagagatctgtgacattaatggaacctgtgtggatgctgcggaagatgagtttttcaggttaacgacaaaagaagggaaattgacagttgaaagagagacttttaggacaccaacagctgatttctcgccgatcttgcaattcgagcaagaccctgttcagattcttgatgctttgttgcctctgtatcttaacagtcagattcttagggcattacaggagtcattggctagtgagcttgcagctagaatgagtgcaatgagtagtgcttcggataatgcatcggatctcaagaaatcgctttcgatggtgtataatagaaagcgtcaagctaagattactggagagattcttgagattgttgctggagctaatgcacaggtttgatttgttttgaaccctctttgaatcttctatatgagtccaaaactctcttcttcttctttttttttcgttatcgtttgtataatgtataattgataatctctagaactctttataatcatgcaattacaaacaaaaacgcggttgtatctattttggcttttcattggataaaatgatggagatcttcgttga

SEQ ID NO: 2 - DNA, 1455 bp, Arabidopsis thaliana
ttcttctgcactgtttgtttataaataaaacctggaagctcagttccatggtgaagtatgttgtgttcaaccatatgagctctgatggtgattctggtaacaggaaattcatgaactttgtgattcattgcatcaagaatagaagactagaagggggaggttaattagattatcttaaggtgtataaaatggaaaaaaagagtgtaccaaattctgataagttgtctctgattagagtgttaagaggtataatatgtctgatggtgttagtttcaacagcttttatgatgttgatattctgggggttcttatcagctgtagtgttgaggcttttcagcattcgctatagccgtaaatgtgtttccttcttctttggctcgtggctcgccttgtggcctttcctctttgagaagattaacaaaaccaaagttatcttctctggtgataaggttccttgcgaggatcgagtattgctcattgcaaaccaccgaacagaagttgattggatgtacttctgggatcttgcactgcgtaaaggccagattgggaatatcaaatatgtgcttaagagtagtttgatgaaattacctctctttggttgggcgtttcacctctttgagtttattccagttgagaggagatgggaagtcgatgaagcaaacttgagacagatagtttcgagttttaaggatccccgagacgctttatggcttgctcttttccccgagggcacagattacacagaggctaaatgccaaaggagtaagaaatttgctgctgaaaatggccttccgatactgaacaacgtgctgcttcccaggacaaaaggtttcgtctcctgcttgcaagaactgagttgctcacttgacgcagtttatgatgtgaccatcggttataaaacccgctgcccatctttcttagacaacgtttatggaattgagccatcagaagttcacatccacatccgtcgtatcaacctgacccaaatcccaaatcaagaaaaggacatcaatgcttggttaatgaacacattccagctcaaagaccagctgctcaatgacttttactccaatggtcatttccctaacgaaggaacagagaaagagttcaacacaaagaagtacctcataaactgtttggcagtgattgccttcaccaccatctgtacacatctcaccttcttctcatcaatgatttggttcaggatttatgtctctttggcctgtgtctacttgacctctgctacgcatttcaatcttcgttctgttccacttgttgagactgcaaaaaattccctcaaattagtaaacaaataaactttcattgctttcagttcacaacttcacatgatggaatattttttacttttgtatttcggggttaagaatcaatccactttctacttatgcaatgtgaggtcaagctgcaatatatgattagctctattttagaatg

SEQ ID NO: 3 - DNA, 2593 bp, Arabidopsis thaliana
ttaattttgacgacaagctgtcttttagaccgacattaaggctttttatgttcacatcattccttggtttgacaatgtcacacgtcgactaaatcaagcgttaagcccacgagatatcaatttcctttttttgggcctgtctctctctccgaacgaaatcactgacctgacctgatctctctctctcttcctccgtctcttctccgtatcggctttaggtcttctccgggaagaaagcttcgaacccaattaacgccggacggtagactgtgaccgactagtccccaaaagctcaagtcaatgagaaaatgctcctcaattttaacgttttagagatccatacccaacaagccctgttttcgcatattctttccgttggtttctcaccatcttcgtcgctatgtcaagagttttgatctctaaaatcgttggaaagcaaacacaatctcttgtctcgaaccagaaagatagagtgtctcaatggggaagctatagaactgcttttacagctgctctaaggtcgcctcagctcagaacttactcttcatctggtaggattccgagtaatgtgtattgtacttttgcctttagagatctcaaaggaagttttttaagtaatcatctgtctcgaagttatactactgcccctgcaagaaatgtagttagtcatcatgcccaaattgcttggagaaggcttcattataagtattctgagcgtattagtaccattgctcaggcgtttagcttgtctcttacccgttcgcacttgttaatacctgggatcgttgctgtcacttgtggacaagtagcatgggcacaaagagctcctggttcggggataaatcactatgcttcagataaatctctctatacaagggctaagaatggtcctatctttctgtcttcgttattgttttcggttatagagggttttatcttgattgggagggctttttatatagcttgtttgtttactcctactattctgatggggctggttgtggaatcatgtgggcctcgttttaggaaaatatggcttgagatggtccatcgaactctggaaagagcaggtcctgcttttatcaaatggggtcaatgggcagccacgcgacctgatctattccccaaggatttgtgttcacagctctcaaagcttcacagtaatgctcctgagcatagcttcgcctacactaagaaaactatcgagaaggcatttggtcgtaaactttctgagatatttgaggagtttgatgaggtgccagtggcatctgggagtattgcccaagtacatagagcttctttaaggtttcagtatccaggacaaaagtccaagtcttcgctggttgcggttaaagttagacatccgggtgttggtgaatcgattaggagagattttgtgataattaatttggtggcaaagatatcgactttaattccagctttgaaatggttgagattggacgagagtgtgcaacagtttggtgtcttcatgttgtctcaagttgatctcgcgagggaagcttcacatttgagtcggttcatatataacttccgtagatggaaggatgtctctttccctaaacctgtgtatcctcttgtacatcctgctgttttggtggagacatatgagcatggagaaagtgtggcacgttatgttgatggaatggaaggacatgaatggattaagactagattggctcacatcgggacccatgccctcttgaagatgctcttggttgataactttattcacgctgacatgcatccgggaaatatccttgtccggaaaaaggcttcccgtggaggccttttcaaaacgaagaagcctcacattgttttccttgatgtgggaatgactgcagaacttgcaaagaatgaccgagagaacttacttgactttttcaaggcggttgcgcgtagagatggccggactgctgctgaacgaacacttaaattatcaagaaagcagaattgtcccaatccagaggcttttatcgaggaagtagaggaagcattcaaattctggggaacccctgagggagatttagtacatccagcagattgtatgcacgaattacttgagaaagtaagacgtcatagagtaaatattgatgggaatgtgtgcactgttatggtgacaacattagttctcgagggttggcaacggaaacttgacccaggatatgatgtgatgcacacgttgcaaacaatggtgttgaaaaccgactgggctaagtctctttcttatacggtggatggtctgatggcgccgtaggcgaagaaaggttccatctttttgaaattttgtttgttatcatcataggagtcgaaacaatttacacatcttagatgagagaacatagaaagaaagtacatgttcttatgttccttttgtttttttctttcattcttttgtcttttgctttttattgtcatggattttggttcattctaactacatagattgtatttacgcggttggtttccgttataaaccgcctgtttattctctgaaccaaagaacagtgaacaaaaacactgaaacatgttgcctgagaatggccaagaagatatgaataaagtgtttacatcc

SEQ ID NO: 4 - DNA, 1558 bp, Arabidopsis thaliana
gactttggaggaatgtagagatttcagaaaatcccaaaaacaaaacactttagatttcatttcgatcgctattcctcccatgcatttttttgattaatcgaatctttgttttctttttcaacttcgaacttttgatttccctccgttcaatatatcattgaacttaacaatcatatgtttctgtggcaatttgtgtctttcttgcttgttatatgatggataacatcaactttgaattctcaaacgcttcacaaggaagccggctacagttgcagcaacaaccgccccagccgtttaatttacaagacttgaatatgattcaatacaatcaaccatcatctccttggactacggagaccttctctggtctaactccgtacgattgcacagccaatcaatcttttcccgtacaatgttcatcttcaaaaccctacccttcctcgtttcatccgtaccatcatcaatcttctgattctccatcattagaccaatctgtatcgatgattcctatgcagcctcttccggatcaatatatgaagccattatatcaaagatcttgctcgaacgattttgccgcaacaaatgcttcatcagcctcttactcgctttcttttgaagcaagtcatgatccacaagaactatgcagaaggacctatagtaattctaatgtaacacatcttaatttcacatcatcacaacatcaacctaaacagagtcatccaagattttcttctcctccttcattctcaatccatggagggtctatggctcctaactgtgtgaacaagacacggataagatggactcaagatcttcatgagaagtttgtggagtgcgttaatcgtcttggtggcgctgataaggcgacgcccaaggcgatattgaagcggatggattctgatggactcacaatatttcacgttaaaagccacttacagaagtatagaattgcgaaatacatgcctgagtctcaagaaggcaagtttgagaaaagagcttgtgcaaaagagctgtctcagcttgacacaagaactggagtgcaaattaaagaggcacttcagcttcaactagatgttcagaggcatcttcatgaacaactagagattcaacgaaacctacaactaagaatcgaagaacaagggaaacaactgaaaatgatgatggaacaacaacaaaaaaacaaagagagtcttctgaagaagctaccagacgctgaagcatcattgtctcttctcgatccccatattcactctcctccttcgcctttcttggtacacgacgctgaagccctgatgctaacaagttatgaagacactcaactccagtccaccaaaagttgaaaaatgagagatactctggctaaattagaaaaggcctaaagcatgtttctactctattcaaagtggtataaagttataagagtcgcgacaagaatgtccaaagtgctacacacactaacacttggaaacagaatcaggtactaaatgtgagcaagtggtgtgtgatggggtcgatctctgtcatagactaatagatgtgtgagattttttttttggta

SEQ ID NO: 5 - DNA, 1851 bp, Hordeum vulgare
cccccacgccgcgctagggcttaccaaaccccccaggggcgggcggtggtgattcttgctgcctgcgaggaggatgcaggccaccgggagcgtgacttgggtcgtcggcgcccaggcgtccgtcttggggagatgcagcggcggggtgccctacccttcgccgtcgtcttctgcttcctctgtcaggtcccaggggctcggcacggtgcggtgctccgtgcaggcgcaggagaagaagccacgggttaggaagactaaggaggagcggagggagatggttgagtccttcgttgacacgtatcgggtttcaaacagcgggaagtttccttcagtcaatcttacacacaaggaggttggaggatcatattatatagtccgtgagattatgagagatatcatccaagagaacagagttcttggccctggtgacttgaatgctaagacattgagttttgaggattgccctgattcttcagaattatcaaataggcatgaattgggccaagacaacatagagatattagatatgtctgatgggtatcatggcaacaaagattctgtgttggaaatgtctgacaagggtgaagcattttcattgcaaacgaatttcatcagcactgaacagttcctgacttcatctgatatcttggaatctggtattctgaacagtgtactccacaatgggaatgtagaagatgcaacatgcttggagccaaaccttgagaaacaagatgaagccttgcgtgggaaaccaagggagtctcagactaagagttctgaaatgcaagccccatctcttgctcatgtttctgatttgcataaagaaactgagctcaacaatgcaggggatgcacatgacgaaacaaccagtagcatcactgatgaggttactctttcctcagaacctagtgtagtttctcaaacaaacggtgcacttctacatgagcatgtgacactacctgacgattgtggtggcataactaatactgctgtcgatgaagctattggttgctcagaaaataatggtgttcttcagacagatcggatccttatacaggagcatgagatattacctgaaacagcaagtatcaagacagaagttgttaagattgcagatagccaatttagatctgcaacatctgcaactcaaatggatgcttataccttgaatacaagtgcagcaacaatggaatccgctgcgtccattgatcatcatgatgtgcttgagccaccactgatcaatgccagccctaaccaacaacgaatgtcagaagatcttgcctctcatccagcaatggatacaaagggttttttgcaaaaggaagacaaccacaacatggtagagaaagatggaagtgaattcaagatatcagtatctggcatcacagaagaagagcgcgaggcaagcaaggccaatcatgaacatgtgataagtgcgacaacagcgatcagcaggagaactgggaagggacagcagaagaaagaggacaacctattttggcttatcgtaagggcatttgttgtttctatgtccaagttgtgggcaaaatgattgatgggcgaaatgcatcttcatctgataccgctgcgctgcatgggatgtcttcctgcctactaagaaacgagaagcactttgtgaagctccattctccccaatgcatatagatgttcttcttgcgcagcacttagggtgttttgttatgcttggtttagtttatagcctaattttgtagttcagatgtattggtcaacttgctctgctgtgtcaagttgacactgccaactctagcgtactgaggaatttctcattttgtaagagtacgatttgtcctgagatctgaaagaagcagt

SEQ ID NO: 6 - DNA, 2130 bp, Hordeum vulgare
acagttcccagtttcgcctccatttcaatttcaaccccgtctcctctccattcactcgccactcctcgctgcgctgcgccgcggagagttcctccctctctcaagagcccaccaaacgcacgcgcgggcggaggcgatcggcggcgcgatggcggcggcgacgacgatgacgtggcacgaggagctggccacgctcgtcggcgacacgggcgtgcgcctccctgccgccgcggcgccggcgcccaattcgggggcggcggcggtcgggggcggttggtacggggaggaggaggaggggaaggtggaggaggggtgggcgcagcaggccagggggttcgccgagtccacggcggagatgctgcgggagctggggctcggcgtgtgggacgtcgccgcgcagagcctcgccggcgccgaggacagcgagctcgcgcggcggctgcggcggccggcggcggccgcgggcaagcgcctcagcttcatgaacgagtacctccccgaggaccgcgaccccgccaggtgctgggccgtcgttgccgccgtcgcattcgtcgcgctcctcgtattaggtgtaggaagtggcgatgataccccagtggagcaaccgaagaaactttacataagccccccaaatgctaaaagatttcaacttcctgatggaaggcatctggcttacgaagaaaaaggaatttcagctggaagggcaagattttcactggttgccccccattcttttctttcatcaaggctagctggaattcctggaatcagctcatctcttctagaggaatttggggcacgacttgtgacctatgatcttcctggttttggtgaaagtgatcctcatccaggccgaaatctgaattcttctgcattagacatgcttcatttggccgatgcccttgggattgtggacaagttctgggttgtaggctattctggaggtggcatgcatgcttggagtgctctgcgctacattcctgaccgggtggcaggtgcagcaatgttcgcccctatggtaaatccatatgactccaagatgaccaaggatgagaaacgtaaaatatgggacagatggtcaactaaacggaaactaatgcacattttagctcggaggtttccatcactattgcgcctcttctatcaccgaagcttcctttctggaaagcaaggacagcctgagagttggttatcattgtcaacgggaaagagggacaaaactttactggaagctcctatgttcagcgcattctgggaaaaggatgttgcagagtctgtgcggcagggagatgcgcaaccatttgtagaggaagctgtgctgcaagtatctgattggggtttcagcttgtcagacattcaaatgcagaagaaagaggatcagggggtgtttgaatttatcaagtctctgttcagtcaggctgagcgagagtgggtgggatttctaggcccaatccacatttggcagggaatggacgatcgggtggtgcccccgtcggcgaccgaatttgcccggaggatggttccaggagccaccgtccacaagcttctcgacgaaggccacttctcgtacttctgtttctgcgatgagtgccaccggcagatattctccaccctgtttggcaccccgcagggccctctaaaccctgtaccggaacccagtgaagtggcccgggaaccgacggaagaaacaagccctgcatacgaagaagaagaagaagaagtcgcagaacaggagcaggaaacatcaggcctggcctgatatcatgttcagcatcaggatcatgagtatagatacaagagtacaagacgacgttactaggaacctcaacacagaccgacctcacagaaaagataggcttttccttccttgccgccggtggacaaatgctgaccgatagttggtggactgagcagagcgtcgagtataaaaggaagctctgggtctctggggtctggatggggggctgctgcaccgattgtgcgggttcagtataatgtacagaagtcttgaaaggtctgcgcatgaaatcacctgcttagtatgtggtgtaatgggatggttgtattactctctcagctatgcagaagtaaagtagtcttgctgcaccagcattcctgattcctgaaatg

SEQ ID NO: 7 - DNA, 1371 bp, Hordeum vulgare
tgagcgagcagagagagcagaggagtgagaagcgcgcccctttccgatggcctccacgtcctcgtctccgctctctcttgtcctcctccggccgctcccatgcagatccctcctcctctccaagcacaggaagccattccccaccccaagaactggccgcctagcagcttcagcagcagcagcaggagcccagcagcggttgctgcggccgccggagaccggccggtggagcgggagctcgaggagcggcagagacttcgcgtgcttatcctacaacaatccgcccccgccttccagtaaggactcgaatgagtggcccatccttcgccggtgggatgtgccgtgggagtggcaaactgttgtgctcagcatggtgggctgtggagtaagctttgctctgacaggattggttgagcagtcgatattgcaatacgtagggtattcagccgcgggggcaaccatagatgagaaggcggagatactgttcctcggacaacttagcgtgactgctgttgtgcttggtgttatatttagcatcaccaataccttccgaccgttccctgatgatgtcttccgttacgatgttaaagaaccattcaagctgcaaaatggctggcttctgtgggctggtattggcctctttggtgcagtcatttccattgctttagttggagctgccatgagctatctgaatggtgcacctccagagagagagaaggactcactggtccttttactgccactaattggctcatcaactctcagcactgcctatttggtggggattactggagttctagcaccaattctggaggagactgtgttccgaggatttctaatggtgtccttgactaagtggtttcctactccagtctgcgtgattctcagtgctgctgtatttgccttcgctcatttgacacctgatcaattcccacaactgtttgtattaggtgttgcactaggatttacatatgctcaaactcgcaatcttctagctcctattacaatacatgcattttggaactcgggagttatactgctgctaacctttcttcagttgcaagggtacgatatcaaggagctattgggggcatcttgaaggctttataaccgatctgatttcagctttgtgcatatccttgagtaacttccgcagaaagacctggaagaagaatgagctttcctttattcgactgcttagtgtatgatcttactgggtaaggcacgcaatgtatggtctataagatgtcttacaaaatatgattgtgtatggttcctttcatactactgccaacctacgtggtggaaaatgttcaatcatacaaatagacaatacggttattgctataagaaatgcattgtacttgtacg

SEQ ID NO: 8 - DNA, 600 bp, Hordeum vulgare
acgcagaccaatcttcggcgagcccatcggcacattctcagagcggagaggaagcaggaggcggcggatcaaggagaggagacgagaagatgggtggcggcatggaggtgaacaagaaccggtggatcgaggagtggaacgccggccgggagaacctcgagctcaacttccgctttacccgccgcagcctcgccgtcatcggcctcttcggcctcgccgtccccatcctcgtctacaagggcatcgttcgcgaattccatatgcaggacgaggacgccggccggccgtacaggaagttcctgtgagcgtcgcctccggtggacgtcgaggctccgagccgtctgcagggcttcggtcagggagaaggaatctccattcggtttgttcccgtactgttgtaatcaggccggagtattttggagatctcttatgttgtgcggtttgcgtttaataagctgtaaggaaatgctgcttttctgattgctgaaacctgacaagtctgaattggttaatttgagggtgaatgtttatgttatgagatgctatttgtgctttgaattgaacggggagtaatacgaggcgagtgtgtatggccttctg

SEQ ID NO: 9 - DNA, 1085 bp, Hordeum vulgare
ataatcgcggcgtcggcggctgcggcggaaccctcccggcgatcaccggactcaccccggcaggcaaagcaatgaggaggtacagcccccagtaccggagccccccaaggaggggatatggtggcagaggtagaagtcccccaaggaggggatatggaggacggagggagcagggttcaggaagcctcttggtccgcaacatcccattaagctgcaggccggaggatcttagagttccttttgaaaggtttggtcctgttcgggatgtgtacctgccaaaggattattacaccagggaaccccgagggtttgcatttgtggagtttgttgacccttatgatgcatctgatgcacaatatcacttgaaccgctcattattttttggccgagagataactgttgttgttgctgccgagtcacggaaaaggccagatgatatgcgtaatagagctagagtcagggggtattctggtgaacctgaaaggcgtaattctcgttatgggaggtcccgttcccgttcacgctcctactctcctcgctatcggggccgtcctcggtcaaggtcaaggtcatactctcctgctccaagacggcgagatgattactctgcttccccaccaagatcacatcacacacagtctcctaggcgtctgccaaagggacatgaagaagacgagcggagatcctattctcctgctggtagaggtggcggcgagcgtgatgctgatactaatggaaagagaaggtcgccaccatctgacattgacaggtcgcctctacgctcacgtaggcactcctcggggtcacctgtggggtcgcgctcaaggtcccctgaagcttctcctgcccgcagcgactgataagattggcggtgttacccgtattgccccgtctcccgtggccatgtactcttatctctagcttcattgtctgagtaaaacccatctgggatgtgttggctggtgctgcggtgcctctttagttagcagatgtgacttgttggctgcttggtgttgctgaaccttgtaccattgtagtgttttattgtgaaccgagccacaactaagccacaattgttattgttg

SEQ ID NO: 10 - DNA, 902 bp, Hordeum vulgare
ccctgttggaagagttcgtgcgaaggccagcacacaccctcccatccctcctctccggccacaaccccaccgccgccgccatggtgaagtactcgagggatccgtccaacccgaccaagtcggccaaggcatgtggcaaggatctcagggtccacttcaagaacacacgcgagacagctttcgctcttcgcaggatgcctttgggcaaggctaagaggtaccttgaggatgttctcgctcacaagcaagcaattcccttccgtagatactgcagaggtgtgggccgtactgcacaagtaaagaaccgccagccaaatgggcagggtcgctggcctgcaaagtcggcccagttcgtgctggatttgctgaagaatgctgagagtaacgctgaagttaaaggcttggatgtcgacaacctctacatttcacacatccaggtgaaccaagcccaaaagcagaggcgccggacgtaccgtgctcatggacgcatcaacccttacatgtccaacccctgccacattgagctgatcttgtcagagaaggaagagcctgtgaagaaggaggctgacaacgtcgttgcaccaaggaaagctatctaagctaacggagtggctgcatttgtctgagaatcttagttgtagttcctttcaagtacctttggtggcagtgtttgttgcctcctagatgtttttggtaccaacatggagtaaggatttgttaaggttgatgctatccttgtgattgcgaatggtctttatatatgctaaaactgtttcggatattcgagcattagcccaccagaacttgtttcttagagatctttgtcctttcgggctgtacacttaagagtttggcaattcactttttggttgctttgaatgatccactttttagttgaactg

SEQ ID NO: 11 - DNA, 1222 bp, Hordeum vulgare
gcgagggatccgggtcgcagtagaagccggaagcagcagccgcagcgtagaaaaagacgccgtctttcccaagcgcccccctcctccaggaaccaaatcgaacaaccgagagaagccatggagcgactgcagcggatcttcggcgccggcgggatgggccagccgccgtcggactcgccgctgctcgactcctccgagcaggtctacatctcctccctcgccctccttaagatgctcaagcacgggagggccggcgtgccgatggaggtcatgggccttatgctcggcgagttcgtcgacgactacacggtccgggtggtcgacgtcttcgccatgccgcagagcgggacaggggtcagtgtcgaggccgtcgaccacgtcttccagaccaacatgctcgacatgctcaagcagaccggcaggccagaaatggtggtagggtggtatcactctcatcctggttttggttgctggctatcgggtgtcgatatcaatactcaacagagttttgaagctttgaaccccagggcagttgctgttgtgattgaccccatccagagtgtcaaggggaaggttgtcattgatgcatttcgtctcattaaccctcagaccatgatgcttgggcaggagccacgacagacaacatcgaatgttgggcacctgaataagccatctattcaggctcttattcatggtctcaatagacactactactccattgcaataaattaccgcaaaaatgagctcgaggaaaagatgttgcttaaccttcacaaaaagaaatggaccgatgggttaattctgaagaaatttgacgcacattcagaaaccaatgagcagactgttcaggaaatgctgagcctagccatcaagtacaacaaggcagtgcaagaggaggatgagttgtcccctgagaaattagcgatagctaatgttggacggcaagatgcgaagaagcatctagaagagcatgtctcgaatttgatgtcgtcgaacatagttcagaccctggggaccatgcttgacacggttgtcttttagtctaccactagtgttgttccaaccatctatagactcacccagtctatcattcatgttatatgtatcaaaagcctgcctccacgcagcaaggtacattcgggttctaacagtttgctcgacagactcaattttctgtagtactatcttcttgtatgtttaatttcgcagcaaagttcatccc

SEQ ID NO: 12 - DNA, 507 bp, Hordeum vulgare
agagacacagcttgcgaacgcggcgggcaatggcgatcagggggataccttcggcgcgggagatgacgatggaggagttcaaggagtggctgaagcagttcgacgtggacggcgacggccggatcagcagggccgagctccgcgaggccatccgccgccgcggggggtggttcaccaccctcagggccgggcgcgccgtccgccgcgccgacagggacaacagcggcttcatcgacgacgccgaggttgagaacctcgtcgccttcgcgaagaaggatctcggcatgaggatctctgcctggtagccacctgcctggactgtggctccatgggtttttatcttctatgctatgctcggcctactgaatgaaaattagtaaccactacagtaagcgtcctgtgatacagccatacaggttgaacttgacatggcaacttgtcctgaataacatgtgtaaaatcaggagatttaattaagtgttcgcgactatgcagtagattgaaaaa

SEQ ID NO: 13 - DNA, 1033 bp, Hordeum vulgare
ccccgctccgcggccatggagaccctcctctccccctccgcattgctcggcccgctccggggctccaggaagctagcggcccccgccgccgtcccgtgcagcaggtccgccgtctcctgctcgctcaagaagcagacgcagacgcaggcgggcgtcgcctggcatggagacggcggcgtcgggagctgggcgtcgttcttgcaccacggcctcgccgcggcggcgctgtccctggccctcaccctgtcgcccgcgcccgcgccggccgtggcgtcggagttcgacgtgctcaacgacgggccgccggccgacacgtacgtggtggacgacgccggcgtgctgagccgcgtgacaaagtccgacgtgaagcgcctcgcccgcgacctcgaggcccgcaagaacatccggatcaacttcgtcaccgtccgcaagctcacgagcaaagctgatgcgttcgagtacgcggaccaagtgctggagaagtggtacccgacggtggaggagggcagcaacaaggggatcgtggtgctcgtcaccagccagaaggagggcgccatcaccggcggcccggccttcgtgcaggccatcggcgacgccatcctcgacgccaccgtctccgagaacctcccagtgctggcgacggacgagaagtacaacgaggcgatcttctcgacggcgaagcggctggtggcggccatcgacgggctgccggacccgggcgggccggcgttccaggagagcaagcgggagtccaacttcaagagcaaggaggagacggacgagaagcgcgggcagttcacgctcgtcgtcggcggcctgctcgtcatcgccttcgtcgtgcccatggcgcagtactacgcctacatctccaagaagtgatccagtcgagcgccgtgcactgtacagtacagtaatttttcgaatccccccggttttctgttggactaaagttttagaagtgaacagagagagatcaatgcaagcgcacccgcactcgtgtgcaatgttcggagccaaggaatttgacagatca

SEQ ID NO: 14 - DNA, 782 bp, Hordeum vulgare
cggcacgaggccgatagctccggcccagttaagcccaggtcgaagtctcgcccagatcgggggtttatgtctccttccccgctgagaaaagaagcagctcgtggcagctccctgcaaaaaccctagctttacctccgccaccaagcgcctccacgatgaagctcgtcagattcttgatgaagctgaacaacgaaacggtgaccatcgagctgaagaatggcaccaccgtccacggcaccatcatcggtgtcgacatcagcatgaatactcatctaaagactgtgaagctcacactgaaagggaagaatcctgttacccttgaccaccttagtgtaaggggaaacaacattcgttattacatccttcctgacagcttaaacctggagacgttgctggttgaggaaacaccaagggtgaagcctaagaagcctactgcagggaaacctatgggtcgtgggcgcggccgtggtcgtgggcgcggtcgtggcagggggcgctgagctatgttataccttggaaattttgcactgcatgcttgtgtgcagtgtaatcttgtttcttagttgtcggagcaatattcgtattagagccaagacgttgatattggctgtacccagctgttcttgatgtggaattatgttgttggtgtttgactgatgttcaaaagtgtgctagctttatattacgattactgtgtcatgattcccacttctaggaacagatatgtttatttggactagcaagcgtgcacgtgcgtaatataaaattagtcaaacattaca

SEQ ID NO: 15 - DNA, 722 bp, Brachypodium distachyon
ctccgatctgcccgccagccttctccctcgtccatcaccatggcgacccacgttcccggatccctattctcgttcctcgtcgttctcctcttctcctgcgccctgaccgccggcgctctgcggttcgacctgtactcgggccacacaaagtgcatctccgacgacatcaaggtcggcgccatggccgtcggcaagtaccacatcgtgcagcccgaggactcctctcagctcccggacccccaacgcatctcgctgcgggtcacctcgccctacggcaacagcctgcactactcggagaacgtgcagtcgggcaatttcgccttcacggcgtccgaggccggggactacctcgcctgcttctgggcgcccgacttccgcccgccctccaccgtcgccttcgagttcgactggcgcggcggcgtcgccgccaaggactggagcaccgtcgccaagaagggccaggtcgatataatggaacttgagctcaagaaacttgaggataccatcaaatctatccatgaagaaatgttctatcttcgtgaaagggaggaggagatgcaggaactgaactggagaaccaactcacggatggcttggcttagtttcctctcacttggtatctgcttaccagtggcagcgttgcagttgtggcatctgaagaacttctttgagagaaagaagctgctatgatttctctacgactaagaacattttggcacaaa

SEQ ID NO: 16 - DNA, 1034 bp, Brachypodium distachyon
ttccctcatcgggagaagaagaaaaaagcataagcaaacgagcctgggatctctctggtttcctcatatcaccagagaaagaagagaggaggggagcgtgcaagaggcggaaatggctgcgatatcagcagcattctccggctgctgctcttcgtcctgcctgtcccagccgggcctgctgccgaccacaaagtcgagaaggcacttcaaggtcacggccatggctcccaagaacaaggtgaacaagtacgacgaggggtggtcaaagcagtggttcggggcggggatcttcgcggaggggagcgaggaggcctccgtggacgtgttcaagaagctggagaagcgcaaggtgctgagcacggtggagaaggccggtctgctgtccaaggcggaggagctgggcgtcacgctctcctcgctggagaagctgggcctgctctccaaggccgaggacctgggcctcctcagcctcgtcgagaccgccgccaccgtgtcccccgccgtgctcgcctcgctctcgctgccgctgctcgtcgccgccatcggcaccgtcgtcctcgtgcccgacgactcctcgctgctcgtcacgctccagacggtcgtcgccacgctcttcgccgccggcgccgcagggctgttcgtcggctccgtcgtgctcgacgggctgcaggaagcggattagcatcatggcgattggcaaatggcaactagtatgctctgagtaaacgatcaccactcgcagttatgcatcatgcaaagcaagcgcgattgctcaagaaattgcgattacgtgcttgctgtggatgctctgtgtaattaggaaaacaagtgttctttcgttcgtccgaaaatgcagatgcagatgtatgtggccatagtatattttctgtgccgagctcagctgaccatgatatgctgggcagtgggcaatgacattttggacttctcttggcgttgtgccgttgtgaggtcttgcttcgtcatggtgacccaggtatacagagcaaattccaggtctctgcttcctttgcaac

SEQ ID NO: 17 - DNA, 2209 bp, Brachypodium distachyon
aacagtcacaacggcatcaaccctctccttatccccttgcgtctcccgctctcccccaaccaaagctcgcccgccatggccatggcctccacctcctcctgctcctcgcggccgccgctcctccacccggcctccagaaccccgaacccctcccgcctcccgccgctcgtctccagggcctcctcctctccccgcccgctcctcctctccttcgctccgcccgcgcgcgggcggttccgcgccgccgctgtgcagcaatccgacttcgaagacggggaggaggaatgggatggggaggtggaagaggagtattacagagaggaggaggaggtggaggaaggggaggagatggacgtggaggcgatggaggaggaggcgcgggccgccgccgccgacctcgccgcgcgcctcgaccgcgagctccgcgtcgatggtgatgttcgggagaaaagaagaaccatgagggataagacatcgacatctaaacatatcccagacaataatcttccgaaggtggcaattattggcaggccaaatgttggtaaatctgcactgttcaatcgtcttgtcgggagcaacagggctatcgttgtcgatgaacctggtgtgaccagagatcgtttgtatggacgatcttactggggtgatcaagagtttatggttattgatactgggggtgtgattactctttcaaagtctcaagcaggtgtaatggaagagcttgccatcacaactactgttggtatggatgggattcctctggcctctagagaagctgctattgccaggatgccatcaatgattgaaaaacaagctgttgctgctgttgaagaagcaactgtacttctattccttgtggatggtcaggctggtcttgtggcagctgacatagaaattgctgattggttacgtcggaacttctcacacaagtgcatcatacttgctgtaaacaagtgtgaatccccaaagaaagggcaaatgcaagcattagaattttggtcactagggtttacacctgtatcaatatctgctattactggcactggaactggagagctccttgacatggtctgttcagaactgaaaaatttcgagggactagaagggttggatgatgttgaagaagacgaaaaccgtgttcctgcaatttccatcgttggaagaccaaatgttgggaaaagtagtattctaaatgctttggttggagaagatagaactattgtaagcccagttagtgggaccacccgtgatgccattgacactgagttcaccacagaggatgggcagaaattcaaactcattgataccgcaggcatccggcgaagagcagcagttgcttctgctggcagcacaactgaaacgctttcagtaaaacgtgcatttagtgccattcgtcggtctgatgtggttgcccttgttgttgaagcgatggcctgcgttacagagcaggattataaaatcgcagaaaggatcgagaaagagggaaaggcgtgtgtcattgttgtgaacaaatgggatacaattccaaacaagaacaatgagagcactacgcattatgaactagatgtaagagagaagctccgagtacttgactgggcacctattgtttattgctcggcaatcaatgggaacagcgttgaaaagattatttcggccgcttctttggtcgaaaaggaaaggtccagaagacttggcacctctattcttaatcaagtggtaagagaagccgtagcattcaaagcaccgccgcggacaagaggcggcaaaagaggccgtgtctactacacaacacaggccgctgtccggccgccgacgttcgtgctcttcgtgaacgacgcgaagctcttcccggagccgtaccggcggtacatgcacaagcagctccggtctgacgccgggttcccgggcacgcccatccggctgctgtggcgcagcaggaagcgggcggacaagcagcggcggaagtccaacaacacggaggctcgtggctcgctcgtaggagccagttcgtagcacgtgaaaaggaatgccagaaaaggaatgcatgcctctatgtcgcgaaagaaaaagagaagaaatgtactagcgagttattaggaccgtcacaaggctatagagctttgaagctttgaactttggtttcaaccagattttccggtctagagatcatattcatatctcatagtaatataagtcaatactaacacca

SEQ ID NO: 18 - DNA, 3802 bp, Brachypodium distachyon
agacgcaaactccggataaaactcctcatcgtctccatcctaaaccccgccattcccctcctctcctccccccaatggaggcctccgcctcctctacgcctcaagctctcaccctcctcacctcctcccctcgctttctctctctccacccttctgctcgccagcgcggccgcggcagcggaggagggctcctgctgcggcctccgcctcaccggaggttagagctgggataccgtgccaaccgcccgctggggtgctccgtcagcggctcgacggacgtatcagtggacgttctgggcggcccggttgccgccgcggccgctctcctcgctgccttgcagctgttgtggctcaggtggcgcggcgcgagggatggggaatctccggaggttttatgtacacaggacaaaagcattgtaaataaggaacttaggacaacaacacggtcggtatatgatagtaattatgcaccttgtgcaactcatgaaaatggattttcagagctatctgtttctggaggaatgactcctgaagtggagtgccaggctggtattccgtgtgtagatactgtaaatacgacaacacgggctgtttctgcgattactcgagggacatcgttacagacattatttgatgtatctggaaaagaagaagctagttgctcaacttcagcagaaaaaacaagttccactgaaaatattatgaacgttcttgcgatgccacactctctgtcacaaggacaacatacaaagtatatctctaacagaatgggctggcaaggtggactctctcgccattttttatccctttcagaacaaaaggaacatgctcaaattgacaaaggtcctagtgatagcaaaacagacagtgagaatgctcatttgcttcaatgccagcagagtgaccaagaggaaaatcttgatttgacatctctttcatcctttaaaagaacagtggaatgccctcttaattttgttccccaagccagaactggaaatttgttcaaatcaagaaaagctattgagtttacagatccatatgaagggggctcttatttgacaccagggaaattagttccggttgcatgcttaagggaaggtcctgcgagtaaacaaaagaaagcagtgaaagatcatgacgctgcaaaaactattggctggactatttccgaaatactgagcaaggagaacctagagaacttcattccggcaaagacacttggattaaacggcacagtggacacatcagattacataaggagatacaatagttcattaatggatggaaggttgaaagactgcgtagatttgttggaaaacatggagcagaagggattgcttgatatgaagaagatccaccatgccagctttttgattgcctgtaagaagcaaagggctgttatggaagctgttcgcttctgcagattgattgcaaatccgaaaatgagcaccttcaacatgcttttatccgtttgtgctcattcacaagattttgatggggccctccaagttatgatgctcctaaaggaggctgggctaaaacctgattgtaaactttacacaacactgatatcaacttgtgcgaagtgtggaaaagttgatgcaatgtttgaggtcttccatgagatggtcagtgctggaatagaaccaaatgttaacacatacggtgcactaattgatggctgtgctaaagctggacaagtggcaaaagcatttggtgcttatgggatcatgagttcaaagaaggtgaagccagatcgagttgtcttcaatgctttgatcagtgcatgcggtgaatctggagctgttgctcgagcttttgatgttttatcagaaatgacggcagaaccctccgaatctaaaggatggaagccaattcttcctgatcatgtcacagttggagcacttatgaagacatgtattcaggccggccaggctgatcgagctcgtgaagtttacaaaatgcttcaggagtacaatataaagggtaccccagaagtttacacaattgcattgagaagctgtagcttgactggtgatctaggtttcgcactgaagatctatgaagatatgaacaagattggagtaataccggatgagatgtttctgagtgctctagttgatgtagctggccatgctaggagggctgatgctgcctttgaaataatcaaagatgtaagagcaaagggatttcatgttggaatcatggcatacagttcctttatgggcgcttgttgcaatgccaaggactggaaaaaggcactacagctatttgaggagattaagatcagcagattaactccaacagttccaatgatgaatgctctgatcacttccctatgtgatggcgatcaagttcaaaagtctattgaggtccttaacgagctaaaggaatttggtgtccgtccaaatgagataacctattctgtcttatgtgtggcttgcgaaaggaatggtgaagcagaactaggtattgatctatttgaacaattaaaagtagatggtattggccttaatcccaccattgttggttgtgttactggtttgtgtctacaaaagttttccaatgatctttcccttggcaatatcattgtcagattcaacctggggaaaccacagattgataataaatggaccacctcagcaattatggtcttccgtcaggcaattaccgctggtctgttaccctcaagtgatgttttatctcaagtgttgggatgtttgaggtttcctcacgacagttcattgaaaagtactttcattgataacatgggaataagttgtgatatgccacatcaccctaatacatattcactattggaaggattcggtgaatatgatgttcgtgctttctcaatactggaggaagctgctttgttaggagcagtggcaagtgcttccacaaaacatagccaaattgtcattgatgcaagaaagtcaaagatgtacacagccgaggtttctcttttgatgacatttaagtccctgaagcatcgactagctgcaggtgcaaggttaccgaatgttacgattttgttacccacagaaaagaaacaagttgatcttgatgaaagagagaaaacacttaaacttgctggaagagttggtcaagcagtcggctcccttctgagaagattgggaattaaatatcaaggcgaggagtctcacggcaggatgaggatcaacggcctcacactaagaaggtggtttaatccaaaattcacgagcacaccctccactggaacaccagcagaattgcttccactaccctcgagattagcaaaagggatcgctgatcagcagcgcgatatcagaagcctttctttatagcacaggtttaaccttttccatggcccaaattttggataccaagaaggcaatttaccgtacagcatcagcagacctcagaaactagctagtcaaaaagatcaggatgatgaaatattttgagagcttattgggtggaaagaaaaatgcaacacagcacacagttctgtgcatcaagttgcataataaatgtattcatttcaggatttaggatatgaagcctctttttctctttcttacattacatgacctcaggctgtctggcatttctcaagagatgatgccttctgtagcacagtcgcataaaaaagattgcgagatgtttccactaatgtactactggtattcgaagtgtaatttatttgttttacttgttgcataactatatattcgaggtcaactctgctcatcagaaaacacgtgtaataatctaattagcgactatatcaaggcaatgttcccccgtttcctttggt

SEQ ID NO: 19 - DNA, 486 bp, Brachypodium distachyon
gccctcgccgcaaccgcaagcgcaaccaaccctcttctccttctccacccgcagcgcagccagccacgagctcaaatctcaatcgatcggaggaggcggagaaccggagatcggatcggcgatggcgacgttcgacccgtggccggtcttcttccgtagggagtggaagcgcaactggcccttcctcgcgggcttcgccgtcaccggcttcctcatcaccaagatgaccgccggcttcaccgaggaggacctcaagaactccaagttcgtccaggagcacaagcgccgagcctgacgctctcaggtgaaggaatggctgctgcagttcccagtcattataagcgtggtcggcaattttcttacgttatttgaatgaattcaccaaaggaatgacttagtctacccaagtttctactgtaatgttgtaataagaggcttttgaatacctaaaccaacaaatgtcagctccaatctatatttcaagtc

SEQ ID NO: 20 - DNA, 1636 bp, Brachypodium distachyon
gtcgccctcttcctcacggctcttccctctgctgatcccttcccgccttaagactcatccgtgccgcaggtccccaatggcgtcgtcctacaactaccccaccaccaccagccctgctactactactaaccctagcttccccgccccctcggccccgccgctgtacccgacgctgaccatggccgacctcgcccccgtcgagatcccgaccaccccggacggcgcgccgccgccctcggaggacgtgctcctccgcctccccggcgcgcagctccacctcatcgaccgccgccgcagccacccgctcgccgcgggcgacctctccctgcgccgcatccgcgccggcgatgcctctctcgccgccaccgcgctgctcggccccatccagtggccgctggcccgcgacgtcgccgccgtcaagctcgacccgcgccactactccttctccctcgccgtccccgcatcccacgacgaccccagccccgacccgctccactacggcctcacgctctccgcccccgacccgcgcctcgacgccgtgctcggcgcctacaccagcttctccgtccattccgtcgctggcagcgaggcgctcgccggtggcgcccgcggcgaggtggaggcggccgcgtactggaccgctgtcgcgcccaatgtggaggagtacggcggcgccgtggccaaggcgattgcgaggggtgctgagaacgtggccaaggggataatatggtgtggcgtgatgacggtggataggctccggtgggggaatgaagtcctcaggaagaggatccagccaggtgatactgacgccgaggtcagcccggagatgctgagaaggatccaaagggttaagaaggtgacaaaaatgtctgagaaagtggcatctggaatattgtctggagtcgtgaaggttactggctatcttacaagctcgttggctaattcaaaagctggcaagaagttttttagtatgttgcctggagagattcttcttgcttcgcttgatggatttggcaaaatctctgacgcagtagaggtggctgggaaagatgtgctatccacatcctcgaccgtgacaactggtcttgtatcccacaagtacggagagaaagccgctgctgcgacgaacgaagggatggacgctgccgggcacgccattgggactgcatgggccgtgttcaagatccgtcaggcccttaacccgaagagcgccctgaagcccacgtcactcgccaagtccaccatcaaggccggagccgccgatctccgggcgaagagcagcaagagcaagtagagcctgaagccgtccttcctcgtcgcaaccggctgtgttggatccttgtcctgaccagaagaacctttgcccccagaagtcccagctgatgtgctgcttgtagatattatgtgctggagctggcaaccagcagcagcttccctactgtgtcctcccctctgctgttgtgaacgttttctgttgtgtttctgagtggagtatcgttgttttcgtttgtgcagtgttagttcaacgcagaaaactacgaaagaaacaaagttcggtgttctttgattaactggtgtgggttgctgctgtttattggtgttgacctgggacactcaaatcatttgctctgatgca

SEQ ID NO: 21 - DNA, 1748 bp, Brachypodium distachyon
acatccaaaacccaaaatccaaagccctcctccctcctctcttcccttaccctctcaatcgagactgcaacaacgaacacaaatgcaaacaccaaccatgtacacgtccatggcagctcgggcaacgtcggcggcggcgaacctccctgcaccaccaccaaggcaatgctactaccacctcctgccacccgcaggtcgccgctccgtgtgggcgctctccgcgtccccgaagaagaagaacccatggctggacccgttcgacgacgggcccgacgaggacttcgactacacgggcgtctactcaggcggcaagcaagacgaggatccacggcccccagaagacccgtcaaacccctacggcttcctccggttccccatgggctacaacccggagctcgacagcctcgcctccaaggtgcgcggcgacgtgcgccgggcctgctgcgtggtgtccggcggcgtgtacgagaacgtgctcttcttccccgtcgtgcagctcctcaaggaccgctaccccggcgtcctgatcgacgtcgtggcctccgcccggggcaagcaggtctacgagatgtgcaagaacgtgcgctacgccaacgtgtatgaccccgacgacgactggcccgagcccgccgagtacacgcaccagcttggagtcctcaagaacaggtattatgacatgatcctgtccacgaaactggctggcacgggccacgcgctgttcttgttcatgtcgtcggctcgcgagaaggtgggttacgtttaccccaacgtcaatggcgccggcgccgggcttttccttactgagatgttcaagccgcccacaaccaacctctccgatgggggatataacatgtaccaggaaatgctggagtggctgggccggccgggcaagggcgtgccgcagcagccgataccgccgctcagggtgtccatctccaagaagctgaggggcattgtggaggacaagtacagccgcgctggcgtcgagaagggcaagttcgtcgtcgtccatggtatcgcctctgactccgtcgccaacatgacgtccaggggagacgatgactgcctcctcccccttgaacaatgggcagagatcgccaaagcgatcagctctcaaggcaatggactgaggcctctgtttgtgatgccacatcagaagcatagagaagagatcgaggacattgtgggcagggagaccagctacctgtttatcaccactcccgggcagctcacctgccttatcaatgactccgccggcgttgtcgcgaccaacaccgccgctgtccagctcgccaatgcccgtgacaggccatgtgtggcgctgttctcctccaaggagaaggcgaagctgttcctgccatacgcggaggataagaagagctgtactgtcgtggcgtccgcaactggcaagctggccgacattgacatcgaggctgtgaagaacgcagtgaaggagttcgagcctgctcccagcttcgcattggcacaaaaatgatcaaaacgataatctttcttgattgtgttgtaaatagatctgcacagcgagctcatctgaccagcgagaggctaagagttcagtgccttgtagctttctaattcagcacatacacatgtttacctctggtttggatgggtgaacaaaaataccatcgtagatagctctaaaagtaaataagatcctcagcaatatcatgagatgatcacacaataatactggaatttaacgaagcatgaaaatttatgtcatc

SEQ ID NO: 22 - DNA, 3658 bp, Brachypodium distachyon
cccttcctactagtctccccctcccggcagccgcctccatccccttctagggttaagattccatgcgatctagctgccgcggaggacggaaaccctaggagcgtttcctctccgttcgagcatcaagtcgtgaccaatgggtaagggcgggcaggacgaggccaggcggcccgacggatccgacggctccgggtcggagcccgccgtcgcagccttcccggtgtgggcgcgcaccccgagcgagtgcctggcggagctgggcgtctcggcggaccgcgggctcagctccgaggaggcggccgcgcggctgcagaagtacgggcccaacgagcttgagcggcatgccccgccgtcggtgtggaagctggtgctcgagcagttcaacgacacgctcgtgcgcatcctgctcgctgcggctgtggtgtcgttcgtgcttgcgctctatgacggcgccgagggaggcgaggtcagggccaccgctttcgtggagccgctcgtcatcttcctcatcctgattgtcaacgccgtggtcggcgtctggcaggagagcaacgccgagaaggcacttgaggccctgaaggagatccagtctgagcacgccactgttaagcgtgatggccggtggtcgcatgggctcccagcgcgagacctcgtcattggagacattgttgagctccgcgttggcgacaaggtccccgcggacatgcgtgtgctccagcttatcagctctacgctccgtgttgagcagggctccctcactggcgagacctcttcggttaacaagaccagccacaagatcgatctggaggacacagatatccagggaaaggagtgcatggtctttgctggtaccaccattgtcaatggcagcgctgtctgtgtcgtaacaggaactggcatggcgacagaaataggcaagatccactcgcagatccaagaggcctcacaggaggaggatgatacgccgctgaaaaagaagctcaatgagttcggtgaggcactgactgccataattggagtgatctgtattctggtttggcttattaacgtgaagtatttcctcacctgggagtatgtggatggatggccaaggaattttaagttctcatttgagaagtgcacatattactttgagattgcagtggcactggctgttgcagcaattccagagggcctgcctgcagtgatcaccacatgcttggcgttaggcacaaggaagatggctcagaagaatgcacttgtgagaaagttgccaagtgttgagacattaggttgcacaacagtgatctgctctgataagacaggaactttgaccactaaccagatgtcagcagtgaagcttgtggcgattgggaggtggcccgatacactgagggactttaaggttgatggaaccacttatgatccaagtgatggtaagatccatgagtggccaagtttggaaatggatgagaatctccaaatgatagcaaagatagctgcactctgcaatgatgcaagtattgcacactccgagcatcagtatgttgccacggggatgcccactgaggccgcattgaaggttctggttgagaaaatgggccttcctggtggatatactccatctctggattcatcggatttgctaaggtgctgtcagtggtggaataatgatgctaaaagagtagggactctggaatttgatcggactagaaaatcaatgggagttattgtcaagaaagcagactctggaaagaatttgctgcttgtgaagggagcagtagaaaatctgctagagagaagtgcttatattcaattgctcgatggatctgttgtgctcttggatgatggtgccaaggcactcatattgtcaagacttagtgaaatgtcagccagtgcattgcgctgtctgggattcgcttacaaggaggatttggcagaatttgcaacatatgacggagaagagcatgccgctcacaagtatctgcttgatccttcatactactcttccatagagaataatctgatattctgtggttttgttggtctaagggatcctccccgagaagaagtccacaaagcaattgaagattgcagagctgctggcatacgtgttatggtgataacaggagataacaaagaaacagcagaggcaatatgccgtgagattggggtttttggtcccagtgaaaacattagttcaaggagttttgcagggaaggaattcatggctcttcctgataagaagaagctcttgagacaaacaggtggccttctcttctccagggcagagccaaaacataagcaggaaattgttaggttgctcaaagaagatggtgaagttgttgcaatgaccggtgatggagtgaatgatgcaccggctctgaaattagctgatattggaattgcgatgggcatcactgggactgaggttgcaaaagaagcttcagatatggtgcttgcagatgataacttcagtacaatagtctcggctgttggtgagggaaggtctatttacaacaacatgaaagcttttataagatatatgatctcttcgaacattggagaagttgcctccatattcctaacatcagctttaggtattccagaaggcctcattcctgtacaacttctgtgggtcaatcttgttacagatggccctccagctacggctttgggtttcaacccacccgataaagatatcatgaagaaaccccctcgaagaagtgatgattcattgatcactccttggattctgttccgttatatggtcattgggctgtatgttgggattgcaacggtgggaatctttgtcatctggtacactcatggctctttcctgggaattgatctggctggtgatggtcacactcttgtctcatactcccagctctcaaactggggccagtgcccttcatgggagggtttcaatgtgtcgtcattcacagcagggtctcggacatttgagtttgatgcaaacccatgcgattacttccagggtggcaaaataaaagcgacgaccctctccctgtctgtcctggtgtcgattgagatgttcaactctctgaatgccctctccgaagatggcagccttctgagcatgcctccatgggttaacccctggcttcttctggcaatgtcggtgtcgtttgggcttcattttttgatcctttacgtccctttccttacccaaatcttcggaattgtgcccctcagtttcaacgaatggcttttggtgatagcagttgccttccctgtggtactcatcgatgaggttcttaagtttgtggggaggtgcttgacagctcgtgccagaaaacaattaggaaagcggaaggaagagtagatgctagtcttcagcattagatttcaggtttgccatgggagtagatgtctgatgagatcccatcgttttgtctctcgagttccaaggactctgctatttcttgagaaacagaaccatgcaggaagttagggtactatatagaactcataatcaggccgtgggtttaacaaactgcatttattcatttgtaacaaaattatgtgtcatgaatgtgctggagacacggcatatttcactgtgaatctaggccgtctggtctgtgtgcactcttctgtctcagccttgtctgaccgatgataatgcagagaagtttactttatgctatttcttaac

SEQ ID NO: 23 - DNA, 1106 bp, Brachypodium distachyon
atttttcggtccctcttcttttctgtccgtctcgccggcgagcgcttctcgagatgcccgccgcggcggcgcgctgcggctgcccgctcctgctccggcagcaaccggcggccggcctccgccgttccttctcctcatactccggcatgcggcgtgtctgcgcagccgcagggggtgggagcgggagcgaggggcggccgccggcgtacggcgggctgctgctcgacgccggcggcacgctgctgcagctggcgcggccggtcgcccagacgtacgccgccctcggacgtccatacggtgtgacaaagcgtgaagagtacatcaagcagggattcaagcgggccttctctgcgccatggccgaagacgctcaggtaccagggtgatgggcggccattctggaagattgtcgtggcagaagcgacagactgcactaacaatgattatttcgaagaagtatatcagtactacgctcgtggagatgcttggcgtctgccggatggagcttacagaacactgcatgatctgaaagatgcgggagttaagctagctgtcgtatccaactttgacacacggctaaggaaattgcttaaggagctcaatgtctcggatctgtttgatgccattatagtatcatcggaggttggatatgagaaacctgctccagagatcttcagaatagcgttagatcaaattggtgtggaagccagcaaagcagtacatatcggggatgatgagactgctgacaaggcgggtgctaacgctataggactcgagtgctggttgtggggagaagatgtcaagacattttctgagatacaggaccgaattctagcaaggaacccgcaatgagtgcggatttggtgttggacatcgttggacctctctgctggtgatctgcacgaattgttcatttgtttcaaacttctgttttcatgaccaggaagtcccgagggcttttgtttatctgttttatcgcacgatgttcttgcaataaaccagtgcaccgccatgtacaaatacaagtgatgcataaactggaccaattttatgcagatttggaatgaaatggaatataaagtaccacacagcttcaaggcacaacat

SEQ ID NO: 24 - DNA, 2010 bp, Setaria italica
cgagtcagatcctactcaatccccggcccaaaccctactcggccctcgcgaagcagccatgatggcagccgagccctcgccgttgtcggccgcggctggcgacctcgaaaccctcgccctcgactcctcgtcgtccgccgcctcggcctccaccgaccccctcctccgcccgccttcctcccagaccgccgccgccgcgaaccacgacgccttcgtcatcgacgacttcctcgacgaggaggacgacttctcccccgccccggcgcccagcatcgcccgccatcccgcgccgcgccccgacgcggcgccccccgtgttcgccagaatcaccgtgtccgatccgaagaagcacgcggagcccagcggcgggggtgccgccgccggcgtgatcccgggctccgggagctacttcacctacctcatcaccacccgcctcgcgggcggcggcggcggcggggaggtctgcgtgcggcggcgcttccgcgacgtggtagccctcgcggaccgcctcgccgcggcccaccggggcctgttcgtcccggcccggcccgacaagagcgtcctcgagggacaggtcatgcagcgccacgacttcgtgagccagcggtgcgccgcgctccagcgctacctctgccgcctcgccgcgcaccctgccgtcggacacagccccgacctccgtacgttcctcaccgagcctggtgccatccccgccttccagggcgaggcgccacggtactggactaccacggtgaatgctgctgctccgctagtgcaggccaaagctgggagggacttatttgggatgttcaagggtctgaagcagactgtggtgaacgggctggtcgcaaccaagcctccacctgtggagcaggagacagacacagaattcctggcgcacaaggccaggtttgaggatttacagcagcagctcaccacaacatcacagcaggctgaaacacttgtcaaagcccaagatgatcttagagaaactacaggtcacttgggaatgacactgattaagctggcaaaatttgaaagagagcaggccacatgtaattccctaagaagaagagccggtgaaatccataattttgcaaatcatgttttgaagatgagcagatcacagataaaattaaactctgaaattgtgaaacacctgggtagcatccatgaatacttggaggccatgatatctgtcaatcatgcatttacagatcgctccaatgctttacatcacgtgcaaagtttgtcagcagatttattttctttgcacacaagggcaggaagacttgaatcttcatcagcaagagatatggggcatgagtggtcgacatatcagaaggtggagggattgaaagaaacaataagatcagcagaagcagccaaaagtgacgcacttagagaatatgaaagcattaaggaaaacaacaagattgaaataaaaagatttgacaaggaaagacgccgcgatttcattgagatgctgaaaggttttgttgtaaatcaggtatcatattcagacaattttgctaacatgtggacgaaggtagcagaggaaacagaagtatatgcaaacaggggcaactgatgtacaagcctgtatagggagtatagagtagtggattttgatatatttaatttgctccgacgtccagcgacacaaccattcttgattcctccccagttttgccaccttgggttggttgtaatgccacatgagttacgtgcagtcacgagctcatgatattgggttgcggcagatagcttctcggctcggtgagaactggcatgtatgagagccacacgcacaatttttcttggtgataactgacaggtcaatgagctccgattatcctgtattggtactgctgtgttcctatcttcctatgcactaatactcgagtatcttgaaattgtgccatggatgatactcactgtggatatgacgaaactcgaagcctcttttcactttttcaggttttagtgtctcacacgttgctggatgctgac

SEQ ID NO: 25 - DNA, 640 bp, Setaria italica
agaagcgtcatttcggacgataagctccaagcgaccggacgccgataaaatcgccccacccactccgcccgctccccctcttccgccgtcgcctctccagcctccactttccccatccttctccgccgtcgcggtcgcctcgcagtccgaagagcctccgactccgatggccagccgctgggtccgacccgaggtgtaccctctgttcgcggcgacgggcgtggccgtcggcatctgtggatttcagctcttcaggaacatcaccggcaacccggaagtcagggtaaacaaggcagggagggcagctggtgtccttgaaaatcatgaggaggggaggcgttacgcaatgcacggcctcaggagctttgtgcatgacaagacccctgaaatcatgccagcgattaacaagttcttcactgagccaaagtgaagcattttgcttggctgttgactgctctgcttaaatggctattgtcgattgtacccatgtcatccataaattgaagcacagccgatacctcttattgaaagtaccgtatgagtgcgattggtcatgacttcctatgtgtgcgatggtcgatgaatgttgtgattgatgatgacttcctgtgtgtgcaatggttgatgagtgatgtgattg

SEQ ID NO: 26 - DNA, 2000 bp, Setaria italica
agtcaatcgttcaatcgttcgagtcacgccatacaacacggatagaggacgaccacgccggccgcagcgcgagtgtgacgacgacgacgaccaccaccaccaccgaggccatggcgcagcttccttccgggagcgtcgtcagcggggaggcggagctcgtcccgactctctcctcgctggagccggtctacggcgagggctcccagctcgacgaggcgcggctccgcttcgcccgcctcggggaccgcttccaggccgtctacggcgcccgccccgcgctcttcgcccgctccccagggagggttaatctgatcggggagcacatcgactacgagggctactccgtgctgcccatggccatccgccaggacatgatcgtcgcgatccggaagtctgacagcggccaggtgcgggtttccaatgtcgacgacaagtaccccgtctgcgtctacccggccgaccccgacaaggaaattgacataaaaaaccacaaatgggggcactatttcatgtgtggatacaagggtgtatatgaatactgcagatcaaaagggatagatctgggcaaacctgttgcgcttgatgttgttgttgatggcacagttcctcaaggatctggtctgtcaagctctgcagcatttgtctgttcggcaacaattgctatcatgggagtccttgagaaaaacttcccgaagaaagaagttgctcaattcacatgtctctctgagcgccacattggaacacagtccggaggcatggatcaggctatatcaatcatggccaagcctggatttgctgaattgatagactttaatccaatccatgcaactgatgtccaactacctcgaggtggtacatttgtaattgcccattgtttggcagagtccaagaaagcagagacagctgcaacaaactataacaaccgcgtggttgagtgtcgcttagcagcaattgttcttgccatcaaactagggatggataccaaaaaagctgtctcttctgttacaaccctctcagatgttgaggggctatgtgtttcttttgctgggaaggaaggttcatcggatcctggagtagctgtgaagaaacttctgcatgaggagccatatacagcggaagaaatagagaaaatcacaggtgaaagcctgacatctgtcttcaagagttctcaaacttccttggatgttataaaagctgcaaagcactacaagctatttcagcgtgccagtcatgtctactctgaagcatggagggtttatgccttcagggatactgtctcgtcaaaactcagtgatgaagataagcttaagaaactcggtgatcttatgaatgaaagccattatagctgcagtgtgctatatgaatgcagctgccctgagttggaggagcttgtgaaagtatgtagagatcatggagctctcggagcacgtctcacaggagctgggtgggggggctgtgctgtcgctcttgtcaaggagcccatcgtcccgcagttcattctcaatttaaaggagaagtactacaaatcaaggatcgaccggggagtgatccagcagagcgatctgggcctgtacgtgttcgcatccaagccgtcgagcggcgcggccatactcaagttgtaggcgggcggccattctttggcccgttgtgcatgaaagaataaattccggtcctcttccctgtactctaggcccagttgccttgatgccgatggcacctgaatgttgtatcgacctatcagtcatctcaggcagtacatatatcaagggggtgtttggattccagctaaattttagctcctgttacatcgaatgtttgatactaattaggagtattaaatatagactaattataaaatcaatttcacaatctctagactaaatcacgagacgaatctattaagcctaattagtccatgatttgacaatatgatgctacagtaaacattcactaatgatggattaatagattcgtctcgcgatttagcctaggagttctgc

SEQ ID NO: 27 - DNA, 1081 bp, Setaria italica
tccgcgacctcacaccactcccagcgactccaccacagaagcggcggcggcggcggaggaggaggaggaagaggaggcgaaggcgagggcacgagggagggagaggagcaccagccatggtgcacgtcagcttctaccgcaactatggtaagacattcaagaagccaaggcgtccttatgagaaggagcgtcttgatgctgaactgaagctcgtcggtgagtacgggctgaggtgcaagcgtgagctgtggagggtccagtatgctctgagcaggatccgtaatgctgcgaggcacttgctcacacttgatgagaagaacccccgccgtatctttgagggtgaggcgctgctccgccgcatgaaccgctatgggctgcttgctgagggtcagaacaagcttgattacgtccttgccctcactgctgagaacttcctcgcaaggcgccttcagactcttgtcttcaaggctggcatggccaagtccatccaccatgctcgtgtcttgatcaagcaacgtcacatcagggttggcaggcaaatcgtcaacgtcccatctttcatggtgagggtggagtctgagaagcacattgacttttcactgtcaagcccgttcggtggaggccccccaggcagggtgaagaggaagaaccagaacaaggcaactggtggtggcggcgatggtggtgatgaggatgaggagtgaagatgaaccagtagcaattacctgatataatattatctagtcgtcataaacatgttggtatcttgagcacttagctgtgtggcccaatgctcagccccatgtgctgattcggtgtcacagatgttatgttttatctggcggtgttattagcctatacttagctgctatgtttggagatgtttaattatgttgcggttttatgtggtttcgacttctgttgccatcaagctgtaccttttttctcttggcctatgatttgccaagtcgttcgcataatctgcttgagttgcctttctggtttatgttgatgagatggtatcaatgcacctaatgaccggtttcattggtgttacagttgactgatttgtgcttccgaa

SEQ ID NO: 28 - DNA, 2739 bp, Setaria italica
attttgaaccagcgaacggacgctcccccgacccgtccctctctctcctctgagctgccgcacggcacaggggagccccacccccacaccaccccgctcccactccacactgtcaagagagggagggcgaagcgcctccgcgcccaccgcgatccgcccgctcacctaacgccggtcgccggtcgaacgccgccgcgatggggttcggagggctggtggtggtttccgacccatacctgcagcgccgcttcacgcaggccgatctccgcgcgctccaggccaagtatgcggcgctgcgggacgcgtcgcccagcgggaggttgcggatacgtgacctccccgccgccatctccagcctccgcggcgccaccgtcgcggccaagggcgacgccgagaaggagaacagcgcgccggaagcaggtccaggcccgggcctcacagacgaggaatgggcctccgtgctcaaggccgtcgcgcgcgccgacgagaggccgcaacaggatgccagcttcgagctcttcctccgcgtctacgccgagatgcagcttcgcctcaaggcggcaggcgccagcgccggcgggaagaaggcgggcggcggcatcgcccgctcctcgtcctcctccgccgtcgccttcctcacggcggccaccaccacgctgctgcacaccatcagcgagtccgagaaggcatcctacgtcggccacatcaacgcatacctcgctgaggatccgttcctcaagagcgcgctccccatcgatccggccaccgatcacatcttccacatcaccaaggatggcgtcctcctatgcaagctcattaacttggccgtaccgggcaccattgacgagcgcgccatcaacaccaagagggtgctcaatctgtgggagaagaatgagaatcatacactttgcctcaactccgccaaggcgatcggctgcaccgtcgtcaacatcggcacacaggaccttgccgaagggaggcctcatcttgtcctgggcttaatttctcaaataatcaagatacaactgttggcggatgttaacctgaaaagcacacctcagttggttgaattggtcgaggacagcaaggagatggaggagcttatgagcttgtctcctgaaaagattctattaaggtggatgaactttcaactgaagaaaggaggtttccagagaacagtaacaaacttttcatcagatataaaagacagtgaagcgtatgcttgtctattgaatgtcctggcacctgaatgcagtgcaaaaccatcggcaatgtcagtaaaagacttgcttcatagagcaagattagtccttgagcatgcagataggatgggctgcaaaagatacctgactccaaaagacatagttgatggcttaccaaatctaaatcttgcctttgtagctcatatttttcagaaaagaaatgggttgtccaaacaaatgaaacaagtttcttttgtggatggactctctgatgatgctcaagtttccagggaagaaaggtcattccggctgtggattaatagccttggaatttccacttacatcaacaacgtgtttgaagaccttagaaatggatgggttctccttgaggtgcttgacaaggttgctcctggctcagttaattggaagatggcaaatcgtccgccaataaaactaccattcaagaaagttgaaaattgcaatcaagttttgaagatcggaaaagaactaaagttttccttggtgaatattgctggaaatgatattgtgcaagggaataagaaactgatattagcttttctatggcaattgatgcggtacaatattcttcaactgctgaagaatcttagatttcactcaaatggaaaagagatcacagataatgacatattggcatgggccaataaaaaagtaaaagattctggaaagcaccattctcgtatggaaagtttcaaggatagaagcctttccagcggcacctttttccttgatttactaagtgctgtggagcctcgagttgtgaattggagccttgtgactaaaggagaaaaagatgaagagaagcaaatgaatgcttcatacatcatttccgtggctaggaagcttggttgctccattttcttgttgccagaagatatattggaggtgaaccagaagatgatgctaactctgacagcaagcatcatgtactggtatttgaaaagaccaacatcacattcattggactctgaaaacgggagttcatgtgagacaagctcgaccacaacttcagacgattctgcatctgaatcatcgttcgatgacaatgcagctagatagaagtgcagggatcatgaagagaaatgatctgacctggaatactcttcatcccagcgcgacattggttttgttcttgattctttgctgtaattttaagaacaaatgcattcaacgcatagggaagcgataaagagctcagagtgttcatttgtgaggttttgtagtgtgaaaaattgattgggtgaaagatgtgtaacatcctgtaaatattgacgcaggtagcctatatttgtaaaatcatagtgacagtggattgtccaaaatccacatagtttggttttttcttgggcatttttgctttgcaacatgacaagataccggttccagtttagagcgagaacaagttgggttgtagcttgcgataaatctgtcctaattaggaatttaggatgttaaacatttaggcacgtgtttattagaaggaaagaaaagaaactta

SEQ ID NO: 29 - DNA, 860 bp, Setaria italica
gcatccattttgtctagactagtgcatgcctccttttaatttgttcctgcggacaactcacatctgcaggttcctttgtgtccaaaccaaggaaaggcaggctcctctcatctcctgccatatcgtctgcaggctcttccttccctagcttttctctcggtccctctctcttcaagctgaggaaacgcaggacaggttagctggttgcatgctccatgagcgccatggagcccaggaagtccagctatcttgttgccgtcgtcttcgcttcgctcttgctgtcctccatggcaggagggcataggaagctggtaaacaaagatgacgcagaatccatggagacgtcggaatccatgcagcagctgcagggagatgacgaagcggcggcggtggtccacgagagaattctcaagcaggtgaagatggacgactacgggcgctacgaccctaccccgaccatgtctaagcctcacttcaaggacataccaaactagagccacaacccatttgagatcatatcctcgaatacatgttgcttgctagtcgctcctccttatacatatatatgtgccacatatatttgtcgaataatctcgtgtatcatcattaccatgcatgtccagcttgattatatgtgtgtgtacactaaattgttgatacatgtgcatgtgtatgtctgaaacttatcatcacttatatgagagctagtagtatatttgttgtcgtcgtcagaataagagtgtgcattgttgttgagtgatgggtagttttacccatggccaggccaaggttttcgtagctagagatgtgtgtgtgtatatatttttaatttggctctatgtgaaaataaaatgacctaa

SEQ ID NO: 30 - DNA, 1801 bp, Setaria italica
acacatcactcgctagtcgctagctagcgtgcagctgcagcgcaccgggcacaaggacgacgaccacgaccccaagccaaaggccagcatgagctcgccacctctgctcggcaaggagggcctcaaggccgcgtactgccgcgtcgtcgtgacggtgccgctcgccgcagccgccctcgtcgccgtggcgcggctcgggcccgaggagctcgccggccgggtccgggacgcgcggccggtgcacctcttcctggcagcgttcctcccggccgcggcggcgaccgtgtacctgatgctccgcccgcgcgcggtgtacctggtcgactacgcctgcttccggacggcgtccaactgccgcgtgcccttctccaccttcctggagcacgccaagcaggtgccggtgctcaacgagcgcagcatccggttcatgaccaagctgctggagcggtcggggctcggggaggagacgtgcctgccgccggcgcaccactacatcccgccctacaagtactgcaccctcgacgcggcgcgcggcgaggtggacctcgtcgtgttcggggcgctcgacgacctgttcgccaagacgggggtcagccccggcgacatcgacatcctcgtcgtgaactgcagcctcttctgcccgaccccgtccttcgtcgacatgatcatcaacaggtacaagctgcgcagcgacatccggagcacgcacctctccgggatggggtgcagcgcggggctcgtctccgtggggctcgcccggaacctcctccaggtggctcccagaggcgcgcacgcgctggtggtgtcgacggagaccatcacgcccaactactacgtgggcagcgagcgcgccatgctcctgcccaactgcctcttccggatcggcggcgcggcggcgctgctgtccaactcccccgcgaaggcccggttccggctcaggcacgtcgtgcgcacgctcaccggcgcgcaggacagcgcgtacacgtgcgtgttccaggaggaggacgacaggggaaacgtcgggatcaacctgaacaaggacctgatgaccatcgccgggaacgcgctcaaggccaacatcaccgccatcgggcccctcgtgctcccggcctctgagcagctcctgttcgcgctctccttcatcgtgcgcaaggtgctcagcgggaagttcaagccgtacatccccgacttccgcacggccttcgaccacttctgcatccacgccggcggccgcgccgtcatcgacgagctgcagcgcagcctcaacctgtcggatcagcaggtggaggcatcgcggatggcgctgcaccggttcgggaacacgtcaagcagctcgctctggtacgagctggcctacatcgaggccaagggacggatgcggaaaggtgaccgggtgtggatgattgggtttgggtccgggttcaagtgcaacagcgcggcgtgggagtgcatcgagcccgcggcgaacgcggaggggccctgggcgacgtcgattcacaggtacccggtggacatcccggacgtgctcaagcactaactggctgcggcttgggcatcgacatgttctttcgctgaaattaaatcgcgtgcgaataattgagatctgttaaacaacatgtctgttccatctgtttattattaatccgatatgatccctttatatcacagtagtgtataatatcatgcgtgtgtgcgtggcagggccatgaaacaggaatgttctcacaatatgttgtacacggtaggtagctctcaggtgtctttttgtgcagtctttgtgatcgaccgccgttgccggcaa

SEQ ID NO: 31 - DNA, 2147 bp, Setaria italica
cagatattcacgcaacatataagaacggtttttttcgtgtgtttgtccagcatacagaggattgggatagtacttatttggagtagccaggaccaggagggggcacgcagaagaagcaggcgcaaattaacggaagcggtttctcaggagccgaggcgcgaagagaaacagagcgagcgggagatgaggagtccggtgtcggaacgcagcctcatcatcgagagctccgacgacgaggacacccactccggagccgccgtggccaccagcgggcgaagacgcgtcgtccatgacgaggaggagaagggcgctggttcggactccgactcctcgtcgtcgtcctcgtcatgcgccaccccacgccgcggcccctgctcctcctccccctacgcccagcaatggccgcagagttacaggcaatcaattgacattcttagtaacgtgcagtcacccaatctgagtttcttggggactccatctctgagcagattgtccaactctttcctcgccgtaaccgattcttttcgaagcaaaacccctgaaataatctctaactttgtcaagccacttctgagccccacgacaagtgatgagcagcagcaacacgaagatacccgaaagagttcccagtacattacgccctcaagaaaaccatctttgcaacaaatccctgaggatcagaagccattggtagctggtcatgaggtgtctccttatcgaaactgctcttacacccagggagtgatgaatggaataaatgttctatgtggtgtgggaatcctgtcaacaccttatgccattaaacaagggggctggattggacttgtgatactagctttatttgctctgcttgcatggtacactggcgtcctactgcgtcattgcctggatagcaaagagggccttgaaacataccccgatattggccatgccgcctttggcaggactggtcgcctagttatctcgataatcctgtatgtggaattgtatgcctgttgcatcgagtatttgatattggagagcgacaatttgtcaaaattgttccccactgctcacctgacccttgggagcttgacactgaactctcacgtactttttgcaatcttgactaccatcatagtaatgccaaccacctggctacgtgacctgagctgtctgagctatatttcagctggaggtgtcattgcatcaatccttgtggtcatctgcctgctctgggttggggttgttgatgacgtcggttttgagaacaaagggactgtactgaacctcccaggaattcctattgcacttggattgtatggttactgctactcagggcatggggtgttcccaaacatctatttgtctttgaagaatcgcaatcagttcccttcgattctttttacttgcattgggttgtctactgttttgtactccggtgctgcagtgatgggatacaaaatgtttggagaagccacagagtctcagttcacgctcaacttaccagacaattcagtggtttcaaaggttgctgtttggacaacggtggcaaatccaataaccaaatatgcattaaccataatcccactggctatgagtttggaagagttgctgccaacaaatcagcagaagtactcgaacataatcatgcttagatcagcgttggtggtgtcaaccctcttgattgctctatctgtgcccttctttggacttgtgatggccttggtgggttccttattcgccatgcttgtgacctatattttgccttgcgcgtgttttctggcaatccttaagacaaaagtggggtggcatcagatagcagcttgctcgttcatcatcgttgtcggggtttgctgcgcttgtgtggggacatactcatccctgtccagaataatccagaactacacataatgcagttattcctgtgatccagctgcccagcaatactatatgtgctgtatgagccaaacatatacaagacggaaattgagttgatttataataaatccgtggtatgttgtacttagtgggtcaacagtatatagtatggccgtatgggtttgaggttgtatcatacgtacgtaacagtattctttatggtgcagtaaagaaacccgctgatttgttcttgtaatctttatgatttaattctatcaatatgtttt

SEQ ID NO: 32 - DNA, 966 bp, Setaria italica
agaaatgccctagctagccttggagctagattggccaaaccccatcacaatccactgccgtcaccatcacattataggaggaagggggaggagaccccctagaaagaagatcagcgaggccgatcgagcgagcccaataaaccaagggagatgtttgcggctgctagcgagatgtgtgcctccatcatgccacaccatgtgatgcgaggagcctctgcagcctctcctccccctactacttccaagatgcaatcatgctgccccagcaagctcctcgggccctcggccgccatgattgccacaccgcacctcaagagtcgcctccacctacctccaagaggaagaggccggagaagctatagtcgatgagaaaagcgggggcggagagagaagggcggcggcgtgcgagggggccgcggaggaggagagagatggggaggtgacagaaagcgagagggagagagatgcatggtgcatgatgatggcgtggttgatctgctcttgtactcctctcatgtgagtcaagaggccatcatcagatcggtgcagttctcctggctccttcgtcttcttcctccagcagactagctcctctcccttcagcttcttttgtacgctgcgccatggctttggggaatcaagcgtcttggtccgaaatccgtcttctttccagctaggatctacgtacttgtgcgagagtatgtcatgctatgctatatctgttactcctacctgttcctattctgccttctatatatggtttgtgcaaacaagattcgtttatcttgattgatttctttcggtctttattttgaagttctattcatgtaatatttcattattggttatgtggattatttctcctctttgagctattaactctagttaaagaacttcgatgattagttttgatgcatacgtgtatcttgattgactgatgatctgaatatatccaaccgtctgtct

SEQ ID NO: 33 - DNA, 1354 bp, Setaria italica
gccggtgttccaaaacctttcgtcttttcccccgtctgtctacaaagaccttcacactcgcagccccggctcagtgcttcgtcgcgaaggcttcgtctccctctcccttctcccttccacccgcattcgaccgcctcggttcgccggcgacgagatggccatcgatcacgcgacccctctgggactgaagagcagatacgccatgggaggggacgagtgcgacgacgacgcggagaaccagcggtggccgccgtggctgaagccgctgctgtccacgagcttcttcgtccaatgcagggtccacgccgacgcgcacaagagcgagtgcaacatgtactgcctcgactgcatgaacggcgcgctctgctccctctgcctcgggcaccaccgcgaccaccacgccatccagattcggaggtcgtcgtaccacgacgtgatccgggtgtcggagatacagaaggtgctggacatcaccggcgtgcagacgtacatcatcaacagcgcgcgcgtggtgttcctcaacgagcggccgcagccccgccccgggaagggcgtcaccaacacctgcgacgtctgcgagcgcagcctcctcgactgcttccgcttctgctccctcggatgcaagattgtgggaacggcccgaggataccgccccaagaagaagcacggcggcggcgatagcaagaagaagaagagggcggcgctcaaggacgtgcgctgcgactcggaggactcgtgcaccggcagcagcggcgggagcagtgacaagagcagcgtcgtgcagtgcttctcgccgtcgaccccgccgccgacctccgccagctgccgcccctggaacaagcgccgcaagggcgtcccgcaccggtcgcccttcggcagcctcatcgtcgagttctagtagcactctccagactccatcagcactgtgacaatgtactctgtactgtatacgtgacatagcctagcccggaaggaataaccgtgcgcctctggacgtggagtcgtggaggccggccggccggcggcgcaatgccggcgaagggcgagagcggtaagaacacacctagtagtgctgctatagtgttatagtttgcttcttttcaggttttgttagtttacatttacagttgctagttactagcggtggtaccagtaagatagctgctacttacggcctcgtaaccgcgactaagttttgcagccttgtacattgtaatataccagtactctcagtatgctagatgtatatatatatatgttactttcaatcaaacaatgtgggggataggatgcagcgaggcaaggtgctcgcatgttcactagccatgtgacaaaaaaaataagaaatactgct

SEQ ID NO: 34 - DNA, 600 bp, Setaria italica
gcgaaagggaggaaggcctgcttcacctggtttcaggttcatgtgttgtgcgtgttaccaagagtgtacgcgtcgtgtgatttcagaatgaggatgctatcaaggtcttggagatctgcgtccctctttcctgtcatcgtctttgccttgttgttctcaacttcattcgcagggagacagtgcaatttcttgacggatcaagatgccctacgtcatcaaggagaggcagcaggggctgaacagaaggaagcagtagtgccactggtgcatggtcggatgctcaatgtcaagacgaatgattacggcagctatgacccttccccaaccacggacaagccgcacttcaagctcatacccaactgatcaaattacgtatcgagcttgccgcaatggagtggccgatgaggaatttagctgcttacatatgtgtgcctgacgtatagatagagaggtattcctaggcttgctaaaattattataatgacatttagtacctttttatagatgttgctcgtgctgtgttcagtagccacaaggagctgtcagtgttcattcggttgaacttgtcatatattgtacttaaaccatacatatatgcaa

SEQ ID NO: 35 - DNA, 1712 bp, Setaria italica
acaaaaattacccatctctcctccgccaacccaatcgcctccaaaaccccccggcggcaaaaccctccatttccgccgcctgccccgccctctcgtctcgtctctcctcgtggggccgcctcgctctccccctcgattcctggggcctgggaggaggggaggatgcaggccgcggccgggagcgtctcctgggtcgccgcgcagccgtccgtcctcggcaggtgcggcggcggcggcggcggcgcgcagtccgcttcggtcaaggggagggctggtggaggaggaggaggaggaggaggaggcgcgagcgtccgcggggtcggcgtggtgcggtgctccacgcgcgcgcaggagaagcggccgccgcgggtgcgcaagtccaaggaggagaggagggagatggtcgagtccttcatcaacagctaccgggttgcaaatgatgggaaatttccgtcagtcaaccttacacacaaggaagttggagggtcctattatatagttcgtgagatcgtgagggatgtcatccaagagaacagagtccttggtcctggtggcttggattctatggctctgagttttgaagattgccctgattcctcagaggtatccatgaagcatgaattgggtcaagacaatatagagagcttggcaatgtctgatgatggccaagccggtcagggttctgtgtcagagtcatccagcagcgaggaatcattttcattgcaaaacaactccatcaacactgatatactgctggggtcatctaatattttagaggctggtgttctgaaaagtatagtccaaaatgggactgcatcaggtacagcattcttggagacaaaccttgagaagcaagatgaagttccatctgggggatcaattgaggttggcctgaatagttctgaagagctaaacagtcaggaggatgcacatgaggggatgggaagtgttgctactgatattcttccctcagaagctactgatgtttatgaaacaaatggtgcacttttaagagagcatgagatgttacctaatgatagtcatggtggctcaaatgatagtgttgttgatgatggaaatctccttgcggcagccaatggtgctcttcaagaaaagcaagcatcttttcaggagcatgatccatcaaatgaaagtgtgcaaggtgatgttcagagcttagattgccagattagtactacattatctgctaatcccataaatggttttgactcagaggctgaagtcacaaccaagactatcgaagcatcggatacaaaggggctattgcacacagaagaccagcacagtgtagtacaggtagatggtagtgaatttaagaaatcaacatccggtttcacaaaggaagtggttgaggcaaccgacgccaggcatgaacaaggaatgagcaccacaactgtgatcagcaggagaacttcgaaagcgcagcagaagaaagatgacaacctattctggcttgtccttagggcatttgttgttgctatatcaaaaatctgggcaaagtgaacaatgcagtgaaggcagcttatgtggaactgaagattgagatgcatccttcctacaggaaaaatgagaatcggtccacagagttccatttctatcgtacgaatacatatgcttcttttttgctgcagtgttaggttattgattagagacagttgatttagttcgtagtagcttcccactgtaggtgt

SEQ ID NO: 36 - DNA, 1947 bp, Setaria italica
ccccaccccgtctccattcgctatgctggccgcccccaccgcgcctctccatcactcccccgacgccatgagcctgtagcccagcagcggtcgccaaagaagccgccatgggcaggtccagaggcggcaagggcgccggcgactcgaagtcgttcccgtcgccggcgtcgtcctcggcgtcgtcgtcggagttcgagttcacggtcacgctgtcgccggcgtccaagcagcggtcggcggcgcagctgtgccccgccgacgagctcttctacaagggccagctcctgccgctgcagctgtcgccgcgcatctccatggtgcgcacgctgctgctgtcctcggcgtccacgtcctccgcctccgactccacatccacgtccaactcgtcccgcgactccaacggcagcacctcctcgtccttctccgccgactgcgccgcgctcctgctcccggactccgcggcatcatcgtcccgccccagctccgccaccgaggacgaccggcacctgcacccgctctccgccgccgcctcgttcgccggcctgccgccggccaagcgcaccgggaagcagtacctctcgtccttcgccacccgcttctcctccgtcttccaccgcggcggcgctccggccgccaagaagcagccgtccaagtcgctcgccaaggaggtgatcaagaagtacgccaagaaggtgaagccgctgtacgagaagctctcccagatccccaagaaccagaacaacgtcaacgtcaacgttaacggcgccagcgccggcgccaacaaccagccgcagcaggggttcaagaagccgttcaccttctccatccgcaagaagcgggccgacgacgaccacgccgtcgtcgcggccgcggcagcggtggacgccgacgtcgttagcggcaagtacgcgcactccaactccttctccgggaacctccggttcccgcgacagaagcggtgcgcggcgagctgcccgtcgtcgatgcggtcgtcgccgagccactcgggcctgctcaccttcggcggggccggcggcgctggcttccccgacgtgccggccgccgcggccgcggccgtggcgggcggcattggcgtcggaccggtttcactgtccacggcgtcgtcgatggaggagctccagagcgccatcgagggcgccatcgcgcactgcaagaacacgatgggtggcgccgtttcggtgtgcccgcgcaaggcggcgaccggcgacgagatctgcgcgttctgagcgcgggcgcgctaggattcgggcagggagctaagtaatgccgtttaatcgttagcagtacttatctgttaattttcatttcattcgtctccttctggtaagactctatgataatggtggtaaataagagtagttcgaagggttaaaatgataatcggagcctttgaatctcaccttttcctgggttcggaatttgcattggtgccctccaaatttaagctctaactgcatctaccccacccagcatgagaagatatttaatttctatggtcaaccttaattgataataatgctatataaattcacagaagaccctcaaacttgaagggttgatatgcatgaaaacttctgctatgaaatgagtgcatctgaaagattgtggatggggttgtggcctgcaatttcctagtttcatttgcctccttagaaaccacaaaagcagttggtgtgaggatatttcactctaaatattttagggcaaaagtggagtataaagttcccaacttgatggagggtgttgatgcaaatttctgttcctggagaagggttgccaaagctccctagttcattaggttgagatttttggactctgatgtggccgtacgtctgagctagtggtgtcaattttctgttgtgattttgtcccgagacaagtgtttaatattaagctaatcctaatatagtttggctttttaatctg

SEQ ID NO: 37 - DNA, 735 bp, Setaria italica
tgtgtagtagaacatcctggtgactgatgaatgaagagagagaactgcacaacgattccacgccgaagcgtagagcgcagcagaggacgcgagaaggggcggcgagttcttgaatcctctctctccgctgctgagcctgctcatcaacccggcatggatgcaaagaacgtaggcaatgaacaagaagctcaacaaaagcttgatgcggtgacaggcagtgttccaagacctaatcaagagaccttgaaacagttcgcagattcagacgctggaaacatcagtccagcaaatggccaggaagctgacgtgaacatggaagctgccatctccaccgaggacgtcatgcgagctggcgggtttggagcaaaagatgacattggcagcctcctcccaacagctattgattcgacagatttcgaggcctcgctgcgggacgcccgcgacttcgaaggtgagaaagaggcaccatcacatcctggactgggctggaagggggagaaagctgatgatggtagcaaaccatcagatgtgccgcagcagttaccatgatatcttaccttgtaggctagtccagcttcagcttcagaaaacatttgctgatcacgtttatgtacgttgttcccaagagctgctgtacgtttgaactttttgccacaatgttatgtgtgtagcattctgctgtttcagactatcagtgctgtgtgatcatgaggataacggttcttgtctgttgtc

SEQ ID NO: 38 - DNA, 2772 bp, Setaria italica
acatccccacctctagtagtctaaaactcgcccccgcgcacgccccgatgcgccagtttcctctggcttctattcttctccacccccgcttgctcgccgtcgtgctctcgtgggttggtcaaccccctccccaagcaattccgcgagcacctcgcgcgcgtcgccgcccacccacatggccgcgcggtcgccgcccgcggcccgctgctagacgcctcgcgcgcccgccgcggcctcccggctgctggtgctaccatgttcctcctcccgcggcagtggctgctgctcctcgcggcggtgctagcgacggcggcggccgtggcgcgggggcaggcgccgctggcgtcgcgggcggacctgggggggctctacagccttcgcgcctccctggggctgcgggcgcgggactggccgctcaagtcggacccctgcgcggcgtggtcgggcgtcgcctgccgcgccggccgcgtcgtgaacgtcaccgtcgcggggctccgccgcacgcgcctcgccgccctggccccgcgcctcgcgctcgacgggctccggaacctcaccgcgctcgagcgcttcaacgcctccgggttcccgctgcccggggagatccccgactggttcggctcgagcctcccgccctcgctcgccgtgctcgacctctcctccgccgcggtcaatgggacgctccccgccaatctcggcgcgtcggggaacctcacgatcgtgctcctgtccgggaacggcctctcgggtgccgtcccggcgccgttgctctccgacagaggacctcgcgtcctcgacctctcccgcaacaacttcaccggcgggctgcccaacgtttccgccgtcgccggcggcgcgtcgatgtttaacatctccgggaattcgctgtacggcgtggccggctatgccattgcggcgctgaggagaaggtttcaggtcgtcgacgtgtccagcaactacttggatggagctttgaacgggtccgatggagtagtgattaccacgacgaattgcttccacggcgtgccgggtcagcgcagccgtgtggattgcgaggagttttacaggaagcagggcgtgaaccttgttgatgctccagctccctcgccgttgccgtcggcttcgcctctgccacagccatcaccggaggtgaagaggaagaagcagggtatctccaaaaatgtactcattggagtccttgtagctgcgggagcattgatggttctgtttttggctgtattgctgttctgcttggtgaagatgagcagcaggggaagaagcagagggaggggagtggagataaacgaggaaggtactggcacacgctctgcgcgtaggagggacagcagtgtgaatccagtggcgtcatctccatcagcagtttctccaagagccaatggtggacctaaaaaggatgtgtctgccattgccggtgatttcagctatgaggaattggtagatgccactgggggtttcggtgacgacaagctcatcaagcatgggcattcaggagatatctatcacggtgtcttggagaatggctcacatgtcattgttaagaaggtcggttcaaagggtatcaacaagcatgctagtgaattggacttctattcgaggtactcccatgacaggattgttccgctactcgggtatttgagcaaggatgatgaggaattcctggcttacaagtatatgccaaagggagacttgaccgatgcattgcacaagaaacctgtagacactgcagatggcttgccctcgctggattggataactagactgaagattgcgactggtgtggctgaggcaatgtgcttccttcatgacgagtgtagcccaccattagttcacagagatatccaagcaagcagtgtccttcttgatgataaatacgaagtgcgacttgggagtatgagtgacatatgcgcccagcaaagtgggggaagccagaatgtcttctctcggatattgagatcgtcaaagtctctcgacaagcacacatcaggtccaccggccacttgctcctacgacgtcctctgcttcggcaaggtgctgctggagctggtgaccggcaacttcggcatcagcgggtcgaacgacgccgcctcggaggaatggctggcgaacactcttaaccagatcaacggcggcgacaaggcgagcgtcacgagcatcatcgaccccttgctcctcgtcgacgaggaccaccaggaggaggtgtgggcggcggcgatcatcgccaaggcctgcctgagcgccaagccctcgcggcggccgtcggcgcggcacgtgctccgcgccctggagagcccgctgcgggtggtgcggcagagctcatcgtcccggtccgactcggcccggctgcggagctcgtcgtcgaggagctcgtggcagtccgtgttcttacaggggaacaaccaccgggtgcagagcctggaccggcggcactcggtgaggtctcacgggagcggcggggaggcgtcgttctcgttctcgttcaagagggccgtggcggcggccccggaggtcgcgccggagccggtggcggcggcgctcgacgaggaagccgttgttgtgtagtgttactggtagcgagtaggacgccatttcttgggttctttcttacaggcattcctgattctttccttacgtgatgtcagtcacatcgcattgtgtgtataatttgttgttgttgtctgatgcgttgatgcggtgttccaacatgacaagaaaataaaaactgtgcataaagagcatgttttcaaatatttt

SEQ ID NO: 39 - DNA, 3667 bp, Setaria italica
gttgcgagattttccagtattggttgttcattcatttcacaagtaaaaagacctcaatttctggacctgagtagcaaaataagttctttccgctgtagtcagtcccgactggtagcaatggctacagctccagccaatggtgattcagagagtggccctcagaggaactatcaggttgttgtggctgccactcgtgacatgggcattggtaaggatggggttttgccatggaagcttcttggtgaccttaagttcttcaaggagcttacacttgctacatctgaccctgccaagaaaaatgcagttataatgggaaggaaaacatgggagagcattcctgttaagtcaaggccattgcctggtcgtttgaatgtcatacttactcgatctggtagttttgattttgcaacagtagaaaatgttgttatctgtggaagcatgaagtctgccttagaactgctagcgtcaactccatattgcttatcaattgagaaagtttttgttatagggggtgggcaggtactgagggagtatcttaatagacctgcttgtgaggccatccatctaactgatattcagtcgagcattgagtgtgacactttcatccctcctattgacttctcagtgttccagccatggtattcatcttttccggtggtagagagcaacattaggcattcatttgtgacctttgttcgtgttagaaaatcactggcagaaactcacgagtcaaatggaaaggaatcaactgaagttgataccaagaatgacaagtttgaaacagagaatttctcttttctccccaagatgatatttgaccggcatgaggagtatcattatcttaatcttgttgaagatattataaggtctggtgctcagaaaaatgacaggacaggaacaggaacattgtcaaaatttgggtgtcagatgcggttcaacttacggaaaaattttcctctgctgacaacaaagagggtattttggcgtggtgttgtcgaagaactcctgtggttcatcagtggttcaacaaatgcaaaggttctacaagagaaaggtattcatatctgggatggcaacgcttcaagagagtatcttgacagtgttggcttggcacacagggaggaaggtgatctaggtccggtttatggatttcaatggcgacattttggtgctgaatatacagacatgcatgctgactacactggaaaaggttttgatcagctaatggatgtgatcgacaagatcaagaataatcctgatgatcggcgaataattttgtcggcatggaatccttcagatctcaagaagatggctcttcctccttgccacatgtttgcacaattttacgttgagaatggggagctatcctgccagatgtatcaacgctctgcagacatgggacttggtgttccattcaacattgcatcgtactctcttctcacgtacatgattgctcaagtttgtgatctttctcctggggattttgtccatgttataggggatgcacatgtctacagaactcatgttcgagctttggaggagcaaattcagaagatgcctaagccattcccaattttgaagataaatccttcaaagaaggatatagattcttttgtggcatcagacttcaagctggttggctatgatcctcaccagaagatagagatgaaaatggcaatataatggtggctcagctggagccccagtctatgagcttggcgaaattattcggactgctactatattaaaattaaccggacatcgcactagcttgtttttggtgatggtgccgaatgttcgcgattgtactctggcttcgtatctgaactctacaaaacctgctccccttttatctggagccggtgttgatggctcgttgcgagtgagagctgctttttgggtaacgccctgtcgcaagggtcgactggcgcgtgccccgcgagacgatgtattacctcgtgagatatacccaagtcactgaattcgtctacttgctaatactcggtactgtttgatatgtacacgtgtgctgtctggtttttttccctttcgacgtcagatatcgacctgcatgctttaaacatgcgttctgctgcgtttgttgtgcattggctatttggcctccgttttcagttttttttttctagtcgggttttccaggctcagacacgtacaccacactcttgcttgcatgagcgcagctcatctaatcgttctcgtgagttggggtgtgtggtgtagtgtgttgtgttgtgcgttcagatattataacttgtaccgcagtgtgaaggccttagaaaacggcagctaacacatccgtggcctgccatgcgctgatcacatgaatcgtatgtactaaactgccctcatcctgagtggataacgcgcgaccaaaactatactagcaaaagaaagaaagaaccgaagaattcacatgacaaccttcagtaacggcgagaacacacctaaatcctcgttacgactaacggaacgagctgagatgatttcatcccaaatacgctactctgagcacgtaatttcgccacaagaaccaggcaggcattccgattgcaattggtgatcagctggcagccaactcggacgcgttgctctcatccatgaaagccttcatctccgtggcgagcctgccgcagtcggggagcacggggaacaagaagaaggtgtgaatggcctcggggaactccaccacccgcaccgccttccccttccgctgcagcacgccggcgtaccgccgctgccagtcctgcagcgggtcgagcccgccgaccaccaccatcaccggcgggaatccctccgccaggtcggcgttgtcgtcggtcacgtgcgcggccgggtggtcccggtcggcgccctccggcaggaacgccctccacgcccagtccgagccccgcatggtcaccaccggcgccttgccatccagcctcagctccgcctcggtccgctcctcgccgccaaagtacggctgcaccaggatgatgccggcgaggcggatggggttggagggaggcggagaggcggcggcgctggccgtcgtccagcaccgcgccacgtggtgtgcgatgttgccgcccgcgctgtcgccggcgaggaagcagcgggagaagtccaccggagcagcgacgacgtccgggaggccggtggaggcgaggtggcggagaacgtccacgccgtcttcgtaggctgcggggtaccggtgctcgggcgcgaggcggtagtcgacggacacgacgacggcgcggagctcgcggcagagccgccggcacatggcgtcgtagggcgccgaggccgcggagagcagcgcgaaggcgccgccatggaaatagacgagcacggggagcggctgcgccccggccgcctccgacggcggcgagaacacccgcgcccacaggccgcgcgccgcgtcgacgtcgacgtcggcagaccggacgccagacttgtccgggcgcgcgctggcgcgggcccggcggtcgacgaggttgaagaaggagcggttgacctgccgtcgctccgcatcgtgacgccggcggccgccacgaggccgaagagctggagccgcaccgaccacggcagcgccggcgcgcgtgccgccgccgtctcgtggtcgttgctggcgcctgcttccatctcgctcttgctcgtagctcgc

SEQ ID NO: 40 - DNA, 1136 bp, Setaria italica
cctccttcatatccaacggcccaccctcctcgaccattccgccccccaaaccctaaccctctttccctccttcccctccggcgccgccaccccgcgtcgccgctgccgccgctgagatgggccgcgtgatccgcgcgcagcgtaagggtgcggggagcgtgttcaagtcccacacccaccaccgcaagggccccgcccggttccggtccctcgacttcggcgagcgcaatggttacctcaagggcgtcgtcaccgacgtcatccacgacccgggccgcggcgcgccgctggccaaggtcaccttccgccacccgttccgctacaagcaccagaaggagctcttcgtcgccgccgagggcatctacacgggccagttcatctactgcgggcgccgcgccacgctctccatcggcaacgtgctgccgctcagggggatccccgagggtgccgtcgtctgcaacgtcgagcaccacgtcggggaccgcggcgtcttcgccagggcgtccggggactacgccatcgtcatcagccacaacccggacaacgggacatcaaggatcaagctcccctctggtgctaagaagattgtcccgagcagctgccgtgccatgattgggcaggttgctggtggtggcaggactgagaagccaatgctcaaggctggcaatgcctaccacaagtaccgcgtgaagaggaactgctggcctaaggtgcgtggtgtggccatgaaccctgttgagcatcctcacggaggaggtaaccaccagcacattggtcatgcctccaccgtccgccgtgacgctcctcctggccagaaggttggtctaattgctgcaaggagaactggtcgtcttagaggccaagctgctgctactgctgccaagtctgataaggccacttaaatcagttagttttgccatatggagcataatctaccttatagattaaaacatgatttcctgcatggattttgtgtcattttgatgagactgtgggcatttatcagttttgtggctactgttgagatttttggttctatataaacaagttgcagtgtatgttattgtgttttatgctagtgctctcaccgatatttcttgaaccgtacgttgtggaatgcatctatttttattttc

SEQ ID NO: 41 - DNA, 1210 bp, Setaria italica
accaaaatccaatccgtctcggcccacagcccacaaaaggtcctcaacgaattcgggttaaggggaagaaaccaagcgcaaggcggcgtccactgctccccttcgtgttccgtgttccaactccggcgactccaccaccacccgtcgtccgagcagccagtccactccggccaccgcgatgtcgaggcgcggcgattgggtctacgagaacaacggcgggacctgcgtggccatcgccggcgctgattactgcgtcgtcgcagccgacacccgcctctccgtcggatacagcatcctcacgcgcgaccactccaagatctgcgacctggctgacaaatgtgtactagcatcttctggctttcaaggtgatattaaggctctgcacaagaacctagctgccagagaattgctataccaacaccagcacaataaaaggatgagctgtcctgccatggcacagctgctctccaataccctgtactacaagcggttcttcccgtattatgccttcaatgtgcttggtgggcttgacagtgaggggaaaggatgcgtgttcacctatgatgctgttggttcctatgagaggactggttacagtgctcagggaacaggatcttctttgatcatgccagtcttggacaatcaacttaaatcacctagccctttattactccctgccagagatgctgtcacgcctttgtcggaatcagaggccattgatctagtcaaggatgtatttgcatctgcaactgagagagacatctacactggagacaagttggaaatcgtagtcattaacaaagctgggaccaagcgtgagtacattgagctgaggaaggactaaagctgttacttgtgctgcagctgccatttgcttccaacgtgttccctggacgtgggatgtattgcctaaagctgtcgcttcatagaaacactcgtgtttgcttgcatctgtgctgtaccaggattcagtgagctttttttttttgtttgttgaaacaaattgctttgatgctgaagtgatatttattggcagaaaggctacgatgtttgggagcaccacatgaatagcttgatccgaaatgtaagatgtcttcttctcgatagagaaaaggacagaaatgcctagaaaattcttgtagcaagagttgatggtagactccacaaagatcaagttaacctgcaggaagttttcttagttgaagttttc

SEQ ID NO: 42 - DNA, 1145 bp, Setaria italica
ccaacgagccccacggcgcagcgaggcgcacgctaatccgccacccacggccagacggccccgccgcattgctgcgcgccgccgtccctcctggcgcgagaggagagaagactcgaaccagcggggggcctgctcgggggcagcctgagccccgccgcggcgggatcggaggaggaagaaggggaggcgggcatgtgcgatctggtggcccgcacgggccggcacctgcagcgctacgaggacggccgtcgccttgtggccgggtgcataccattcagatatagagacattaaagatgaacaaaagaaacttgttgaagttctcatgatcaactcccagagtggaccaggtcttctatttccaaagggaggatgggagaatgatgaaactgtggaagaggcagctgcacgagaagctatcgaagaagctggagttcgaggagatttagtgaaactgttgggcttctacgatttcaagagcaagcaacctgaaggtatgtgcagagctgctgtctttgcactgcacgtgaaggaagagctggcctcctggcctgaacagagtacccggcagaggagttggctcacggtacctgaggcggcagagcggagtcgtcacccatggatgcaagaagcccttgtgacaggcttctctgcctggcttgagaactggagcaacggtggtggctgtgtggaccgaagcgaaagatgacgacacctgaagcatcaggaggcatctgctatttccttttccctttttacctttgcttgggttaaacttccataacctgacgtaactgagggctccctgatgctcggtagtttgttggttcacccacaatttcaggacacattatagtgtgtgtgtcgtcagccgacccgaggattgttggaattgtaagttgctgattctcgcggtcaccagctatttaagtcttacaccaaatgttgtgttgcaccttatatggaagcgcgtttgtaattgcaacattgaaagtcaggaattgtcttgttgatcaatctgtttctttgatctgggggcattgctcttctgtactctcccagagtgcggatgtattttgctggaagcgcatgcggaattgattgagctgtaaaattaaatcaaaaaaaggggatgggtttattttc

SEQ ID NO: 43 - DNA, 873 bp, Setaria italica
cccaaaccggaccgtcgcccccaacatcagttgcgcctcagcgtcaccgtcgccttgccgctcgccggtgactcgagacggcggagcgtccccagccccgttcggccgttccgctcccaccgaaggcttctccggtcgattggcgtcgctctcatcctcttccccaccctctgctggtgctgggcttgcgcggcgcgggaatccgtccacgctgacctagatcggcactctgcctctgccggtttcgtcgcaatggggttattcaggggcagcttcactctcttggtgggaatgggatgcggtgtctatatagctcagaactacaacgttccgaacgtcaagaagctattcaacacctacgtttttctggcaaagcacatcgaggaaacctaccggaagccgaagaaagacgacgattgatccttttacattggttttccctgtttatgccctgggaaagtgaaagtacagctaacgtgatacgggaaaaatgcttttttgaaatggtgaagtcaattttggtgatcggtgagttttgaactatggtggattatcttggttagttgtggaattcagttgctgtaaaagcttttgctcagtttagaccatgtatatctagacgagcactcccttttggtcgtgttcctgtgcctgggaaatgcactgaactttgtagctgaagtgtggcgatggatatctcagcatcatatcagtgtgtttgtcaagttaacatgggctgggatgatatgtttagttgaatttagatttgctctattttctaaaattgcctcttttttttccttccagatttacagatatggatgatggaatttatatctgctactgaaatggagggaatggcggaataaatga

SEQ ID NO: 44 - DNA, 796 bp, Setaria italica
cggggccgccgcgactgcggccgccgggccagccgccagctccggtggtgactgaccagtgaccccgccgccgatcgacgaggagcctagttacagcgcagatgcttggtcagtagccgccggccgcatatgtcaggtctcgccttttgcgaggttgccgccaagttgccgtgctggtcggaatgctctggatcgaggctacttgctgcataccgcgttcggaggggagccgtttcctgccgctgggagaagccagggaccttttccttgctgtgggcatctccttcctaccgcagaaactcaaggcagatgcaatgggccatcaggactatgtcagatgatagcagtggccaaccaggcaatagcactcgccttttcagtgcaattcaatctttctggaacaagttttctgcaaagctgaagaaagcaaggaaagggctagcaacgaagatcatgttctttctgattggattttattgtgctacggcatttgctactgtcattgggcaaacaggtgactgggatatattgtcagccggacttgctgttgccattgtggagggtattggcgcactgatgtacagcgcttcctttggatttcttggtaggatcaggaacatggttaccatgttcaattactggaaagctgggcttacacttgggttgttcttagattcttttaaatatgaagtggatgggcttcttgattcatgtaacccattcaacttcgagattaatatattcactggcctctggtaaaattctgttccatgttttgatattatttctgccaatg

SEQ ID NO: 45 - DNA, 1121 bp, Setaria italica
aaatatcttatctcatctccctccccgctcttccagctcgagaaagcatccacagccaggagctcctcgttcgagcttctccacgtgaccacacgcattcactgtgccccgccgtctcagcctcatgtctctgctcacttcccccacgccgttcggcgtggccgccgtccaccgtcgcgctgcggcgcttccccttctccccgcgagcggtcgagctgccctgcacgtggccctcgctcgccgcggcggggtctcgtcccgcacgcagcggcgcctcgaggagcgcggcggaaagaagcgccgcggcggggtcgcggcgcccgacgtggacgaggacgcagcagaggcgggggcggccgagtgggaaggggagccgctggggttcgaggtgtcgacggagcccatgccggaggtgccggacccggagacgcccgacttctgggaggggccccagtgggaggccctcggcttcttcgtccagtacatgtgggcgttcggcgtcgtgttcggcctcattgcttgtggtgtcgcggtggctacctacaatgatggcgcaacagatttcaaagacactcctgcctacaaggaatcacaaacacaggagttccctgaggagtctgaatcatcaagcgctgatgtgtttgaaggcaatccgactgaggtagcaccagctcttgagtaggactgtggaggaaacacgggtgagagaagacgatgtctctcttttatttgaggtatagcctatagggccttacctgtaaagtagccggtaagacatgtaaggtttggttgaaatcataatgctcaaaaaaactggctggtgactattgagcactgaattttcccttggatgaaaatatagatggctagtggtgatggaattcaagtattcaactgtcagttgtacccagaagtagggaaaaagaaaagagagcaaggattgccatctttcctgtattttgcattcatcgtaccctataccatcataggatgcttttcatgcatatagtccaaggaaaatgtatataattcaaatgaatttcacaagttacattctgtaccggcacaattcatcatgtctctcttaggaaaattttggagtactactgtgaattcccttc

SEQ ID NO: 46 - DNA, 469 bp, Setaria italica
acagcacgacaaatcaaactgaaggacaaaatggcatccatgaagctgctctccctcacctgcatcctcctcctctccgggcttgtcgtgttcggcgagatcggaggggtggcggcggcggcggagccgtgcccggtggtgtgcatccagggcgggtacatcacctgcgacaactacccctaccagaagctggacggctgcgactgcgagtgcgcgcccaaggacggaatcaactgcgtgctccaccacctggtcaccggcgacacgttcaaatgcccagcgcaggcgtaggctttggctggagcctcgcaggggtgatacaagctcacccttgctgctcgtggtttcgctggtttgtacaaggcatcgtgatcatctgaataatattgtcgcttgttgttggtgaagtatgtttggtaaaaaaattgatgatagtgaagtactccatgacagccatgcgcttatctcc

SEQ ID NO: 47 - DNA, 1617 bp, Setaria italica
agcgccaccgcgacgactcatcgagtcattgtttgtcctcatccatccaaaattccaaatcgcaaaaaatccccttcaccatgaagctccgattgcggtctatggaggcgcgcggcggcgccgccgccgtcgagacccaccgcgtggatctgccgcccacggccacgctgggcgacgtgaagaccctcctcgccgcgaagctctccgcgttgcccgtccccgccgagtccgtgcgcctctccctcaaccgcagcgaggagcttgtctcgcccgaccccgccgccacgctccccgccctcggcctcgcgtccggcgacctcgtcttcttcgccctgtctcctctcacagccctcgcgccgccggctcaggccctgccccggaaccctagcccgggttctggctccgttccgaccgcgatggctgtcgacggcggcaaaggatcagagaagcccagcaccggaggctcctcgctgcaggcgcgagctgtggtcgtgaaccctagcgttccagccgcatccagtcctgcggatgtggtgatggcggagaccgtcgatgccacgaagggctggtcgagttttgtgcttagggatctcaagcgggagatggggaacgtcgttggcgcagagggaaccgctggaggtcgtctggttgcagccctacatgcagctttgcttgagttcggcttccacatcactaatccgatggggtcacgcctctctctgccaccggactggccgccagttgcttcgaagccactggccatcaagtataccataccggagctttcaccgatgttacatgtggccgaggaggggaaggtggcagtgcttaacttctccttgatgccaaatttcgtgatagtatacggttatgtgcctggggcgcagtctgaggtgcgccgattgtgcttggagctgccaaggcttgagcctttgctgtatctggatagtgatcagctgagtgcagtgcaggagagggggattcttgatctgtggacagtgctgaaggatgagatgtgcctgccactgatgatatctttatgccagctgaatggtttgcgcttgcccccatgcttgatggctctgcctgctgatctgaagagtaaggtcttggatcttttacctggggacgatcttgcaagggttgagtgcacttgcaaggaaatgagaaaccttgcagcagatgatagtctttggaagaagtttgtacagttcagaaattctggtgagggtcctagagggtccatgagcgcgaaggccatatttgcagaagcatggcaggccaataagaagcggcagaagaggccccatccaaccttttggaactatggctggggaaacaatccttacagccacccacttaggctgccattgatcggtggggactcagacaggctaccgtttattgggaatcagggttctgttgggcgtaactttggaaatcaacgaaggaacatcgtgccaaactgcattcttgatggccaccgccataacttcctttgaagccatttcgggttttacttgtatgctaaaagtattttgtaagaagcggtgcgtagacggatagaccgtcttgttcatatctccaagttgcacgcttatgcttttgcaaagcact

SEQ ID NO: 48 - DNA, 2480 bp, Zea mays
cagcaggccagcaggctcccagtttgttttgccacgcgccgacgacgacgaccagccgtcattccttggcctcgtccgtttccctcctccagaccagaccagacctccaccgctgagagcatttcagagagagagagagagagagagagagagagaggagagagagagagagagagagagaagaggacgtacgacgaggagggcaatggggatgggcagcgacgccgccgcgctgttccccttctccaccagcaccaccgccacgtcgccgcggctctgcggcgccaccgccgtcagccacaggaggatattctcagacgtcgctgaggacgtgacggtgtcggtggacggccagtcgttcctgctgcacaagttccctctggtgtcccggtgcgggcggatacgcaagatgttggcggactcctccagctccaacagcaaggacgcagacggccaccagaagctggagctggcgaacgtgccggggggagcctacgcgttcgagctggccgccaagttctgctacggcacaaacttcgagataaccgcggcgaacgtggcgcagctgcggtgcgtggcggagtacctggagatgacggaggaccagcacgcggacaacctggtggcgcgggcggaggcgtacctggccgaggtggcgctgcggagcctggacggggcgctggaggtgctgcgcaggtgcgacgacggcgggcccgtggcggagcaggtcgggctggtggcccgctgcgtcgacgccgtcgccgccagcgcgggcaaggagcagctggtctccggcctggcggcgcacctggagacgtgcgactgcgccgccgccgcgcgctgccgggaggactggtgggtggaggacctctccttgctccggatcgaccactaccgccgcgtcatcgccgcgatgcggcggagcggggtccggccggagaccatcggcgcgtccgtggcgcactacgcgcagacgtggctcaagggcgtggacgtggagcagcggcggcgccagcgcgcctgctgggacggatcgggcccgttcgtcggcgacggccagcggatggtcgtcgagacgctcgtcgacgtgcttgccacggagaacgtcgcggccgtcacgctctccttcctgttcggcatgctgcgggtcgccgtcgaggtcgacgccagcctcgactgccggatcgagctcgagcgccgggtcgggatgcgcctggagatggcggcgctcgacgacctgctcgtccccgccgcgcagaccagcgactccatgttcgacgtcgacaccgtccaccgcatactgctcagcttcttgcagaggattgatgaggatagctcgggggacctgtcgtctcccccctgcgggtacgactccgacggcctcaagtctcccagccacggatcggtgctcaaggtcgggaggctcatggacggctatctcgcggaggtggcgccggatccgtatctcaagctgcagaagttcatggcccttattgagctgctcccggattatgcgcgcattgttgatgatggcctctatcgcgccatcgacatatacctcaaggcgcatccatctctgacggagtcggagtgcaagcggctgtgcaagctgatcgactgccagaagctgtcgcaggacgcgtcgagccacgcggcgcagaacgaccggctgccgatccagatggtggtgcgcgtgctctacttcgagcagctccgcctcaagtcgtccttctcgggcggcgggtccgggtgcgtcggcttgggcggcgccgacgggtccttctcgcagcggttcgtgtgcagcagcagcggcgtgccgagctcgtgcgtgtccccgcagcgggacaactacgcgtcgctgcggcgggagaaccgggagctgaagctggagatctcgcggatgcgggtgcggctgacggagctggagcgggagcaggggctgatgaagcagcaggggaggatgcgcggcggggacggcggtggcggcggcgggcggggcggtggcggcgagcacggccgcgccttccttgcgtcgctgtcgaggggcatcggccgcatcaccatgttcggcggcgggcctgcggcggccgacaggcggcgcaagaagagcggcggccggagctcccagtgctccgacggcaaggcccgcaggcggcagaaggcgtccttcgcctatgactgaagcttcgctgctggcgtcgacaatggaggcgcggcaggcggcgatcgtggatggatgcggtctcagcgtctggaggatcggtcggagctaaagcagggacggtggctgctgacagctgagtgggtgacgatgatcaagaattcaagactgcggttttagctgttggtgatggcagtccgtcgctcagacgaacaaacaacagggaggaatggaacggatcaggaggagtttattgcaggaaatgctacaggctagcgagagattttttagcatgcaggaacgacgcaggatcagtaaa

SEQ ID NO: 49 - DNA, 1457 bp, Zea mays
accggcacttgtcttcttccataccacatttccactggagcgaaaaatggtgatgctacctctccagcactcgtaggccgccacaattatgcgcttccatttccacttctctgagaccagacagctcgagtctttatccgtcgcccccacttgacccctctcgccactccctcccctccatcaacaattcggtttcttgggtgattttttttcttgcttgctcggtttcttgtggggcgggccgcgaaccggcgaggcgggggcgcggggcaacgcaaagcagcgcaggggcaacgcagtgcagcaaaagcttcgatctttatccgccggattcctctcctcccctttcctctctctccgtctccccgcttgctttgtgcttcgttgttgagaggaggggagaggaggggagacccacatccacttgcctttctcctctctcctctcgcagccccccttccaactcctcctggtccctggaaaaaggagaccttttggtgcaagattcgatctgctgtggctgcctcggccttgctgcgtgcgcggagatttggtttcttggctggcgcgcgcgggcagttggagctctttgattcaacaggttcagattgcagcggcgagcgactgctctgcggtcgaggctgctgctcgccgggtgattccgtgcccgctcttggtggcggcgggcggtgtcctcgtctgatccgtttcttcgggaggctttggttgatgtgctgggtttcctcggagctcagttccccaattcgccattttgatgaggagctcttcccactgtgagagctactgcgctcctcccctgtgctacctcccctgcctccccaaatccaaagacgttgcagtcggtgacccggagtccgggtccccgagccctgccgctgtcgccgaggacaagccgcccgtggtccagaagatcgaggaatctgtggcggcaaccggcggcgatggcgtcggtgatggtgacaagtgctatcgggaggtggcggtggctcccaagagttgcttgaagagggctaattgcgaggacagcagtaagaatgcggtgaaaggcaatgtgaagtggaaggatttgctggggaaggatctcacgctcacgcaggtcaaggaattcgagccaagcgaatctggagactcagacgacgaagagtacgctggcgcctgcgcctgcgtaatccaatgaggccagggatctttagtgtaaattctgtgaagaaaaaaaatcaaaacaaacaaacagaacgctctcagtcagccattagtcctggtcagtagagggtagggagcagctgtgttggtaattggtatgtggatgccatggctcgtgttgtgttctgtcagcagcttcaactgtaaaatgttgttacaaatgcatagctttagaagatattattattatctgccaaatgtgatatgttctcctgtctgaaatcttcttgtaa

SEQ ID NO: 50 - DNA, 807 bp, Zea mays
aaacggatcccagatctcaacgcaactaaaacattttatcttctctatcgctactccaagagtacccaatcaccgagccatggccatctcagtcactgccgtggccgccttgcccgctttctcggctcaaagaagcctcccgcagccgtcccgccagagggtcgtagcgttcatcgtcgtccggccggtgcgcgcgcaccgccggtttgtgggcgtggcggccagctcgccgcccacgccgccggatctcgcaaagaaggtgtccgagagcatcaagcaggcccaggagacgtgcgcagatgacccggtgagcggcgagtgcgtggcggcgtgggacgaggtggaggagctcagcgcggccgccagccacttgcgcgaccggcagaagggcgccgacccgctcgaggagtactgcaaggacaaccccgagaccgacgagtgccgcacgtacgaggactgaaccacgcgcgcgcgaggttggatcgctgtcacttgatctagctagcagcttagctcggcatgatggcgacatgtgtagacgtgcaatggatcgggtatgatccttcgttgattcagtctggcttggtgtggaataaaacgaggtttgctgtttattataagtaacatttaggagctcctactgtagttccaaggcaggtgtaatccttagaaacatttgatggtgtgcttctagccttgtagtactcgatatgtgcaattctgtaaagtatcgcagatttttcacctgagcatgatattgctgcaaatatgatctggtctctaaattggctaatgtgtggccaattt

SEQ ID NO: 51 - DNA, 2045 bp, Zea mays
ctcctgtcaaaaccctagtttcccaacatcgtcggctcctctctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgcgccgggaaggtgctcaggaacgatttccagtctaaagagctccccaacacccgcatcgagcccgaccgccggtggttcggcaatactcgcgttgtgggccagccacagcttgaaatgttccgggaggaactccagagtcggctttccgacaacttcagtgtcatcctgaaagaacggaagctgccactatcgctcctgcaagatcatcaaaagcaagcgaaggcacatctgcttgaagttgaaccttttgagcatgcttttgggccaaagggcaagaggaaacgtccgaaactaactgctcttgactacgaatctttgctgaagagagctgatgattcccaagatgtgtttgagcaaaagtatgcttcatcaaagttgccaagggaggaagaagaagatggcttacgtgatctagtgaggcatacaatgtttgagaagggacagagcaaaagaatctggggtgaactatacaaagttattgactcttcggacgttgttgtgcaggtgttggacgccagggatccaatgggcactcgatgctaccatctagagagacatctaaaagagaactgcaagcacaaacacttggttttcttactaaataagtgtgatctaatccctgcttgggctacaaaaggatggttaaggaccctttcgaaggactatcccaccctagcattccatgcaagcatcaacaagtcatttggcaaaggatctcttctgtcagtattgaggcaatttgctcgtttgaagaatgacaaacaagctatttctgtcgggtttgttgggtaccccaatgttgggaagtcatcagttattaacacactacggtcgaagagtgtctgcaaggttgctccaatacctggagagacaaaagtgtggcagtacatcactctcactaaaaagatatttttgattgattgtcccggtgttgtatatcaaaacaatgattcagaaactgatatagttctgaagggtgtggtccgggtgacaaatttggcggatgctgctgagcacattggtgaagttcttaggcgtgttaaaaaggagcatctccaaagagcgtacaaaattcaagattggtctgatgataacgattttcttgtccagctgtgcaggaccactggaaaacttctcaagggcggggagcctgatctgacaacagctgccaagatgatacttcatgactggcagaggggtaaaatccccttctttgtaccccctccgcagcaaagcgacggcggtgcatctgaaagtgctgaacctattgggattaccaaagaggacggagtaagcagcgacaggactgccgcagccatgaaagccattgcaggaataatctcgtcacagcagaacatgaatgtgccctgccataaggaaaacaatgcagacaatgaagacactactgaaaatgcagataacgaagacattgagagttcagataacgaagacaatgatgacatcgagcctgcagagcgatctgagtgatctttgggtacagatgtggattattagagttgatatgtcaaggctaattaatttgtcagcccaggtgttgtgtagctacttgaccatatcactggcgtgctagaaaaaaaggatcatgttgagttgcactttttgtaactatcgtacctgaatctttgtaatagggcaagatcagttttgctaggtacctggttgtatcgggatggttatctgtgctgtctactacaaatacagttacatctattttactt

SEQ ID NO: 52 - DNA, 1781 bp, Zea mays
aatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcggtgaagagaggtgactggtataggaccaaggatttggtgattaagggggcagactggatagttaatgaaatgaagaaatcaggtcttcggggtcgtggaggtgcaggttttccctctggtctgaaatggtcctttatgcccaaggtttctgatggacgcccttcttatcttgttgttaatgctgatgagagtgagcctggaacttgcaaagatagagaaatcatgcgccaagacccccacaagcttctggaaggatgccttattgctggagttggaatgagggcatcagctgcttacatctacattcgaggtgaatacgtgaatgagcgtctcaacctcgagaaagctcggcaggaagcatatgcagctggacttctcggtaagaatgcttgtggatctggttatgattttgatgtgcatattcattttggtgctggtgcgtacatctgtggtgaagagactgccctattagagagccttgaagggaagcagggcaaacctaggctgaagccacctttcccagccaatgctgggctttacggctgccccacaactgtgaccaatgttgaaactgtggctgtatccccaacaattcttaggcgtggtccagaatggttcgcaagctttgggcgcaagaacaactccggaaccaaactctactgcatctcaggtcatgtgaacaagccttgcaccgtggaagaggaaatgagcatacctctgaaggagttgctcgagaggcactgtggaggtgtgagaggaggatgggacaacctgcttgcagtaattcccggcggttcatccgttccccttttaccaaagcacatatgtgacgatgtgttgatggactacgacgcgctgaaggctgtgcagtctggattgggtaccgcagctgtcatcgtgatggacaaatctacggacgttgtcgacgcgattgccaggctgtcctacttctacaaacacgagagctgtgggcagtgcacgccctgccgagagggcacgccctggctctggatgatcatggagaggctcaaggttggtgacgcgaagctagaggaaatcgacatgcttcaggaggtcacgaagcaaatcgaagggcatactatctgtgccctcggggacgctgcggcgtggcctgtgcagggacttatcaggcacttcaggccggagttggagaggaggatccgcgagcgagctgaaagggagctgttggcggcttctgcatgatgtgccagccgcatgtactagttttctgatttctttctaccgaaataatacaaactgatggagctcctttctgtgtaagcaaatgctagcattcctgatttctttgaaccgtttatgtggatgtttatttgatgcactcaagcatctgacggattttgatggactaggtacaccttttcatagtagaaacaaacttgagggttgtaccgtgt

SEQ ID NO: 53 - DNA, 2139 bp, Zea mays
cgaagctcccagcgtcctcctgcaggccgagctgaaggttcagcgcgccggtggagttcgacgacgaaactccgtcacgtcatacctctccgcctcccgtcttccagacgtctctaatcggggtcccagcgtctcggagaagaggagcagcacggcacggcagctgtggcgaggaaggctcctgtcccatcccaacccagttagcagccgcccaaggaggaggagatccaatcggcgtgcgggcgtccgcggtccatccatcgatccaattccaatctgcaggttatactcaaactgcacacagtagcatccttctggtacaggtgtatgtaattttgaagtaacaaaggatttggaacccagccctctgttctccaccaccgcttcgaagatgccgcaggtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgctggcaccagtgaccgctgcagcaatggaagagtgggtgcttgatgaatatgctgccaagcataaggttgccattgataagcttctacagctcagggtctttgttgaagtgcgcgacagacgacgggacgtgagctacaagatgaatcagaagttccagggaaacatgcagaagtatttggttgatggtggaagtttaccaagggaacctttaccattaagtgtcactggtcgattgcccacaccagcagatctggaagcctatgctcttgatcaatgggagtgcttcttgttgcaattgatcaattcatctcaagtcgaaaaagggtcaagttttagctcctccatgatgaagacgtttcagcgtggtcttctgagttcaagggatggtgaagcttcaaagttgactgaaaatggcttccaatttcttctgatggaaacaaatgcacaactttggtacataatgagagaatacatttcatctgctgaggaacgtggagtggaccctacggagctgatatcatttctcttggaacttagctttcataaattgggagcggcttatagcttgaacactctgactgatgtccagaggattgccatcagggatcttgcagaattaggactagtcaaacagcagcagggtcgaaaggatagctggttcattcctacccaattggctactaatctttcagcaagcttgtcagattcgtcatctaacaaagagggatttgtggttgtggagacaaactttcgaatgtatgcatactctacttccaagttgcactgtgaaattctacgcctttttgcaagggtggagtatcaacttccaaacctcatcgtaggagctgttacaaaagaaagtatctatggtgcttttgaaaatgggataactgctgagcagataatttcatttcttaggcaaaatgctcaccctcgtgttgctgacaagatacccgctgtcccggagaatgtcacagatcagattaggttgtgggaaactgacctcaacagggttgagatgattccatcgcatttgtacgaagattttcctagcaaggaatggtttgaacaatgctgtgattatgcaagggataatgggtacttgctgtgggaggaccccaagagaatgagactaattgtacgaggggagttccaccccgaaatgagggagttccttcgcaggcaaagatgaggaacgaccttgtacttgacggaccatgctatgcttctttgtagtgcatagaaacactgtatcgggtaatagttctcctttaaatatcaggaaagggtctagaaaagggctcagtttttgaattattttggtgacctgtgagctgtggaagcatatgaataatgtggtgttcaatggagcaaggcccaacatccttgatctgcttctaaatgttactagtgactgtaccctatgctggtgtatggctggtggccaggtcctgttggaactcttaggtaggtagtatggtgggatggagttggtatgctcttaatttgttgttatttggattgattctatataggacggagtgattttaaaaatgaaaaaaactcaaatgatgaaccatttaa

SEQ ID NO: 54 - DNA, 914 bp, Zea mays
ctcggaccaagcagcggcagcaaagccacgacagcagtcgaagcgcgcggcgcgcctgcctagccatcccggccacccggggccagggcccagggggaggggaaaccgaggcaggcggcggccgcagcagcggcagcgcagggcgcacgcgcttctcgtttcgtgtccccactccccagccgagggggagttggagggaaggaacgggaggcgcagcttcaaggaggaggctggcggccgagcgtccgtgcggcatggggagggacgagctgctgcggcggagcctcgtggcgctggcggcggccgtggcgctcacgggcttggccacggcgtcgctgcgcaaggcggcggccacatacgggttcggcatcctcgccatcgctggcgtgctgctcccggactgggagttcttcgaccgggactactcccagtggctcacccccatgcccgcctcccgacgcacggccgcggccgcggccgccgaccgggagcacgacgtctggaaattcaagccctatcctctcagggtggccatgctgacgaccatctacgggttcggtcttcacaagtggtggacgtacgtatctagctagcggagtgggtcttcacagcatgaccgacgaacccgaaggttgaaatatcattgattaggttgtagccaagttcctcttttttttgttgttggattggaagaagcaaaatactgtgacagcgccttgtcatatatcatcagttcttcactgtgatcatgagattagccagctgttctaatggggagcgaccctcgacacaaattgatatatgtagcgtaactagcgatcttccattcgcgctgctgctgctctttgatcgccgtcattgcttctgaaggactattgcttctgaaggactatgaatcttacagtttgctcgta

SEQ ID NO: 55 - DNA, 1377 bp, Zea mays
acatttctcttctggaacataagtagcgtgcaaacttcgaccgggaccggcgatatccgccatggccaccaccactgccgccgctcgctggagcttccccgcccgtctccagctcctcaccagccgccgcttttgcttccccgcctcctctgccgcgccgcccagttctgtagcggggttcagttgggccgacgccctccgcgtcgctggggacggcgggcgcggcgacgagtccgacctctccgggtacttccggaaggtcaagagctgcaaccgcggaatggataaaaaagggcagttcgtgaagttctctgtggaggatcaggtcgtggggtacatccacaagggatttatcgaacacatcagagactttcatgatgtttttaccattgtcatggatgacaatggcagcaacactgtggagcatgtgtctctccagtcatcactaaggactccagaagaccgaacacatgctattggaagtgtcattaaaagccttggagaattgattccaggtattcgaaatgagctctacccagtaacgtcatcttatggcatgcctgtgtacttctctctggaacgtgctgctgctccttactttggtataaaagcttatggagttcatatgaatgggtatgttgagaaggatggtcagaaatttctttggattggtaaacggagtgatgtgaagcaaacatatccaggaatgcttgatcatcttgttgcgggtggcctgccatacggaatgtcctgcaaagagaatatcatcaaggaatgtgaggaggaagctggaatcacaagatccatatcaacaaatgctacttctgttggagcggtttcttatatggatattgaaggctttagatacaaaagggatgttctcttctgctatgacctccaacttcctgctgattttgttcctaataatgaagatggtgaggttgatagcttcagactagtccctgttatacatgctgcaaacattataaggaggacagattttttcaagccgaactgcaaccttgtgatcatcgacttcctcttccgtcatgggtacataaacccagattctcgttgttacttagatctgctgcaaagcttgaggagtggtgattgttcctaactctcttttgctgtccacatttataatcattgttcaatttaatgaaacaaaaaaaaaatcatggagtagtctggtattatggttgatcataatcataattatgcctgggactccattgtcattttagtatgaacagagcattcacgtgcggttggggattatgcctgggactccattcatcgagttccgttggttggggaagcttctccttcccaaagcatgacgcaagtgctcatcatgtgcggttgctggag

SEQ ID NO: 56 - DNA, 1092 bp, Zea mays
aggcctccgcagtccgcacacccctcctgtgctttgagattcgcgcgtcgcgcctgccgacctcgtgcctcccgcggactcgccggcgaacgcctcttggagatgccgcccgccgcggcggcgctcctccggtgcgctccggcggtcccattcgcggcccgcagtagcgctgtttcccgctcaggcatggcgcggcgtctggtggcagcgagcgctgcggccggcaggctggcaccggcgtaccgcgggctgctgctcgacgccggtggcacgctgctgcaggttgcgcggccggtagccgagacgtatgcctccatcggccgacgttacggtgtgacgaagactaagaagagaatcatggaggggttcaagcgggcattctccgcgccatggccgaagacactcaggtaccagggagatgggcggccattctggagaattgtcgtggcagaagcgaccgactgcactgatggtgattatttcgaagaagtgtatcagtattatgcgcatggagatgcttggcgattgcctactggagcagacgcagcactgcgtgagctgaaggatgctggagttaagctcgctgttgtatctaacttcgataccaggctacggaaattgcttaaagaccttaatgtctccgagatgtttgatgccattgtggtgtcatccgaggtcggatatgagaaaccttccccagagatcttcaatatagcattggatcaaattggcgtggaagccagcaaggcaatccatgttggagacgatgaaactgcagacatggcaggtgccaatgctacaggacttgagtgctggctgtggggtaaggatgtgacgacgttttcggaaatacaggagcggattctgacaacagatggtcctcaatgagtgaatttggaatgttgcaaaaaaatgatagttgttttttttccctcagttccttcttttttgtttccttccaactcgtgtgttggcattttcattgtgctttcgtgaaataagctcatgccatggctaggtactgatgttccttcacattcttctcacatatgaacatttaataagaagcacaaggactcttgataattggta

SEQ ID NO: 57 - DNA, 413 bp, Zea mays
atccctaatcccagcgcagcacaaacaaacaccgcgccgccgccacagctttgccctacagaatccttttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctattcctcattctttttgtatcatatatgtctgcgacatttatatatatgaataaagttggatgatctgctgcat

SEQ ID NO: 58 - DNA, 1920 bp, Zea mays
aagctggtggtggcgtcgtgaacaagaaattcctccggttccacgcggtcccctcccctcgctttggccccatttattttcttccttttccgctggttttctggtggggggcggggggttttgcgctggttgttccggttgggtttaggacgccaaccagctggttttccccaccccgcttgcgcttccatccgtgagctcatccgcccagctggaaaacaagaatcctcatgagttctagaagggaagtcgcgatctctgggtgaggtgtccgtttcctcccgttgctggatccgctgactgaccgatcggcagagccgccatggcgtcgtcgtgcatcccggccggcggcatccggctgccggacctggagatggtcaaggccgcgccgccggcgcactccgcggcgtcctccacgctctcggaggcgtccagcgcgtccgcagtctcctcgtcggccacctcgtcatcggtggcgtcgctgtcgctcaagcgcccgcgcacgccgcggaagcggtccagccagacgtacaacgaggcggcggcactgctcgcgtccatgtacccctccgtcttccccgtcgccaggggcggcgccgcgccgcgccgcctcctcggcctcgcctccgcgctcgccgacgactcgtcctgctccgacctcctcccgccgttcccagtccccggcggccacgccgccttcctcctccgcgacctgacgccgcggatccccgccgccgaaagctgcccgtcgcccgctgccgtcagcagcgtcttcagcgagttccgcgacccggcgccgtctcctgcgacccctgacgacgctgcggcggcgcctgacgagcgcagggatcttggcttcgacgatgacgacggtttcgacgccgattctattctgtgcggcgtcgaccagagcgcggccgagggcatcgatggcatcatgggtaagctctctatggaaaacaacggggcgtccgtatcaggctcaagcgttgactccaacatgcccggatccaagatgcacccctacctcaggaaccttatggtgctcgggctcagcttccggcaggatcagaatatcatcatcaatcaagcgctgaagcggcatagtgtcgatcctgaatggtggatgtgccctgccatacctgtgaaagacattaccccggcaccaccgccttcagtggcaatggccaaggtgacagacaagaagaagactaagaagaagtcactggggacaatatacgaggaggggagtcctgagcctgccaatggcgatgacgatggagctttggcactgccagagacaggattggggcttagcttgaatactgacggggtgctcaaggcgtggtgtggcagaggctctgcgtttgctgatggcaatgggcctgacttgccattgtcccctgctcatgtggtagttaaacatgaagacaatgatctcttcccaaagaatggtaccggcgctgttatcagggaaggcaacattctgaagatgcagcgcaagcagaagccatgcactcccctcccctccaacaagcagagtcggtactaccggcctcgggtcaaggggaggtttgtcagcaaggcttgtttcctccagcgacagcaagcgttagagaaggagagctagagaaagatggatcctgctccaaggcgcatttctggggctctcttggagaagcagcagagcttctccgttttcatctctgcggcggtacagtgcggcagatgtagagatgcctgtagagtggtgcttgtgaacctcaattctcagtttcttctatccattccaggttcccatattgtggagggttcgaacgtgcctaaagtgaagacagaaaacaacaacagactcctagttcacacacaatacgttttcagagcccaggtcacgtacccagcactcgaaaagaaaaaaaa

SEQ ID NO: 59 - DNA, 779 bp, Zea mays
accaaacaaaaacctaaagctaccaccaaagccccgagagacgagacgaggcgagatgagatgagatctatcttttatatatagcctttagcgcccttcaaacacttcatcccgaagtcaccgagctgagctccaaagaatctagcagctaggagcaggccgtgtatacgccatccaccacggcaacatgtgctccggctcctggtcctggagcagcagcaagaagcgcaagcgcccgtctcttgttgtcgtcaacctcaagcggcagcagctgcagaagacgccgccgccgacgccgcctcgtgcctcagttgctatcaggaggaagaggctgaggctgaggaggttgcgagccggagcagaggccatggagatggtgaacctgaagctctacctggagaaccggtgcatcatcgcggagaacgagaagctgcgggagagggccagcgcgctccgccgcgagaacctcgcgctgctccaggacctgtccaagacgccggccgtgccagaggcaggagcgggagctggagctgcgtgagattattgcttcctcttgctgcctgctgagcatggagtagctagcttagcttgcgttccctcgctggcgcttgtgctagttgcgtgggcaggacagcggactcctaggtatctatctgcttggctgctccgccatgtctgtgctctgctgtctgctcatacatcaccaggctcctggagctctcttgggtgctctgtgccatggtgtttgtacattatatataagtgcgcggattaactag

SEQ ID NO: 60 - DNA, 1592 bp, Zea mays
aaacctgggcgtattcctctctctttcctcatcctcatccgagtggctctctccttgtgctgtggcggcggcggcgcccggctctgctcggacggactccaccgaaggcgctcggctcccctcgggctgcacctgcgacggccggccctctgactgcaccgacggtgcccgccccccctcggcatccaccagcggtgcccggctccaagtccccgccgccactccgaccgtcctctagcagctccgtccggtggtccggccagctgcctagctccctccgaccgtccggccagcaccgcctcctgctcgcggtctcgcccagctcctccgccctccgctgagacgcagatcttggtgcggcagggcaccacagaggctgtgcgtgtgttggtggcctggtgctagcaaccgagtactatggatcacgaatgatgtattgtatgcaattcggcccggagcgtcactaaatcctggatccgcattggccgcagggccagtggccagtgtccagcctgccagctcagcccggcggcaagcgcccagcggctggctcgggcagcggccagtggcgagcagccgactcgtttcttcggcgttctccgccactgccccccagctatgcaccctgttccagtcccctcccagccctttaccgcaactcctgcaaaaaaacttgtttcaaggagcactgctgtgaggaaggccatccattttgtcaacctgcggacagctggaaggtctagtggaaacctggctatgaactccgtaccgaaaccagcacttgggtccgaaacatcttggagggaggattttgctgtgggggataaggatgctgtggtcattgttgatcatgggtcaagacgccaagaatccaatctcatgctaaatgactttgttgagatgttccgggcgaagactagctataggattgttgagcctgctcatatggagctagcggagcctactataaaggatgcttttggaaaatgtgtgcaacaaggagcatcacgagttattgtcagtccatatttcctttcccctggacgacactggaagcaagacattcctgctttagcagcagaggcatcaaaggagcactcaaatataccctatattgtcactgcccctcttgggctgcatgagcttatggtggatatcatgaatgatcgcatcaagtactgcctgcgacatgttgcgggtgatgtcgatgagtgtacagtgtgtgctggaaccggaaagtgccgcctgtactcctgatggagcatacctgggaattgtttctggagaatacgagatctgacgagtgtatatctaggtccgctgtgtaccgtgaaaccaaaagcttgtacagttcattctgaacagatcgtcagaattagacaagtgccaaattagttatgctgtgcatgcttgcgaacatcaataatggtagagattcattagctaatcttgagtttatttacataacgaacaaactcagtcaagtgctctgatatttccattcacatgtaatctatattcctgctaccttgtagttgaatgaattaacatggatcaaatgataatataatgtgcgcttgtttgatttgcca

SEQ ID NO: 61 - DNA, 911 bp, Zea mays
aattcttcgcagtcagcatctggactctggagtctgttgtctgcgtgtgtgcggctggttctctctgccaccgcacgagtcgcagcagagagggaaaaaccctagcagcctcccttcgtcccaactcccgcgaccccatggccgcatctaacggcggcggcggccccggcccgatctccgcagaggcggaggcggcgcttggagaggctatcaagctggtgttcgggcggtggacggcgctgcagatggcggtggagaaccagtggggcggccgcgactcccgcgccaaggccgaccagttgggcgagtccatcctattctggttctgccgcactaagggtccatattatttcgaagacttggttgatatgatgtatgacaaaatttctgaatcttttaatgcctactttgaggataatagtattgaggaggttgctgaacagtttttgatcatacatgaagaatgcctgcaaaacaacttttcgtctatagagaagctaaggaattctcgtgttccggggaatgctgtttctcaaagtagacagatagtgggcgatgacgacgatgacagtgatagctcagatgacggtgatgacacatcgatggtggctgatgaagaggctgggccagaagagatggcagtggacaggccaaggccccccaagcctactccagacgccgatgggtggactgttgtgcctcctaggcgtggtggtcgcagcaagaaatagagtacatggtagctgctggcttttctcgcggaatgtttgttgagtgctgcggttccatattcacttgtatcgctcgatatttgacccgacatggatgttgtgagtgtgtagtatgtttggtttgccaccgcccaccaatttggtgtaaacaaggtaattattatagatgcatcctgtgat

SEQ ID NO: 62 - DNA, 3909 bp, Zea mays
gaaggaaggaggagaaggcaccggaaatcctcccatcccgctagctggaacctggaagggctgaagctggagctggagtgctggacagtgaccgagagtgagagaggcagcagcggtccggtggctgtggcctccttggttgatgctcacccaccctcagggaggcacgagcgttccctctccggcgagccccaccccggaactcctccgagaaatgcggcggggcagccacagatgacaccttcctcttcttcctgacctgctgcagaggagggcagcctcctgcatttccgggttcccttgcgcttgcgcctcctatttcgtctttccacgagagtgggaaggggaagccggaggatgccggccaagtacctcggcccgggggcgttggcggaggacaggcgccaggacctccaccgccaggtgggctgcgtcaccgggatcttgcaggccttcgaccgccgccaccctctcgcctcctcctcccacaagaggctgcttcccccaacaggccatgcagtatccagtaacccaagcaaagagggcgattgcacaagatattcaccccagattgtgctggagaactcgagtaaaacatgggctgatagccaaagagcaccagcaacagaactgtctcaaacctcatattcatcgtcaccctcttcgtcattctcgtccgttgatgacaacaaatcaacacaacaggacctatcatccactgaccgaatgctatttccagagaggccgttcaagagctcgccgaagctcaagagttattttgacagtgacaccgggctcgactaccctgatgacgcgcctacgaagtccaaggacatgcccatagttcaatccagcctgccaactcttggtataagaaatcttgtgaaggattcaatctatatggatagccgtgaattgtcagtcagaatttgcactaaagaagtaacagatcacccatccaactgtggagatcaacctagggaattgaatgggcctccccgtgacagcacacaagaaaaaagcaagggtctcgtggacatcaatgaatcgcttcgagtgctagccaagctcagggaagcctcatggactcctgctgaatctgtccatcatgcaagactttcatatgatgctcctcggttctcatacgatgggaaggaggctgcatcaaaactgagggaggtaccaaggttgtcactggacatcaaggaaagtcaccttcggaatggtgaaattgactctagattgaacccaagcttgagttctacagacagaagcagcaacactgttattgggtccaatgcagcttttgagatccagcagaaacagcctgcctgcaagcggcttcctagcgttgttgcgaagctcatgggtttggaagagttgcctgagcataatcaaagtatagcatcatcacatgcatgcaaaaccgttcaagggagcaagcaagaggccatgttcaaccccttgagcatctcatctcacaacgagcatgctcttcgacaacaaaggaatcatgattcaactgttagaaatttacccaactcaaagtttcctgtcgaaactgcaccatggaagcaacaagaaaggattatccttcctcgcaaactgccaaagggatcaaaaggagcccacggaagagaacaacctgctgcatcagtcatcagtgacatagagaagcggctcaaggatcttgattttcgacaatcgtacaaggaccttagagcgcttaaacatattttggattccatgcaagcaaaaggactattggaaaacaaaaatagggaggaaatatctatgccaaagttatctgatggaaaccacaatggccaagagatagccagtgtgaacatgagagtgaacagtaacaccaacaacgtgtgtatgcctgaagagagcaacgctgaaagctctttcaaatcacctattgtgatcatgaaaccttcaaaatgtgcaaaccttttcaacgaagttgattcttctgtcttccccttagggggttcatctgatcccccacaacaacaaacaagcaatagcacctatagaaggaaagcttcaacgagaaatagaacagctaaagagcaacatgcaaaatttagttcaaaggtgcctacttctcaaccccttgtttcttatgacaggagatcatatggaaggaatgacgatagcagcaacaaccaaaaatctagttcactgctggttactgagagctcatccagaagacagcagctaccaagggacagtagcataagtatgaaaaagaataaacattccactaccccaaggttacaacagagaaaacttggttcagagcggagggctagaccacctattccttgtgctgagtctaacaaaagccaaaatcaatctggagataggaataatgcagaaacagtgtcaccccgaagcaaattcagaaggaaacttttgtgtccacaagaaggtgatgatgacatgccgagtggattgaacaacaggacaaggagcctgaaccagcatggcaatgatatgtccacaaggtcagatggcagtataactgttgcttcagagctggatattataagcaatgacagatctacggaagttgatatttctaattttgatcaaggcatcggaactccatccggaaggaacccacaaaaagtgaaaacctcatatgatgcaagcaaggacgtgccatctgtagacccttcagctggtatttcggaacggcccagtccagtgtctgtgttggactcttcatttgatcatgaggatttgttcccgagcagcaggaatccaaattcacttgctgttgatgacgagcgtcaaacattaggtgaagaaccctggaaaccttctgttacaaaggcaacagaggtgggcatgcagtccaagaacaataagctcgctaatgtcgtgagcctgcttcagaagctccagcagcttagcgtgagcaaggatgaggacgcacctccggtcgaccatatggctttcctgtgcgagacagaaagcccggaccaccgttacgtgtctgagatactgctggcctcgggtcttctgatgaaagagctaggttcaggacaggcaggcctccagctccagctccactcctctggctacccgatcaaccctgacttgttccacgtgctggagcaaagaaaggcaggatgggccagcatacctgacggcatccaccagagcaggagcggcgccaagtctgatcccaagagagcgcaccggaagctggtgtttgacaccgcgaacgagcttctcctccagaagtttgagaaggaaaccacagtttacgcggtcagttcctccaccggagcgaaggatcatccacctgcaaaggctcttagcgggcagcaactgctgaagtttgtatcttcagaaatcgaaggcatgggtacggagcgatcgtccacctgccagatggaaggcggcgtgatacctgacgcagagatcctgcagaggctgcagggatggacgagcttcagcagggagctccctgggatggtgctggagatcgagaggtcggtattcaaggagctggtggacgaggtggtgcatggggagtctgccgacggcccggagatgaaggcggcaggcaggcggagaaggcggcggctctttgcttgatatggtttgtgtgaccatcaccatgcaccgggtgggttgtccaagtagatgggcctgatcatgctgtaactttgattgccgtatgaactttttttctctctcaagggagaggtgcacaagttgtactgttgtagtataagcagcgcaggtttgcagaggcatgaaaaatgggcattggtttgtgctgtatagatactctgtataccattgccttttgattccttgtgtttcattggggatgatgctatttcagtaaagaagtgtacaaatggcagggttcatcattttaat

SEQ ID NO: 63 - DNA, 631 bp, Zea mays
actaagccagaggagtgcatgccctcctcctcctctcctcttggttcttgcagacaactcgcacctgcaggttgttcctttgtgtccaaaccaaggaaaggcggcaggctcctcacattctcctgccatatctgctgcccgctgctcccccctctctcttcaagctagccagtagctggctgaatggtcctcgcgcgagccatggtgatggagcacaggaagaagtcgaattatcttgttgccctcgtcttggcttcgctcttgctctccgccatggcaggagggcatcggaagaagcttctgaacaaagacgacgcatcagaatcaatggagacattggaatccacgcagcagctgcaggaagacgacgaaatggctgtggtggtccacgagagaattctcaggcaggcgaagatgaacgactacgggagctacgactcttcgccgaccatggctaagcctcacttcaaggacatacctaactagccagccccactagctactatatacattgaggtgttgcttgctagtcgagtcgcccctcctccgtcctcatacacaagcatacttgcctaataaattccatgtatcatcaccatgcatatatgtgagaatatatgtactgccgctt

SEQ ID NO: 64 - DNA, 593 bp, Zea mays
gttgcaggttggctagggattgccgccccagctggctggttatatattaggctgtcgccgccaaagaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacccgtccaggttgcagcagtcgagttgccgatgagaaatttaacagcttaaatgtgtgcctgatttatatatacagaagcattatattactaggcttgcttaaactgttctcatgacatctaatatcatattattatagatgtgacatatagatgtttac

SEQ ID NO: 65 - DNA, 1284 bp, Zea mays
atagagttgttctacttctattctactggagtgcattaccacctgtctttttccttcctcttcaacgtctcgaacaagcaggaggaggtagaccgaacaactccaggtcgcgggagcggccatttctctggggcgggaccgcgggagagctctagctcttgcagcagtagaactctactgcagccagagttaagagaaatggataaggatggcagctccgagagaagtcgcccagatcatggtgatgtgaagatgctcaagttcagaccaaaggtgcctcgacagaagcaaaagccaaagcaacaagaccctaagccaattgatgaagatgtgatgaagatattgaggactcgccaagtggctgcaaaaagtgcaccaaacacagaagatgagtgctcaccacagaagaccctctcgacgccaccttctgcagatgttgtttgcttgtcaccagcgcaactcggagtgcaaaaacaaaatcaattgccactccaaattcctagatccttccctgttcctgttaattcaggattggtttatgaagaagagagtagtgatgacgacgacgataatgatagtgacaatgttgggttgctggagactcagccagattcaattgaaagtgaagctttaacatgtccggctgaggagcttgatttgcttcagcaagaaggtagcaaagaaagaatgttcttcttccagttcccaaactctcttcctttacccaaaaggtcgtccagtgccggcaaggaggtgatggaaggatccaacctgcagcagctgcctcagggttatttgggcaaaatgctagtatacaagagcggcaagatcaaaatgaagttaggagacatcatctttgatgtgaacccaggagtagaaagtaggatgctgcagcgtgcagtagctctcaacactcgagacaaacactgttgcttgcttggagagattgagaatcgtcatgttattgtgactcccaatgttgattctttgttgaacgacaagtagggaccaactgtagcagctttgtcacagattgtgtgtagacctgtagatatgcagggttagtgacatctgtagaaattatatcagctctgtcaaatgatgtataggattttagttgtgtagtgttgtgaacgttttattgtgattgcagtgctatgttagttttagaactgcatgcagctccctgtggatgaatgtttgtaaggatcggtatttgaccttgattgtattggaaggcaaatataataaaaatcacgtcgttcttgtgggcaaggccttctg

SEQ ID NO: 66 - DNA, 1904 bp, Zea mays
cacagtcacggcccaaccaaacaaaccttaaataaccgtaaaaataaaaaatctcagctccgcgccacgcaacagcccatctccgctctgctcaccccgattccacccccccccccggccatggcaacgacggaggccaccacgctgacggcgctgctcaaggaggcggcggccgccttcccgacccaccgcgccgttgccgtaccgggcaggctggagctcacgcacgccgccctcgacgctctcgtcgacgcggcggccgcacgactcgccgccgacgctggagttctcccgggccacgtcgtcgcgctctccttccccaacaccgtcgagctggtggtcatgttcctggcggtgatccgcgcgcgcggcgtggcggcgccgctcaacccggcctacacgtctagagatggcaacggggaattccccgaggagttcgagttctacctctccgactcggaggcgcgcctcctcgtcaccaacgcggagggcaatgcggcggcgcaggcgaccgctgccaagctcgggctcgcccacgccgccgccagcctccacgacgcggccggtcctgtccacctcgccggcctcccggtcccggctctggagaacgggtctcatggcggcggcgcggcgggctctctctcccccaacgacccgtcggacgtggccctgttcctgcacacctccggcacgacgagccggcccaagggcgtgccgctgaagcagcgcaacctggcggcgtcggtgcagaacatccggtccgtgtatcgcctcgccgagacggacgccacggttgtggtgctgccgctgttccacgtgcacgggctcctctgcgccctgctgagctcgctggcttcgggcgcgtccgtggtgctgccggcggcggggcggttctcggcgtccacgttctgggccgacatgcgggcgtcgggcgccacgtggtacacggcggtgccgacgatccaccagatcatcctggaccggcacgcgtcgcggccggaggcgtatccggcgctccggttcatccgcagctgcagcgcgtcgctggcgccggcgatcctggagcggctggaggcggcgttcggcgcgtcggtgctggaggcgtacgcgatgacggaggcgtcgcacctgatgacgtcaaacccgctgccggaggacgggccacggaagcccgggtcggtggggcgcgcggtggggcaggagctggcggtgctggacgaggaggggcggctcgtggcggcggggagccccggggaggtgtgcgtccgcggggacaacgtgacggcgggttacaagggaaacccggaggcgaacgaggcggcgttccggttcgggtggttccacacgggggacatcggcgtggtggacgaccaagggtacgtccggctggtggggcgcatcaaggtcaaggagctcatcaaccgcggtggggagaagatctccccgatcgaggtggacgccgtgctgctgggcctccccggcgtggcgcaggcggtgtcgttcggggtgcctgacgacaagtacggagaggagatcaactgcgcgttgatcccgcgggacgggtcggcgctgcgggaggaggaggtgctggcgcactgtcggcggaacctggcgtccttcaaggtgcccaagaaggtgttcatcacggacgacctgcccaagacagccaccggaaagatccagcgccgcatcgtggcgcagcacttcgtgcagccgaccagtgcctgatcgttgatcctagtgcttggctgcttgccaagtcatgggtcgacggattggggttttgctacactagctagcattttgccgttgttcccgcattgcgaagtggacatggcctgaatgggcctccctgaataaacaacacatgcatcgtgtctctctctcgtctcgtcgtcccgtac

SEQ ID NO: 67 - DNA, 755 bp, Zea mays
ttccagcgtcttgtctcgctgtaccggccgatctccccattctcccctcttcgccggtcccaccaccgcgccgatcctgatggcctccgccgcctcatcggccgtcggcgctggcaaatcgctgttccaggggctccgcaggttcctcaagaagccgtgggagatcacaggcccctgcgcctctcccgagtaccgcagcgcgctgcctggcgcgctcgagtaccgcgtcaagtgcccggccaccgtgcgcgacgaccgcgacaaggccatcgtgcccacatccgatccggagacagtctacgatatcaagtacttcacccgcgaccgccgccggagccgcccgcccgtgcggcgcaccctactccgcaagcccgatctcgagagctacatggccaccaagcagttcgaccccaccaatgacttccccgtaccatacgtcaacaccaccgtcgaggaggatgacaacactgtcggcggtggctaccagaagtgactcaggaaagcttgctggttaatttggtaggtatcctttgattggacttcatcagaagcggcactattttcattccagctattaaatatccccttttcttttgttcctagtggaagttttttggatgtaaaagatgacggtgtcaaataatatggcacctgtggagctcacaggatgcacatatcttgtaaattgtattctaaaactgtctacctgataccattgttactgtttaatgcaaaatttaaggtttctattccaa

SEQ ID NO: 68 - DNA, 1881 bp, Zea mays
gcactgtactagccggcgaggaccacgtgtacccgccaccgcgccgcgcggctccaccgttcggcggcgctcgggcacggcacgtcgcacggcacgccgtaaaaccctagctcttgcgccccctcctctccaccgcgccggcgagccgtggagacgcggagctaaggatgccgcggaccaccgtgctggagagccccggctgcccgccgctccgcgccctcaccaccgacatcctcggccttgtcaaagtcgtcgaggcccacgcgaggccggcgggtgccgccaaggtcgtggagacgtggggcgcacccgacgcctcctgcgccatcgtcgctgcctccctcgccgatcgtgccaccgaccccgttttggctgtggcgaggaagaacggcgtggttgagttgctgaatcccctgaacggagatactttggctgctgtcaaggcagtgggaccagcaccaaatgatggtggcgctgaaggtgatcccctcactgcattgcaccttttcacaagacaggcttcggactcgatcttaggaacgtttcttgcttgcactgagcaggggaaagcttctataaggtccatcacgaaagaaaatgcagcttcaggctcacatattgagccatctgctacatgggatgtgtgcggtggggccaatgtgcaattttgctcagttgatcatggtgaaaactatgtgatgtttggagggaaaggtatagaagtgagtttgtgggatattacatcttgtagtaagacatggtctgctaaatctccccgaacaaatagtcttggtatattcactcggccttggttcactgctgggaccttcttgtgcaaggatgatcatcgtaaaattgtagcctgcacaaatagtcatcaggtccgcttatatgatactgcattgcaaagaaggcctgccatctctgttgagtttaaggagtcaccaatcaaggcagttgctgctgatccgaatgggcatgatgtctatattggcacagggacaggggaccttgcttcctttgacatgagaactgggaaattgcttggatgctattttggcaaatgcagtggaagtattagatccattgttaggcatccagatctacctttgatagcatcttgcggactggatagctacttgcgtatttgggacacaaacacaagacagttgctatctgctgtctttctgaagcaacatcttacaactgtggtccttgattcacatttttctgttgaagagcctggagagatgaaatccaagcaactggagtcttcagtggagactgagactgaagtccgaaaagaaaagaagaaaaagagtaaggcaattacagaggatgagactgaggcacaaatccgaaaagaaaagaagaaaaagaagagtagaacaattgaagaggaagaacaagctggattggtcgaccatagcgatattaatgatgaagtatatgccagaaaagaaaagaagaaaaagaagagtagaggtattgaagggggcaaggagcgagaaagaaaccgggaaacgagaagtaacaagacaacaaaatccggagaaacaagcaaaccccagaagaagaggagcaagaaacagctggttgcctagtacaagtatcatttctcattacccgccttcttgattttgcagaattacacaattttgtgtggtagtttgttcggaattgtatcccttttgaaaccctgcaagggaagtgcatcattttcgtgtgcgcatttttctactctggtgtagctaaattttgagacatacacgctggagtagttacagccaaaacttgaaactaatttttgagatagacatgtgggactaaatttcgagatatacgcgtaggagtttctactataaaagtagaaagtttttt

SEQ ID NO: 69 - DNA, 719 bp, Zea mays
gtatgaagaaggattaaagctgaggccgaatggttcgctaggtttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatggtctcagttgaagagtcttcagaagctgcaaagggcaagtcccaagtgaagttcagtgtgaagaaaaactcaagaatacagataaagagattaaagggcaaaggcaggaagaaagccaaaaatgcaaaaccacctgccaaggagaaagttgatgccatggtagaatgacagttgatgccatggtagcatgacggacaagactacatacatccatccctttgtatgttttctcagagtttgcagcatggaccgacctcaccgaacactggcgcgtgtctcttgcatcttctgcctgaatgttaaatagaagctacttaggcctggtgttaatgtacttcaaacatgaatctacctttaatagtggactatgcgaatttgttcatgttcttattgcgttt

SEQ ID NO: 70 - DNA, 1638 bp, Zea mays
attccttcctcctcatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagggagaggagagcggcctgtcggcggcgtccccgctgttctgcggctcgccgccgcggcgggcgtcgaacccggtggtccacgacagccggttcggcgtggactgcccgcccctgcccgtgcccatgccggtggcggcggcggccgtgcaccggccgtcggcggcgccgcccatgtcgccgcgcggcggcaacgggtgcgcccgcgcccggttcgcgttccagcccgccgcggtccgcgtcgagggttttgactgcctcgaccgcggccgcggcggccgtggccacggcatcaccgccatggcctagatgcacatacaaacgaacaccaagtaacccactcgcatccccctcttctttcgccccctcctccatccatggtgcgaagaaagtgtaaccatccaagcactttgtcggaggagagagggagagagaggatcaatcaattcgtcctaaatttaaccctcctaaaaaccacttatattactacttttatttatataaatccgtccccatcccaaccatccaccagcccgcccgccccgcctgatccgtcccagcgattgctatgagtttaggtgattttaccacagatcttcctcttttttttgtatgtaaataaagtttgaggtccaggctcgtcatgtaaattcgggagcgagtgaaatcgggtacgtaggaattaggagcagagggacaagagggcctggctgcttggcaacagcaacaacagaaaaaatgggggaaagaagagggaagggccttcttgatcaagaatcaagatctcgtctcctgtctgtctcctctctcggggagggagggagggaggattggttagtcgttggattaggttggggagtgggaggtcgtgggagtagttaggtaatctgtcctagttcatcaatcaacgaggttttctttttctctttttgggttttcgatggaattgtttttgtccgtccgtccatgcaaccaagaaagaaaagaaatttccaaggcccatggagaatctgtacaaaagagtggctacgtgcaagagggcaccgttgagtctgtgagcagaagcaagcagcagcagcagctaggttgttcagtcaggcagtggatgagctgtgtgtgagagagagacatttattttgtggcgttttccctttttcccccttttctcatgttgtaatatcctgctgtgattgaaatgaaatcaagctgtata

SEQ ID NO: 71 - DNA, 6400 bp, Zea mays
ggtgctgttttggtgcatgaagaaagtaatgcaccggaacaacccaaccaggaagcttcaaatgttgttgctagtgaggtcttgggagaggttggagctgccaccccttttctaaaatctgagattcaaacaagtcagcgttgcattcttactgagacgcgctcactaaataaggcagtggaaagcatccccatgttggaaactggagagcaagctactggtggttcaaaccagaaacctctactagaattgccaaatagcgcttgctctactgctcatcatgaagaggccagcaagtcggtggaagatggtaattctattgggattcaaggtgcatgcacttcaaggaatactgaagctatccaatgtgatgaaacatggtatgatgacaacatttgtgttgtttgcagaagtagggaaatctcagatatcctgaagtcttgtggtggaaaaggatgtaaacgacattaccatctttcgtgtatggatccttccttggacgtgtccctaggaatatggctttgcataatgtgtatgaaaaagaggattcagtttggtgtatattcagtcagcgagggaattgaatctttatgggatgtcaaggaaggagtggtgaacagcaagcaatatttcgttaagtataaaaatcttgctcatgtacataaccagtgggtttcagaaagtgatatagttgatagcaccccgcaaggttctgatcttatctccaaagttagcaagaagattcataaagaaaagacaataaggtggaagcaggaatgggctgaaccacaccgtctgttgaagagaagattgcttatgcctcaaaaagaagccgaagttttttttaattcactaggtgataaatttgtatactgtaatgtcgagtggctagtgaaatggaaggatctgggctatgaacatgctacatgggaactcgagtcctcatcctttttatgtactcctgaggccgaggagcttaaaaggagctatgaggaccgctttaaaactgcaagaaaagcatctgatccttcaaaagtagacaaggctaagggggggatatttcagcaactcgagagactgccagatggttgccctcctggtttagacgatgaccatttgagatcacttaaccagcttcgtgagttctggcacaattcttgtggtgctattttcatcgatgatcaggagcgagtaattaagaccattctttttgtggcatccatactgcctcacatctgtcaaccactcctcattgtgtctactactactactctctccttgtgggagactaaattcaatcgcttggcagcatccatcaatgttgttgtgtacaatggagagaaagatgtacgcaaatcaatacaagatctggagttttatcaggatggttctgtgatgttgcaagttctcttgtcccaccctgatgccatcttagaggacatcgaagtgattgaacgaattaactgggaagcagttatagtcgatgattgccaaaactctagagtttcaaaatggcttgaacaacttaggagacttcctaccaattttaggatggttctattgagttcctcactaaaggaaagtattgctgagcacatcagtctgctgtcttttctcaaccctgaagaaaatggtacattgagtgtttcaaatggtgtttcttttgatacagctggcactctagttgttctgaaagaaaaacttgcacgttatgttgcctttgagcggaagacagattcatcaaagcttttagagtattgggttcctgcccgcctttcaccagtgcaactagagatgtactgttacatattactatcaaactccccagcccttagatcacattctaaaacagatagtgttggtgctcttcgcaacattcttatatctcttcggaagtgttgtgatcacccttatcttgttgatcaatcgctgcaaagcacacttaccaaggatcaccctgtaactgatatccttgatattggagtgcgttcatgtggcaagttgctgcttcttgacagaatgctccaacagatcaggattcaaggtcttagagttcttattctttcgcagtctggtggtgaatctggcaagcctatgggtgacattttggatgactttgttcgtcagagatttggttatgagtcatatgaacgtgttgaacgtggattgctactgcaaaagaaacagacagcaatgaatatgttcaatgacaaaactaaggggcgatttatttttttaattgatagtcgtgcatgtggtccaagcatcaaactatcatctgttgatgccatcatcatatattgtagtgactggaatcccatgaatgacttgagagcccttcagagggtcagcatggagtcacagtctgaacctgtgcctatttttcgtttgtactcgtcttttacagtggaggaaaaagctcttattcttgcaaagcatgaccatattttggatagtaatattgtgaatataacccctagcctgagccattgtctgctcagttggggcgcatcatttctcttcaatagacttgaggagttgcagcaacatagctactcaaatgtctctggtgatgagcttttcatggataatgtagatttggagtttttgacaaaattactcagcaaggttgaactcagaactgaatcaggcaatacagccatatcacaagcttatctgtgtggatctttctattctagggctattgttgtagcgggtgagagggagggaattccatcagttgatggtgacctgccaaagttctgggcctactggttaagtttacttaatgggaggtctcctcagtggcagtatatatctgagccagtacaaagaagccgtagaaagataaataacatggaacaacaattgaaaaacacagacaaacagttgaaaataactactgaagaaactgatgaagccagagtaaagcgtagaagaattggtgaaatcatggattcatctgcaatagactcacctggcaaaaacaaggacaccatattgccaggaaacaataccccacctagttctcatcaaatatcagttgaagatacatggcaggaactagagcgaagcaatcttcatgccacacaaaaaggtctacacgttcaactcaagccagagatttcgaagttatataagttgctgcaactgccggagaaggtgaaatccttatgtgaggaatttcttgagtatattttgaagaatcaccaaatcagccaggagcctaagggcatactgcatgcattcaatttggctctgtgttggcgtgctgcttctctctcaaagcataagatcaatcacacagaatcactcgcacttgctgtaaaaaacttaaactatgagtgcaaagaagaacttgttgattttgtttatgggaagctaaagatccttaagaagaagtttgcacgtagagcaggggaagtgagcaagcaaaactatatggtttcagtgagcgacatatcaacttgtgaacaggtcacttctgttagattgagaaatgatgagttagtccctagccaggtaactttaactgatggtaactttgagaatggttcacatcacgaggctacaggtgacttttggaccgaggagatggtttcgggagagaaagaactgctacctgacccagtaactcatgaaggggaacacttattgagggatgaacttctcagcaaaataatggacaaaagaattaaattagttgacaaagttttctctctgagaggaaggagtatctatgataagcattcaaatcaggtttcatttttagacatgcataggcaaaaggtagtggataaactcagaagagcatgcagtttagttgtggagcatctacgtagtagtcaaaatcacattgctcaagaggacagagatgggaaaataaagctaataattgaatggtttactatgctgctgtatgcttttctggaacacatgaaatgccaacgtaacaggcttgatatgcagcaatcagcttccaggatcaaggagtctcaattgaaggaagaaacccttcaggcagcaagatgtggccaattagatcaaaattttgatcaacatattccttcaccagattttgaatttgctatggaagaatttaggcacttcagggaagtagttggtagctgctatgttgatccagctgctctggtaccagagtctttggatgacaattcagcaatggaaattatgttggttcaaagcgcaactgatgctgaagtcatcgaagaagtgctaaatcgacctactgaagttcttgttcaaggtccagcatcagaagttgttggtccatcagttgatgtgatttgcaattgttctgatggcatcaactcccaaagagatgcatctctggctgttcattcattggaaccttcaagtgacgaccttagaagtactgaccatgttgaggagaacacagttggctcacaaatacagggtggtacaagcaaacatttaggtgatgctgcaatggaagttgaaactggaaacaggaacactgctttggctgattcacctcactttgacaaaccagctttgactgctccatccaggcaggcaacattgctggtttctcgagaaaccgagatgctgagcaatcttgtggaccaatgtgcacaacagagtttagtgtcagcacaacctttgcaggatgagtcggaacaagcagatttgtctagtgcagcatcaactcaacccttgcaatctgagaggcaacaattaatctctgtttccaataatctgcttgaaagagcacagcttgatcagagtcaaccaaattatcagacagatgcggcacctggttgtgcgcagtctacagaactctttccagtgacgtcaatgatgtttaatcacgcacctattgattctgaaccactgaaaaatgagttgcacaaattacgattacacatggacacactcaataaagtccatgaaatgaagaaaacccaacttcagaccgcatgtagccaagaactagagaaggtaaagagaaaatatgatttgttaattaaagaacatgattccactcatcttcagcaaaagaaggcacttggtgatttttatgagaaagttcagcgcaaccaatcgctggctgaggattttcgggccaaattcatatcactgtctgcagcacaaggtgcagcaaaaggccatacccctccagttcgtcacacacctcaggctacccaagtggtgtcctccacatcatcaattgccctgtcatcagcttgtcgaccaccagtgccgaggcctagggttcaagctccacaggtggaccaaccattattgtcattgtcgcagttctcccgtccgtctttgcaagtggtccaacctcccaacctggaactaggcaatcttttcagagcaacgtcaacgactcttagtcatatgccacctcaacgtgggagctatggagttcagagtgaattggctcctcgctcacctgctcctcatcttcagttcagatcgccacgggcacattccatggcacctggaaatcagcagcaatcgccagcaattagtgtggatgcaatgtcctcaaggacacaaccagtgctggcggcaagcacatccccatcagatatacatgtgggacccctagcagcctcagccttgtcaagtttacactctgttctcccttcaacctcattaccctcaagcttgcatcctagtcacctggcacaacgtgtgccaccaactcctaacccaactttacaagccggggcaccgaaaggctcgaatgcaacaatgccttccatccctacaggcatgcagctgccagattctggttccctatcgctggatgcatggcttacagctaatcttgggttgaatgatgcgtctacagctcctgctaaggatacagccagtcttgggttgagcagtgatgcccctagggcagctcctgatacaaatacggccagtcttgggttgagcagtgatgtgcctaggggtacggctcctgctacaaatacagccagtcttgggttgagcagtgatgtgcctaggggaacgactcctgctacaactacaaccagtcttgggttgatcagtgattcacctagggtgattgctcctgccagcagtaattcgcctggggcgattgcttctgctacaaatggtggttccgagatagatgtggtatgcctgtcagatgatgaatgatgctagcacgtgtacaaggctgacagttatagatgactgcttgaaaggactaggcattattttacggctcccttgagtccgttctgacaaggtgggaatgttgtttgtgctgtgaatggctggtaacagcaatgacagttttattaagttcattgtaaatgtgtattatgacaaatgcctgccaacgtttgctgtaaatcgctaacctctggggaatgtggatattaacctctga

SEQ ID NO: 72 - DNA, 938 bp, Zea mays
agtagtagcagagcctcgccgccgctgccgagaatagatggggttcgtgtccttcgtcgggcgggtgctcttcgtcgccgctttcctcctctccgcctaccaggagtttaatgaatttggcgctgatggtgggccagcagctaaggcccttcagcccaagttcaatgtgtttgtaaaaaatatctctgcacatctgggagtagctgtgccgcacattgagttgaagcatgtgattgctgctacaattgctcttaagggacttggaagtctcctttttattttgagcagctccctcggtgcttatctcctgctgctgtacctcgctctgatcactcctatcgttcacgacttctacaactacgacacggagaaggaagaattcgcgcggctgtttgcgaagttcacccaggacgtggcgctggttggagctctcctcgtcttcctgggcatgaagaactccatcccgaagcggcagggcaagaagaaggctcacaaggcgaagacgaactagtaggaggctgctcgctctttctttagatggttgcgcgccggcctcaggcgggtgtcaggagacgaataggcccactagtgcgaagcagtcgtcgatgcgcatcgagctgtcggctgcgcttttacatgtatcggatattcagattccattttgcggggcgcggcccgaacgaaggtgtgactagtgagcggcccgaacgaaggtgtgactagtgagcggcggtcatgtatgtgattgcgattggttggttggtttcttgaactgggctggcagtggttaatcttttcgatttgattatcttttgcactgggccgcaactgattcgatcaggaaaagtcatcactgtccgaaaaacttacttgtagaggtagggcatgtttggttggatgcccaaaaattgctacacattttctgccatgtttgccca

SEQ ID NO: 73 - DNA, 901 bp, Zea mays
tcttccttttacttttttctgatatttctatcggctacgatctcatgcgttagcgagtgccgccccgcccgcgctatccactcgtctctccgtccccatggccacttatctcaacgcaccgccggcagccaccacgacgactgcaagctgccgccatgccttctccggtggcagcctccgtctactccggccgagccgaccgacgctgcacgtgacgtgccaagccgccgcctcctcccagcagccgtcgtccccgtccaggaggtcagcctgcctcctcggcatcgcgtgcgccgtcctgctccgcccacgtgccgcctccgccgccgaaaccgacgacgagccggccaacaacggctggtggctgaccgagttccccttgcccgtgcccaagatcgtcaacaaggagatcaacaacgcggagacgggcacgcgctccttcctcaagaacggcatctacatggcggacatcgggcccagcttcgcggcgcacgcgtaccggctgcgcagcacggccttcgacctgctggcgctggaggacctgctgggcaaggacgcctccaactacgtcaacaagtacctccgcctcaagtccaccttcatgtactacgacttcgacaagctcatctccgccgccgaagacaagccgcccttcgtcgacctcgccaaccgcctcttcgacagcttcgagacgctccaggaggccgtcacagccaaggacgacgccaggatcggcgaccgctacgccgagacaaagctcatcctccaggagctcatggccaagatggcctagcagaaccacaatttttcattcatatatcatgatgtgtaaatgaatacttgaaactcacaaggggtattgcagaattcccagagcagggaaatacaattatcatgtcag

SEQ ID NO: 74 - DNA, 1596 bp, Zea mays
cttctttcttccaaagccttcgcctttttcctctcgtcttcctctctctcccccgctccaaatcccaccctctctctttctctctccacattctccctgctgtgcaccttgcagcagccttgggctgtggatcggaaatggcaatcgacgatgaatcgccgctcagagtcaacaccagaggcggcgccatgggaggaggggagcgtgacggcgcggagaaccagcggtggccgccgtggctgaagccgctgctggggacgagcttcttcggccaatgcaagctgcacgcggacgcgcacaagagcgagtgcaacatgtactgcctcgactgcatgaacggcgcgctctgctcccagtgcctcgcctaccaccgcgaccaccacgccatccagatacggaggtcctcctaccacgacgtgatccgggtgtcggagatccagaaggtgctggacatcagcggcgtgcagacctacatcatcaacagcgcgcgcgtggtgttcctgaacgagcggccgcagccgaggcccggcaagggcgtcaccaacacctgcgaggtctgcgagcgcagcctcctcgacaccttccgcttctgctccctcggctgcaagatcgtcaggacctccggcgacttccgcatccggaagaagcacgccatcgtcgcaaagaagaagagggagaagaagcatgcgccgcagcagaagcagcacaggggcgcggcggactcggcggacgacgacgacgacgactcgtccaccagcaccagcggcggcagcgacaagagcagcgtggtgcagagcttcaccccgtcgaccccgccggcgacgaccgccaacagcttccgcgccgggaagcggcgcaagggcgtgccgcaccggtcgccgttcggcagcctcgtggtggagttctagacaaaaaaaaaggcgcgccgcccggtcgcgatggacgctcaccaaaaaaaaaacacacacacacagcggtacaccactgtagcatacgcacttcttctacataccattaccatctataggtgctgccggatcgaccgggctacatacataagtacatagccagcccaaaaataggagcaagcaataaccagggccccatttgcacgccgcccgcgcttctggacggacgaggacgagggggccggtgcaatgcggctcgtgcggggtacggttacttccacttccatatagcagttactgtgctgggtaacaatggtttgggtttggtgcctcactgctagcagttactcttgtcgtcgtcagcctcagctactactaagttttgcgagttttacctataggtgtttgctagttttttttaccagttgcttggtataccgtatacgcgagtagaatgtacatgtacgtatactgtcagagatgggggaatggtggtagggggtgtagctcctggtgtagtggtgttcatattcgtgtgttgccttgctggcctgtaataataataaaaataaaaaagggataaggatgctgctcctggatggtcttcgatgtgaagggttgtgcttgcttgcttgattttggtggtgctttctctctctctctctctctctctctctctctctctctc

SEQ ID NO: 75 - DNA, 1798 bp, Zea mays
aattgtaaactgtgatcttccaggctgcaccaactccatctccaggtggaatggagttagcttgcctgcacactcagtcacggtggcgtccctataaggcgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatggtgtcccgcaggggcgccgtgcggctggtgctcgtgtcggccaccgcctgggccatgctcgggctcgtcgcgctcgccttccacctccggccatgcagctcccgcgtcgcattcctctcagctctttgcaaaaaagacagtaaagttctctctgtgttggactcgatggggctctcatccaaaccactccaccgctgcccgatacctgttgcggatgatccaaatgttgttgtcataccaaagaggactcccaacacaattgtgaagaagttggcatatataactgttgacaaacaggataaagatccctcaccgctgtttggaggacgtcaaaactggaaacagagggaggagagctttaaactgaactctaccatgaaggttcactgcggatttatgaaaaatagtggtgcagatatggatatcattgatgtcaagtacatacagaaatgcaaattcgtggttgcctctggtattttcgatggttacgacatccctcaccagccatccaatatcagccgccggtctcagaagctgttctgcttcctgatggtggtggacgaagtatctcttgattttatccaaaagaacaccaccgtcaagatcgacagcgctggagggaaatgggttggcatatggcgacttctaacagtgcaccgcctcccattcgacgaacctagaaggaacgggaaaatacccaagatcttgacgcacagactattccctcaagcttggtatagcatttggattgacgggaaaatggagctcatagttgatccgctgcttattctcgagaggtacctctggcgtggaaaatacacattcgcggtggctgtccacaagcatcataggagcatctacgaggagggcgacgcgatcaagcgacggaagcgctacgcccgccctttggttgatcttcagatgaagatgtactattacgaggggatggagccttggagcccgaagaaaaagatgcctggcgatgtgccggagggagccgtgctgatccgggaacacacagcgacgaccaacctgttcagctgcctctggttcaacgaggtgaacctcttcaccccacgcgaccagatcagcttcggctacgtggcgcgcaggctcggcgacgctctcgagctcttcatgttccccaactgcgagtacaactcgctgttcgtcctgcacaggcacacgagggagcactcgtctaaggtggagtgggccaaaacggtcgacgagatcgtggagaaggggctgagggagagtagaggagggttggggctgtggactccgtaccctgcggacctcagctccgtggaactccctgctgtaagaagaacttcgccggcaggataaggctaggctgtcaaagaccacaaagctcccagcctagcctgccgatcctgtgatctttgattcgttcatggttgtacagagtagaactccactgtttgtttgttttttttggcgtagattctgtaggctgacgcttggagtttgttgcttccagttctgtacaacactcatctacggaggtagcacagaaggatttctcacaaaagaaaaa

SEQ ID NO: 76 - DNA, 1149 bp, Zea mays
agcctcaacttcgtgagaaaagaggggaacaaacggctcactagagctggacccggtgcacgcagtaacttgaatccctcagttccagcgcgtggtccgccaggtccactgtccgtctttcctctggcgctcacgatccttttccctgcgtacgccgagctcacgcaggacaggagggagcggatgagatagacaaacagaaagagcccgtgtgcgtgacgcacggacgccgtgactccgccgcaaagagagggagagtccacgctctgaagaagcaacggcgacgcccccgacgacgagcacagctgcccagcaaactagcagcgccctcgtcagttccgtctcgttcccaacctctcccggattcgattcgattgacccgtccgctccaaatcgaatctaatcagcagttttggagttgcggaagggagaaagagagaggagagggggcatggatcaggtgctcaacaaggtggggagctactggttcagcaaaagggccagcaaggaaatcgactccatcggcgacgacatcagctcgatctcaagcagcattggagggtcagccaaatggatggtgaacaaaattaaagggaagatgcagaaagcacttccagatctcctcaaggaatatgacatgccagcagggctcttcccacgggacacgactaactatgagttcaatgaagagacaaagaagctgacagtgtacatcccgtcagcctgtgatgttggttacaaggactcgtcagtgctgcggttcttcacctgtgtgaccggctaccttgaaaaggggaagttttccgacatcgagggcatgaagaccaaagtgctggtctggaccaaggtgactgccatcaagaccgagggcccaaaggtccatttcactgcaggcgtgaagaagactcggagccgtgatgcctatgaggtcgtcagagatggtatcaccatagacaagttctagagcatatacctggcatgaaaaatgtgacgcggttattcatatatgcttctctcctctcagttggtacaccgaaattcatacaatatcgtgggctaattctgcatttgtatgaaagtttaatatgcttgacgtgttaatcacactgctagagcatgcgataaatcgcagttggttcattattagga

SEQ ID NO: 77 - DNA, 1520 bp, Zea mays
cgcgccgtcatcaccatcacccaccatcagccgccaaagatcacgaaagcgacgcgcacaccccaagaaagggcggctccccactccgcctcgccgcacccctttcggcctttcttcctcccccacctcttgctcgcgtcccagctcccaacaccagtacaccacgcgccggctgcgagcgatgcccgcgatcccaacggcccccgccccctgccccgtgcgcttcctcctcgcccgccgccacagcctccacatctcctacccgtcgccttgctctaaccaccagcggctcccgccccgcctcctgcgcctgcccgctcgcccccgggccgctcccatgtcggccgaggcgcgggcacccgcgtctccggtggcgccgccggcgcaccccacttacgacctcagggccgtcatcgcgctcgccctcgcagaggacgccggcgaccgaggggatgtatcctgtttagccaccataccttctgatgtcgaagccgaagccacatttattgctaaagcagatggtgtcattgctggaataagcctagcagatatgatatttaaccaggttgatccatctttgaaggtcgaatggtttgaaagtgatggcaattttgtccacaaaggactgcagtttggaagagtatatgggtgtgcccgcagcatcatcgttgctgaaagggttgtgctaaatttcatgcagcggatgagtggcattgcgaccctaacaaaggctatgtctgatgctgcccgtccagcatgcatattggaaacaaggaaaactgctccaggtttacgtctgattgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggtcgagacaaggacaatcgaagaagtgaaagatttgttgaagtacgctgctgagaacaaaacttcattgacccgtataatgttggacaatatggttgttcctcttggaaatggagatttagacgtttcaatgcttaaagatgcagttcggttgataaacggtagatttgagactgaggcgtctggaaatgtgacagttgatacagtgaagaaaatcggagaaacgggagtcacctatatttcaagtggagcattaacgcactctgtgacggcgcttgacatctctctcaagatagacaccgagctggctcttcaggttggaagacgcacaaatcgtgcttgactcccacagcattacgttgtggacgcaacgcacgcaagcaggatgacagagggaccagcgtggcaaaccagcttaaatagcttaataataacttggcgctgaggcctctgactgcaactacgtgggattcattcttcagtttcatgcacaaacgaccgcaatattgatcggatcagaataattggcaggacatacaggttttgttctagca

SEQ ID NO: 78 - DNA, 2053 bp, Zea mays
actcgaaagcggctcgccgtgtgccgtccccggcggcccactccaaagccccccaatcttgtcgctttttgcgcgccgtcgcccatctatcgtgtccgccatcccaatcgcctccggcaaaaaccctccgtttccgccgcgtccccctcgctgtcccggctcaccggacaccggtcgagtgttggtgctcgctctcgcggctcccctctttcctgagcctggaagggccgatgcaggccgcgcccgggagcgtctcttgggccgcctcgcagccgtccgtcctcggccggtgcggcggcggtgcaccgtccgcttcactcaagtggagagctggcggcgtcggaggaggggaatgcagggtccggggccgggacgtcgtcgtgccgcgctcctgcgcgcgcgcgcaggagaagcgcctgccgcgggtgcggaaatccaaggaggagaggagggagatggtggagtccttcatcaaaagctaccgagtttcaaatgaaggaaaattcccatcaattaatctgacacataaggaagttggaggatcatattatatagttcgtgaaatcatgagggatatcatccaagagaatagagtccttggtcctggtggattggatgctatgacacttagttttgaagattgcgctgattcttcaaagtcatccatgaagcttgaactgggtcaagacagtatagagatcttagatatgtctggtagtgaagtcagtaagagtcatgtacctgaaatatccagcactgatgaatcgtttccattgcaaggtaatgccatcagcaatcatagactgctgggttcatctaatatcttagaggttggtgttctgaatagtgtggtccaaaatggaagtgtggcagatgcaatattcatggaaacaaaccttgcgaaacaagatgaagttccatctagagggtccattgagtttgacttgaatacttctgaagagcaagctcgcttatttgctcaggtctctgattcagatgaagaagtaacactaaacaatcaggcggatgcacaggacgggacgaccaatagtggcactgatagagttattcttcccttagaatctttcgctgtttatgaaaacaatgcttcacttctaagagatcatgagacattgcctgatgataatcatgatggatcaactgatagggttgcggatgacgcaagtctccttgcggcgaccaatggtgttcaagcaaagcaagcttctttacatgagcatgatgcatcaactagaagtgtattgattgacaatgctcagagcttagatggtcagtttagtactactgtgtctactgatcctataaatggttttaaattggagactgaaattgcaaccaagacagttgaaacatctcaagtacacaggctgcaagatgagtttgagcaaccattagttgatgctagctatgatgggcaagaaaactctgatagcccagtttctcatccagcattagatacaaaggggctgttgcacacagaagatcagctcaatgtggtacaggtagatgaaactgaattcaagaactcaacatctgggatcacaaaggaagaggtccatgcagccgatttcaggcatgaacaaggaattaacaccacaatggcgatcagcaggagaactttaaaagctcagcagaagaaagatgacaacctattctggcttgtccttagggcatttgttgttgctatatcgaaaatttgggcaaaatgaacagtgcagaaaggcaccttacgtggaactgaagatcgagtgtgatacctttcctactggaaaacgagaaaccggtccatgaagttccatttatcccatgcgaatatagatatgctctgcagtttaggttattttttggagacagttggtctactttgtagtcgcttcccactgtagatgtaacattcagtcatcttgttctggtgtcatctgtgaaatatctgctacaatggatgtcatgtgtcttttggtaaaaggaggaggatctctttcacagcgtgtttggtttgaggaatgatatagtctatcatcttttcactttt

SEQ ID NO: 79 - DNA, 577 bp, Zea mays
aataatatgtgtgttgactgtggtgcttcagaacctgattgggtatcattaaaccttggcgcacttctatgcatagagtgttctggggtgcacagaaatcttggagtgcatatatcaaaggttagatctctgacacttgatgttagagtttgggagccatctgtaatcaatctctttcagtcattaggcaacatgtttgtcaacagtatttgggaagagacgctgccagatgataattcaagtgctgatggatcagacacatcacagtacctctctgttagcaaacctaatctctttatgagaattttggtttattttgtttgattccggctctcatcaagtgactcctccccctcacgctgactttgcggacagatgtctcaattctagtggtggagctacgaacaacaatctgatgtcctgatcgagagcgatggagctaatgtttgaacttgtgaactaaaaatatgaactatggatgtgaacttatgtatttggaattatgtgaatttgtgaacttatgtatttggacttgtgtgaatttgtgatatgaacatatatccatgtgtttgaaatc

SEQ ID NO: 80 - DNA, 3901 bp, Zea mays
ggcgatccctcctcagctccaacccccagctgtttttaattcgaaaattttcgaaccaagccctcatctctctcgtcttccacctcctgccttccccaccccaccgcacagcgccctgtccggccccagccagagaccagactagacagctccgtttcccctccccgtcctgcatccatctcgaccgcgcaccaaacccgaaaacgcagccacattccctcctgcagccaccccccccccctccgctctcgcgcccctccgctgcgcgtcactccgagcggcggcggcggcggcggcgcccgcccccacagggcagtggcggcggcgaacgagggagggtttgttccccggaagagggagggaggctctggcgggagtgtgttacgggcttacggccgcctcgtgctggtgacaggcgcggcgcgagatccgggctggaagggctggcgggtcccgttggtggcgccgtggcgtcggcgtgatctgagatgagattggacccggctgcgcggtattcgctgcggaggtagacggccatgacgaccaacaccaagcgcgcctacaagctccaggagtttgtggcgcactcgtccaatgttaactgcctcaagattgggaggaagacctcgcgggttcttgtcacaggaggagaggaccataaggtcaatctttgggctattgggaagcccaattcaatactgagcttatcaggtcacacaagtgctgtggagtcggttggttttgattccacggaagtgtttgtggctgcaggagcagccagtggaacaataaagctatgggatttggaggaggcaaagattgtccgcactcttactggacatagatcaaactgcatgtcagttgattttcatccgtttggggaattctttgcctctgggtcactggacactaatctgaagatatgggatataagaaggaagaattgcatccatacatacaaaggtcacacacgaggggtgaacactattagatttacacccgatgggcggtgggttgtgtctggtggcgaagataatatagtaaagctctgggatctgacagctggaaagttattacatgaattcaagtgtcatgagggtcagatccagtgcatagatttccacccccacgagttccttctggcaacaggttcagctgataaaactgtcaaattctgggatttggagacatttgaattgattggatctacaggacctgagacaacaggtgtccgatccatgacattcaatcctgatggaagatctttgttatgtgggctgcacgaaagcttacaggttttctcttgggagccaataagatgccatgatactgtggacgtgggatggtctagacttgccgatttgaatgtccatgagggaaaacttcttggttgttctttcaatcaaagttgtgttggaatatgggttgttgatctgacgcgtcttgagccatatacaatgggtacttcaacaaaagtaaatggtcattctgaattgaagactgtttctagcggcactttgcctttacaaaatgatagtggttcaagggctaacatagggcgatcatcagtcttgcaaaatacagagaacaaccttaaaactacttcaggaagactgtcggcttcacagaactcagattctgcacccaaagaaactaactcggcaccttcaagcgggttgatcccaagcacaccacatagggctggagttggctcccataatagatctgttggaaattcagcttttcaatctggtggtaccaccttgaagagaagttcgttgaggaataacagtgcctctaatgttcacaatttcagtaaagctgatgtagtgcctgtcattgttcccagaactagctcaggaggggagttggctactgattctagaagcgatgctgctgatgtggcacccgttcttccgaaggtaaccagaagggttgaacctgctaccgattctagaaaagaaagtaatgatgtggaacttgttgttcctagagcaagctcaagaatggaaatagccgatttagcacccatttctagttccaagtcaggcagaaggttggagtctgcccctgattcgaaagaagaaagtgctgatacagcacctgttgttgtttccaatcccagggctaatgtaagaatggaaatagtctctgattctgcgcccgctctttcaaagtcaaacagaaagctagattctggcactaactcaaagaaagaaagtgctgatgcagtcattgtacccagaacaaattctagaatggaaatgatttctgattctaggagagaaccctctgctggaagaatatcaccattcagaatccagtcaagatatgctgagccacggaagctagcccatgccagaactgattcaaacaaagttgatagcagaagtaaaattactgaaacagaagacttcaattgccaaatatttcttccccgtagaaacagtgtttttcaaacaataagttctgaagaacctcgtgaagatgtaaagtgtggtccagttgacagggtgggattttcaaattcatcagaaccaaatgcgagtgtccgcaatgagaattatgttcctagaatgcgcaaaccaggagacaactgctatatcgaagtttcaagagcaggaagagcaaggtcaagtgtctctaattgggaagggagggatcagccccctagtcatgaagaaccaacaacaagcagttctacactggctcctaccggccatccatattcatctagaggaagcaatcaagcttctgaagctccaatcatagctagtgatgaagatgttctatctcttatcatggagcgacatgatctatttttaagctcaactaagtctcggctgatgaaattgcagattattcatcaaatgtgggaaagaaatgacatcaggggtgtgctctctgcgatggacaggatgggtgatcatgctgtctgtgctgatatggctagcgttctcatggagaaaagtgaaacaatcacactagatttatgtacctctatcctgcctgtcgtcaccgatcttctggagagcaaaattgacagacacttagtcgtcgcattggaattgttggtgaagcttgtaaggacttttggtccaatgatacattcaacagtatcgtcaggtccttgtgttggtgtagaccttgaggcagagcaaaggagggagcgctgcaacttatgcttcatcgaattggagaaggccaaaaataagcttccatctctaacaagaagaaaaggggcggttgcaaatgctgcacaagaacttgctcttgtcttccaggaaatcatgagttgactgacgacacactagatatacacaattagatgggacatgcttcggcctctgatggcaacaagattggatatcagctgccatggagggtgctagctattcagtcttagcgacgtcatcaagctccaaggccacagcaccaacaaatgcattttgttgctgctgttcgtgccttttgtacacatgctaacacataatccatgtcatttgtgaagagaagctgccatggacagtgacttcatccacaatattatgtggatggcggcagctggagatgttaggccccgatcgaatggtgatcagcagatgagacttgcttgggcttttctggcactcgtagttctttgctgtctgtaacatctttctcatgtatcgttatcatgtgcatgtgcaacagtcaagtggttgcatttggtagtttatggttgtgctgtgtgttggtcgatttagtggtcgttgatgagtgaagcgagccatgtacatcatttttttttaagatttgatatcttctttttccttgatgactcctctcgttatacttgagtgaaaatgatatcttgtgtacttgccttgacagcttttcggaaattcccttttgtctggca

SEQ ID NO: 81 - DNA, 720 bp, Zea mays
ggcacgtgtcgatgcagtccgtgactgcaatagaacatcctggccaacaccggtgagcgaagagaaacgattccatagtcgaagcgtagatcgcagcggagcagaggcatggatggaaagagctttagcaacgaacagcaagcccaacaaaagaacccagacgcagtgacaaacagtgttccgagccaaggccaggagcccttgaacacgtttccagattcagacgatggaaacacgaacaccggtccgttgaatggccatgcagcagctcatgtgaacatggaagctgccatctctacggaggacgtcatacgggctggcgggttcggagcgaaggatgacattggcagcctcctcccgacggcaattgattccaccgattttgaggcctcgctgcgggatgcccgtggtttcgagggcgagaaagcggcgccgtcgcatcctggactagggtggaagggggagaaagctgatggtggaaccaaactggcagatgtggcggagcagtgatcacgctttcctcttctgtagcccagctccagccttcagaaaaccttgttttctgccacgtgtgtctggagagctgccctgcgtatgaactttctttgtcacagtgttttgtgtgacacataacattctgtgtatgaacatgaggatgtcggttctatgctgtctgtcgtatagctctcaattgtgttggatgtctgcggaatgtgtagt

SEQ ID NO: 82 - DNA, 1675 bp, Zea mays
ctttcacaacctgtgtacctgactaaccccgtgacgtcggagggtggaggctttgcctaaaccctcgttgctggccccttaacctcaccctaacccggccatggtgagctcggatccggacgggaacggaggcgcgccggacgtctccgagcttttctgccactacaactccctctacttccgcgattccctcggttcgtgcgctgtctcatggaccgaggacccactacctgattgtgatgtaagcacatgtgactattatccgggaggtggtggctgtataatactgctttccaaatcattatgcgggtctcataatggatctgatctgaagaatgctttgcttcatgagatgattcatgcctatatttgcatcaaagacaataacagtaaccatagtgatcatggtgcaaaatttcagaaactgatgaatacaatcaatttgagttctgtagctgatccccatcgaccagttgatggctacagcataactctgctccatgagatccataagaaatattatcactacaaatgtcaaagctgtgcagattttatcaagtcaaccaatatgagaggaccttctggtgatgactgcattgagagaaaaggtgtagatgacccatgtcataattctaactgtcactggcatagacacaagcagcagtgttcgggtaattattgtagagttcaagaatcatcaccaggaggtccagaactaaaatgtttggaagctgtagaagcattcaatgagggcaaggttgaagaacctgcctgtacaagttggcacaccacacatacatcaaataagagcagaagaagcaataaaaacgagcgggaagatgcctctgtggagttccttcatgttgcacataatgcagttgtctgttcaggactggattcctcttcaaaagacaggtccaataagaaaatcaaaatttcaaaggatgttaactctgaccttggaaggacagaaactgttcaggaagcaccaaaacgcagaagaacagctgtactagataaccaagagtgcagcagacggaagaaaaggaaacaaagcaatcggtgtggttcctattcggtaataattgaatggttgaattactattgtcttagtgagtcggatgaagatgaggtgccgttgatcaataagcgaacagaaagaaggcgccgacaaagattacatgaaatgtatctagccagggaatccaatgatgttgagtttggcagctcaacttctcataaggttggttcttgctcactagctcccaaggacaataacaaaggtgaaagtgtgccagcttctcaacctgaagaaagatcctgctcaagtcatcctgtgagtagcaacggagttgctggaaatcaagctggtcatgaacatatgtcttctccaacggattcaccaattagaggtgaaattgtagacatttcagatggttgagtgcaagagttccgcgttagttccttgtagctggatcctggatgaaataatatacagtgtaatggctataaagaccctgggttttcctatgcaccttccaactgctagacatgcgcacactgccaagcagcctttgtactgttttccccccttcatctagcctttgtatataagcttatttgttcctttctgcattcgccgctttttcctggctgtagattgtttctcccaggt

SEQ ID NO: 83 - DNA, 926 bp, Zea mays
agaaacctcaaaacccaaccaggacagcgtccacagaaagaagagagagcacatagagtggagtggtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctggtgccgtcagaggcgtcatcatccccagatgatggcggcctggatgagattctaagcaagttgaacattgaagtgactccgactttaatcctcactggatttggtgcttttattgctttatggatcctatcttctgttgttgctgcagttgattcagtccccctgctcccaaaattgctggaattaataggaactgcttacacaatttggttcatcgcacggtatctccttttcaaggaaagcagagatgaactgtttgcaaagttcgaagatctcaaacagaggattatttgatctatcgtcgaccttttgccacgtgtttaggctttacagccagcttattattaggttttctccctttcgtttgaaatatttctgaatgggtaaagaaggtcatgtatctaaattgtctcctcatggggtctgttaattgttatcagaccccaagttcggctagtgcgcttcttcaggtcaatatggattttttttttactcaatcctatgtgtatactgtcgagtaaagctttaaaaaggtgaatacggttagtat

SEQ ID NO: 84 - DNA, 3329 bp, Zea mays
gggtgggcaccgattcgaacgctttctctcctccgccgctgatcccctctcgatttgttgtgcctccagcccccgattcctactgttgtggtccagtgatccaatcgacgtcgacgactccgcagccaccgctcctctcctctcgtcgcttctgccgtctctcggcgtcgaatctcatccggccagtgaccacactctactggccgcccggaaggagttcttccaggattcgagccgttgctgccgtcacctctgcaggcccagcgtcgagcggagatccaatcggaaattcaactgacttcgtcttttatcctccgattcgaacgctttatactccgccgttgatcccctctcgatttgttgtgcctccagcccccgattcctcctcattcgtcggcgatcgaacgcagccagccagttctcctcgacttcttccagtcccacccaccgaggttcttctctcctccgcccccgacagctgattgccttcttgctggtgactaaaacctactagctgcttgcttcgttcttcctttttatttctgggtgcgggcgacgagttctcagatcttcgggttcgcgtcgcgagtggtacatacattcctataataagcagtcccaaaaactcaaacttctcgatcaggttcctcttcttcttcggcgcgcccgtctcggtggacgccacaggaattggctcctgacttttttcaacgggtggtttcgctgggcccgatgcccgacgttatggccgcagccctaaccggcttctcgcctcgcggggtgattccgagcagaggcagagcatctcttcccggggtcgctagagcgtatgccgagaggcggttggttgcagaaaacacaagcctgccaaacatgcataaagaacaacttgagactataataaggaatcagctccggaagccccagttgccaccttcttcatacgacacagcgtgggtttctatggtgccagtgcggggctctcatcagactccccgcttcccacagtgtgttgagtggatactgcagaaccagcaggatgatggatcttggggtgtcagccaatctgactcatcggtcagcaaggatgttctcctatccacgttggcatgtgttcttgcgttgaagagatggaatgttggcagagagaacatttggagaggactgcatttcatcgggaggaatttctctgttgctatggacgagcagttcacttctcctataggtttcaacttcacctttcctggtttgcttagcctcggcattgatatgggtttagaatttcctgtaagacaaattgatgtctgtggcattcttcaccgccgggagatggaattgaaaaggctggctgtggatagttcttttggaagaaaagcatatatggcttttatcccagaaggattcggaaatatgctggactgggatcaagttatgaagtttcagaggaagaatggatcattgttcagcactccttccacaactgctgttgcattaatccacaaatacaacgaccaagcccttcaatacctaaatttgcttgtcaatgaatttggcagtgcagtaccagcaatgtatccttcaagggtacattgtcagctttcaatggtggacgcgcttgaaaaaatgggaatttctcagcgctttgtcagtgaaatagaaagcatcctggacatggcatacaattgctggttacagaatgatgaggaactcatgatggacatagcaacatttgcaatggcatttcgccttttgaggatgaatggttacgatgtttcctcagatgagctgtctcacgttgctggagcttccactttccatgattcactacaaggatatttaaatgatacaaaatccctactggaattgtacaagacctcaaaagtcaccttatcagaaaacgatctgatcttagatcgcataggatcctggtctggcaacttattgaaggataagatgtgctgtagtagggtgcaaaaagactcgatttttggagagatcgagtatgctgttaattttcccttgtattccacactggagcgtctagaacacaagagaaacatcgaacattttgatgcttggggttctctgatgctaacaacaaaatcctcatcttttcgtatcaatcaagaattcctagctttggcagtcgaagatttcagtttctctcaacgtgtttaccgggatgaacttcggcatcttgatagttgggtgaaggagaacaagctggaccagctacaatttgctcggcagaaactgacatattgctatctgtctgctgctgctaccgtattttcttctgaattgtctgacgctcgcatttcatgggccaaaaatggtgtcctcacaactgtggttgatgacttcttcgatgttggtggatcaaaagaagaattagaaaacctgatagcactagttgagaaatggcatgggcaccatgcagttgagttctattcggaacaggtgaaaatagtattttctgctatttatacaacagtgaaccatcttggagcaatggcttctgcagcacaaggccgtgatcttacaaaccacctagtagaaatatggctggatttgttaagatctatgatggtcgaggcagaatggcagagatgccaatatgtaccaacagttgaagaatacatgacaaatgctgttgtctcatttgcactgggcccaattgtgctcccagcattgtattttgtagggcaagagctattagagcatgctgtcaaagatgaagagtacgataaattatttaggctagtgagcacttgcgggaggctcctcaatgactaccaaagtttagagagggaaggcaaccaggggaagctgaatagtgtttctctacttgtgctccacagtggtggttctatgtccatagaagccgctaaaaaggcaatgcagaagtccatagacgtgtctaggagagacttgctaagattggttctcaggaaagaaagtgctgttcctaggccatgcaaggagctcttctggaagatgtgtaagatacttcacctgttttactctcagaatgatggatttagctccccaaaggaaatggtcagtgcagtgaatgctgttatcaacgagccactcaaagtccaaaacagtactacgtttttgtctagttcatcaaggtagcgaggatatcatgtaatttatcctgttcatatggatcagaagcaacagcagcaagcttaagatatttgtaagtttgtgactgggctgctgtggatctgtgaagctacaactttgctgtatgtggatcaaggtattaggaagatctggttcacatattgataacataatggataaaccataacgttaaa

SEQ ID NO: 85 - DNA, 1272 bp, Zea mays
aacgagcagggcgggtaggcgagcaaggcaaagcacgccaagcgcgagtccgtccaacaaacagcccatcactcactcgccgcggcgaccatccccgcagttctcactccagtctccacacacctctcacgagcgcgcgcgcgcgcgtccgccatggcgccgtctaagcctttattccccgtcgccgtccccgcccccgacccgtccgacgaggtcgtgcgcgagttcggcccactgctccggatctacaagagcggccgcatcgagcggcccctggtggccccgcccgtggagcctggccacgacgccgccacgggcgtccagtccaaggacgtccacctcggctcctactccgcgcggctctacctgcccccaagcgccggcgccggcgccaagctgcccgtcgtcgtgtacgtccacggcggcggcttcgtggccgagtccgccgcctcgcccaactaccacctcttcctcaacaggctcgccgccgcctgccccgcgctcgccgtctccgtcgactaccgcctggcgcccgagcaccctctgccggcgggctacgacgactgcctcgccgcgctcaagtgggtgctctccgccgccgacccatgggtcgccgcccacggggacctcgcccgcgtcttcgtcgccggggacagcgccggcggcaacgtctgccaccacctcgccatccacccggacgtcgtccaggcccagcgcgcgcgacaggccggcgcgccgccgctcaagggcgccgtgctcatccacccctggttctggggctccgaggccgtgggcgaggagcccagggaccccgccgcgcgcgccatgggcgtcggactctggctcttcgcgtgccccgagaccaacggtctggacgacccgcggatgaaccccttggcgcccgccgcgccgggactccacacgctggcgtgcgagcgcgtgatggtgtgcgccgcggagggcgacttccttaggtggcgcggccgcgcgtacgccgaggcggtggccgcggccaggggcggtgacctcggggaggccgctggcgtcgagctgttggagaccatgggagagggccacgtcttcttcctcttcaaacccgactgctacgaggctaaggagatgatgcacaagatggtcgccttcatcaacgccccctgaggcgtgaggtgcttgtgttcgcgtctcagaatcatcgttggcgtggctaggtatgcgccaccgtgtcagacatttatcgtgacagcgtgcaaaataaaggccttggatccgtga

SEQ ID NO: 86 - DNA, 2698 bp, Zea mays
cggcacgactcccagtggccaagtacactcacccgctcgcgcgcgtgagcgatgaaagctctcgcctcgcccgccgcctccttcctcccgggtatcccgagccctagccatctcgcgcgcgcgcttccccgatccgcggcggccgcgctctcgcggcccccttccgggcgctccatcgccgccgcggccgcggccgccacaggggaccactggggcgccgaccaccagcactaccacggaggacgcgcgggcgcgtcggaggccgggcctaccgcgtcggcgcgcggcgtcaagtgcgacgtggacgtggtgtcgtggcgggagcggcgggtgctcgcgtccgtgcctgtggccgccgacgtcgacacgctgtggcaggtcatcaccgactacgagcgcctcgctgacttcatccccaacctcgtccagagtgtgacgattccgtgtccgcatgaagggcggatatggctggagcagagaggcctgcagcgcgcgttgtactggcacattgaggcgcgcgtcgtgttggatctccaggaaatccctgactccgtatgtgggcgagaactccatttctcgatggtagatggtgacttcaagaagagtgaaggaaaatggtccataagatctgctcctaggtcctctagtgcagttttgctgtatgaagttaatgtgataccaagatttaacttcccggctatatttcttgaaaggattataaggtcagatcttcctgtaaatcttcgtgccttggcttgtagagctgaaaagatttatctggaaaatcaaggatgtggttcaagaaaattttttgttgaggacttgaagccatcatatacttctcagcttaataacttccatagtacgacagttgagacttctaagtttaaacaagcacctcccaggtctggtgttagcagtgtgcttccttcaccttcttctgaattgattagcaaatggggtgtatatggaaacatatgcagaattgataagccttgtgtggtagatgagatccatcttcgaagatttgatggcatgttggaacatgagggggctcataggtgtgtttttgctagtatcactgtgaaagcaccggttcgagaggtatggaatgttctcacagcatatgagaatttgcctgaattcgtaccaaacctggctatcagtaggattgttcttcgtgataataacaaggttcggataatgcaggagggttgcaaaggcctgctttatatggtccttcacgcccgtgttgttatggatcttcgcgaaaaacatgagcaagagatcagctttgaacaagtcgagggtgatttttacacatttaaagggaaatggcgcttagaacaacttggggatcagcacaccctgttgaagtacatggttgaaactaagatgcatagggacacctttctctctgaatctatccttgaagaggtcatatatgaagatcttccatcaaacttgtgtgcaatccgtgattatattgaaaaggctggagccaagagtagcaattccacaggtcattctaatgtgcccacagatccagatccagatgttgatcatgatgaaagcaggcaatctgagcaaacgtgtgtgtcttgctcatccagtaccatgaagcagagaccaaaagtcccaggattgcaaaaggacatcgaggtcctaaaatcagagcttgataatttcattgcagagtatggtcagtatggtttcatgcctaagagaaagcatctccggtctcatggaagagtggatattgagaaggctataacaagaatgggtgggttccggaagattgccagcataatgaacctttctctttcttacaaaaatcgaaaaccaagaggctattgggataatctggagaacttgcaagaagagatcagccggttccagaaaatttgggggttggatccttcttatatgcccagtagaaaatcttttgagagggcaggtcgttatgacattgctcgggcattggaaaaatggggtggggtgcaggaggtttcacgccttctttctcttgaactaagatatcctagaagacaagcagacccggacgatgagagacagtctgaatccccgtctgggatgatgaagaagcacggagtgaaacctgatgaaggcaatgtttccccaaatgcgcagaaatggctcctgaagctgaaggacttggatgtcaattgggtggaatactaggtttagctttggaaaaagatatggtctctcatcatgaactcagctctttcctttcttcggaggtgttctggatgcattccgacaaagacgccgcagattgtgtacagaacagcgcggtgcacgggccaaccccattctgaaggcgagctaccagcaggcaacatgttttcttgccagtaatcacgactcttggctactactgcgtatctagaactgctgacaatactactcagcttcttttgcggtcaaaccgatccatggttttgacaaagtcaggccataaaatgcagaaaagggtgtcgatttcgtgcgcctgttcaaagctgttttgagtcagccacgcctttgaaaaatctgaggtgttcacaggttggtcgcctactttgttattactggtgatataagttgacctggtccttttgaaagagaaggtttacccgtctaaataaaataacaagaatatggatttttattgaagtcaaaaaaaaaaaggaaa

SEQ ID NO: 87 - DNA, 2516 bp, Zea mays
cagccccctgttgcccccgcttttccttcttcgctgggcgcctgggccctcccctccccctcatttctccctgcccttgcctcttctcccctgtcgccggcgagagctcgggcggagacgccgcagcacccgcaggagagcttttctccccgggaaacaaggagacctccggagggctcttccttccacgagggctgcggctgttggattgtgctgaaagatctcagtttttatctccaaggaaggattactcatcgcgaatccggatctgtcggtggtggaaactggaaagttgccacttttatgaggcgaggctgtgaggaacccgtgtccctcccgtggatgtggtgagccctgattggcgcaccaggcgagaaggggcaggagcccagtaggtggtgacagagcagggtgagagggagaaccggagaagagaggtagccggtatacaagacaagcaggcaactataggaaggacgaaggaaaaggagaggagggagctctccatgggggagcccctcctcgcctccctctctatggagaacagcaacagccacccctgcacgctcctctccatggaccctgccggctcgcacctggcctccgccgagtcctcgggcggcggtagcgccgcgaccaatggggttggcaatggtgttgaccgggaactctttgtcattccgcggcgtgagtcggcgcaccctgttccgccggacatcaacctcccgctctctgcagatcactcaccgctgcctccgtcgtggagcctcgacacgttcgacatacttgatgtcactcttggaacacacaactacgagtctgaggttgcgcttacgcttccaaagccgaccggcaacggcaatggcagtgccgctatcggcgtcggcgcgaggaaatacgctaagagaggcgacagcatctggggcgcgtggttcttcttcaataactacttcaagcctgcacttgtggagaagtcaaaggggaagatggtgcgagacgcgtccaggaacatctcgggctttgacaagtctgatctacgtcttgatgtcttcctggtgcagcatgacatggagaacatgtacatgtgggttttcaaggagcggcccgacaatgcccttgggaagatgcagctccggagcttcatgaatgggcattccaagcatggggagccgtctttcccgttcagtgccgataagggctttgccaggtcacaccgcatgcagcgaaagcactaccgtgggctgtcaaacccgcagtgccttcatgggattgagatcgtggcctcgccaaatttgtccgcagttcctgagtctgacttgaagaggtgggctgaactgacaggcagggaacataatttttcagtaccatctgaagccagtgactttgagtcatggaggaatcttcccagcactgattttgaacttgacaggccacatccaccggccgcaaagagtgccactcatggccagaagaagggattgaatggttcaggtctcaacctttcaactccaccatcatcagacgatgggatggacctttcaccgaaatgtgccaaacgccgcaaggatttctttggccatggcgtagaggaggactgtgtgatggcgaacaattcttgttccgacagagagcaagaggcagaagctcacactggtgagccatcatggatgcacgagttcactggtgtggctaagcatgcaagcggccctgtcactgctgccaagacgatatatgaggatgaggaagggtacttaatcgtggtgagcatgcttttctccgatccacatagtgtcaaagtatcatggaggaacacgctgacgcacggcatcgtgaagataacatgcgtgagcactgcccggatgccctacattaagaaacacgacaggacgttcaagctgacggaccctttccccgagcactgccctcccggcgagtttgtgagagagatccctctggcgacacggattccagaagacgcgaagatcgaggcgtactatgacgagacaggaactgggctggaaatcatggtccccaagcaccgggttggaccagaggagcatgaagttcaggtgtgcatgaggcccccacatcttggtgacaacgatctcgtgctctcctagaacaggaaaacagctagcttttagatgttctggtgtcatgctcatgccatgagatactggaacataaactggtggtgccatggctcagtaagagccgtcctatttgctgctaaacatgtagcttgtaagttgagaattcctttccccccataaaagtttgtgatttaggcaaaaggttacctcctccctctgttaatttccctctgtacctctgctacacaagtgcatcactattggtgatcttccttgactatctgaaagctgactagtcaagattctgtgtatattcagatgaccaggttcgtaataatgttgttgatggctacctatgattttgaggctcggttgtcggtttcgaaaattatttgcaatgattgccttaaccgttttaatgtg

SEQ ID NO: 88 - DNA, 897 bp, Zea mays
atagattattttccgattcctcccgatttttggaaagcgaaggaaaactttcgattgtatttgtggccgtcaggtcggatgattcctgcttctccgatcctatcacatcgcgcactaccttccagcgaatccatcacggaagaaattgttccccacccaccctagactcgccgccgtcgcaactcccacccgatccccaaattctccggcggtgatggccagcctgtggcgcgccgtgatggatagcgtcagcggctcctccccctcggcgctggacgcggccccaggtagcggcgtcgagttctggcacggcgcagagcgcgctgggtggctaaataagcagggcgagtacatcaagacgtggaggcggcggtggttcgtgctgaagcaggggaggcttttctggttcaaggaccctgcggtgacacgggcctcggtgccccgcggcgtcatccccgtcgccacctgcctcacagtcaagggcgccgaggacgtgctcaaccgccagttcgccttcgagctctccacgcctgccgagaccatgtatttcattgcggactccgagaaggacaaggaggagtggattaactccatcggtcgctccatcgtccagcactcccgctccgtcaccgacgcagaggtcgttgactacgacagccgcccccagcccccgccgcagcttatgaccagcgaagagagtgcaccagcagcttaatggcgtggtgattcctgtgaactctctcgatatggatctgacttgtagcatatgtatttccaattccatgtgattgtggccttgtgccgacgttcctcactcttgattatgtagcagtatattaactatcaacgacatggtctggtatggtaataagcgagttaataagctgtgctttcgtt

SEQ ID NO: 89 - DNA, 1281 bp, Zea mays
cagacacgccgcgcatggcgatggcgagagagagagagagagagagtaggggagggatcattgaaagccgcagcgcccatgtcccaggcccgtctgttcgccaccatttgtccattccccctccatcattcctccccgctttctccaccatcagggcgaaaattttatgcgagctttggaaagcgcgagctagtttatccggccgggcgtggtcaccgaggcagtagcggcgagagaggggaggatctgatcgatgtcgtcgggcgaggacgggtactgcagctcggattcgccgcgggcggaatcccccgaccagccgcaggcagctgcggcggcggacgcggacgcggacgcggagtcgcctcgcgccggagccgggccgaacaagcgcgacctccacgcctcgtcgccggcagctaagcgcagccggagatcggtggagaagcgggttgtgtcggtgccgctggccgagtgcggggaggggccgccgccgtctgactcgtgggcgtggcgcaagtatgggcagaagcccatcaagggctccccctacccacgtgggtactaccgctgcagcagctccaaggggtgccccgcgaggaagcaggtggagcgcagccgcgccgaccctgccgtgctgctcgtcacctacaccttcgaccacaaccacgaggcgccgcggcccaagagcagctgctgccaccagcaaggcaggccgccggcgccgaagcctgatgagcccgtggccgagcaggaggatgagctgggtccggagcatgagccggaagacgagcaggagccggagcagaaggtcgtcccaggtctggccgggccggaagcggcgccggcaaccgcaacgttggcgccggcgccagaggaggacgaaagcttcgacttggggtggttcgaccagtacccgacgtggcaccgttcggcgctgtacgcgccgctgctgccgccggaggagtgggagcgggagctgcagggggaagacgccctgttcgcgggcctcggcgagctgcccgagtgcgccgtcgtgttcggccgccgccgcgagctcagcctggccgctaccgcgccgtgctcctgatggtccttcaactcttttttacactagtagctctgatcgctgcacggggtatctgttcaaggccggcgctgcctaagctttctgtccccatgtccgtgttgattgggtacgcgcgttcgccgtgcaaggttcgtttgtcccgtttgcgatgtggttccagccagaaagcagcgaaaggtttggcatttgtgatc

SEQ ID NO: 90 - DNA, 1302 bp, Zea mays
cggaaaggtccccgcgtacgtgtggctttttcccaccctgcctctctgctcttcccaagctccatccccttgctctcaccactgaaatgagcggcggcggcggccttgggtccggctgctcgtaccagaagttcgtccacttcgcgctggagcagacccgccaccgctccactctcgtcccccacccgtcccaggaaaagttcaggttcataaaagcaaatgaggataacaccgttctcaatgccttgtcattcagcacttccaaaattagactgcttcggagcttgacaattgagcaaaaaaactcggttcaggttcttgattttgctgccttctcaagacctgaatacgaccttcctatattttgtgccaatgccttctcatcccctgcacggagtattgttgtcttggacctcaaccctttgtatgataccactgaacacaaggattacagggaaaaatactacagggctttgatgccccttgtacacaagtacagtgagcttctgccctggggtggcaagattacaagtgagtcgctgagattcttctctcccattgttatctggacggtattcgagccaagcgaagccaaccaccaagctctatactcggccttcgtggattactatatggtctggcttgagttcatggacggagcagttcgcgaaagtagcaaagaaaaaatcgaccgcaatagagaagcgcaacataaatatctcacatggagagcagagaaggatcctgggtacccgctgctaaagaagttgatcggtgagagtggtgccaaggacctggtgagggagttcctcttcgaaggagttggctcgctcggaaccaagtcgtttctggagtatttcgccgagtacgcgcaagaggacgggacggtgaacaagaagcggagcatggcggggaagtcctttggaacccgaccttgggacgcccacggactgttcgtcggcgacgctgtggatggatagcggccaagcgggggctgttttgcttctacataagcagtttcatctcaatccccgttgtttattcacggaggacttgcgtagtggtttcagttgttgtttcaagtggttttgcttcggcaaaagtactggacggttttgctggctcaggtttcagatcatcttcaacctttccccatggcattccatgcgaggccggctacaatttctgttgtctctttacttcttttatagcattgttcatcatctttttcgttgtccggtgacttggctttggttgctgccgctgctcggtcggtggttttaaacttttgattcgagtcct

SEQ ID NO: 91 - DNA, 1427 bp, Zea mays
aattccctccgaacgctgaactccaagcaaccgcaaaataaccaccgtttccttgcagcccgcgaatcttcgtctcccttccccacccgacacggcacaccactctccctccctccttcccttcccctcccctcccttttttccctccgaatcccgctcgcgaaccctagccagccttccgcgagatggacgacgactgggagctcctcctcgcgtcccccaaggcggcctcggcggccgagccgtacgccggaggcggggaggacgacgccggcgccatcaagcacgactacttcgacctcggctccgacgccaagtacccccggagggcgtcgctgtctacgggggacgaggaggagggcgcggaggaggggcttctcagggcgtcggacaacgcgagctgggtggagccggaccctgacgaccttctcttccccggccgcgaccgcgcggcgctatggtcggactcgtcctccgacggggagaggcccgaggtcgaggccaccgatcccgtggggcgggccagggaggagggcggggtgatggcggccgcggctgatggggtggagggggccgtggcgaagggaggagaacacgtccggtggtggaagctgccgctcgacgcgctgcgtgtttgggcgatgcgcgcggcgaggagcgcctggtcggtgccgttcgccgtcgcgctgctcggattcgctgtgctcgggcgccggctgtacaggatgcgccgccagagcaaagccgccgcgcgcgtccgcctcgtattcgacgaaaagaaggcctcccaattcaagggccaatcgtcacgtctgaatgaatccacgacgatgatgcgccgaactcctttcataaaacctatgcttcctgccaatggagtgactccatggcctgtgctggggcacctgtgagatgtgtgatcagtgacgtgatagagctaataatacagctgccccaagccctgcagagacgctcacacttgctacaggccggcatattatgcaatgcccagcagcagatgtactggctgcttgtaattcgaaaccacgcacttgtggaagaccttgcaagcttccgttcatgcagaatgatatttaggcctgatctagcttatgcttcttttgtgtatagccacccatgtttatatttctattttctgaatccttgtatcatcgacttatgtgctggagatgtaaacgattgagtactgagtacccaactatctatatgtagtgtgatgtatcatgtatatgacgattacccttaggccctgttcggttgttccggattggagccccggattaattcttagccggattacttctctaatttatatagattttgatgagctgaaataaatcctggctcattccggtacaaccgaacgggcccttacccataaatcaatacacgtggaagttagatta

SEQ ID NO: 92 - DNA, 1360 bp, Zea mays
gtggactctccactcttcttctgcggtcggatcccccggcgggtcggactgcggagcacgggctccggcgagccgctgacgagggcctgtgcggcgaccgagctcgtggcgggagaagatggacgaagcgagcacctccgcgtccggcgccgcgacgaggcgcggcttcgtgcctgcgagatcgggagttttctataggttcacccagcagaacctcccagcttggaagccagcaatgacacctggatgtataatagcaatgttcttgattatcggaataattttcatacctttcgggcttctttgtctccaaacttcaaatcatattgcagaaatcatctaccgctatgatgttgactgtgtgcctgatgcttacagaggaaataggcaagcttatattaaggacagctcgatttctaagaactgtactctggaagcgaaggttctggaatacatgagagcaccaatttatgtttattatgaacttgagaatttctatcagaatcaccgcaggtatgtcaaaagtagaagcgataaacagctgcgttttggggcaaaatacacggccgactcgtgcagtcctgttgagtgggataataatggttccccaattgttccctgcggcttgattgcctggagcttattcaatgatacatatggttttactcgtgggtccaaggaaataaaggtcaacaggaaaaacatttcatggaagagcgaccgggagcataagtttggcaaacatgtgtttccttccaactttcagaacggaaccttgattggaggggggaaactcgaccctactgtcccactgagtgaacaggaagaccttattgtgtggatgaggacatccgctctccccaaatttcgaaagctctatggtgtgattgaagacgacctgcatgcggatgagaccatagctattttcgtaggaaacaattacaacacctacacttttggtggaaagaagagcatagtcctgtcgactgcgtcctggctaggcggcaagaacgacttccttggacacgcttatattgtcactggttcgttgagcatcatcatatcgattctctttgctctgatccatgtgaagtacccaaggccgcaaggtgaccccaattgcctatcctggaacaggaaaaacagcaatagctaaggggccccgcctgtatctaccatctatgagggcgcctccacatgaatcagtattacacatctgtatctgaaacatgtcagacactgtgccgcaaggttaatcccagatgatgaaaagaaactgcgtacaccatgtccatcagaaatactagttccaattccgacacatgcgctgggcatcaaggtcaacaccgggagtttttat

SEQ ID NO: 93 - DNA, 1140 bp, Zea mays
atcctattcctgcggcctcggcctgtccgcctgtattttagggggcccgtggggcgtgggggcacgggcacccgcacaagctgcgctgccagtgccagcgctcactcgaacgccgagacccgagaggagcaaacagccaaaaagaacggaaaggggagagcaaacagccaaaaaaggacggacttgcgcgacagggtcgaagactcagaaggggaatctccggaggatggaggtgggcaggactccgcggcgacgggcgtccccagcggcagcggcggcggcggcggcggcggctgtgccttcgctgcttctgttcgccgtgctattcgtgggccgggcggcggcagcgttgggcggcccggggccggcgctatacaagcacgcgtcgttcttcgaccgcgacggcgacggcgtcgtctccttcgcggagacgtacggcgcgtttcgggccctcgggtttggactcggcctgtccagcgccagcgccgccttcatcaatggcgcccttggcagcaagtgcagacctcaaaacgcgacgtcgtcgaaactggacatctacatagaggacatccggagagggaagcacgggagcgactccggctcgtacgacgcccaaggaaggttcgttccggagaagttcgaggagatattcgccaggcacgcgaggacggtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagcgacatggagagaagctgataagcgtggtccgggagaactgaacaagtctggacatgccgtcaagcgacatgtgggtgtgaacactctttcgggtcagattattaacaagaagggtgtgaccgtgtgagtgtgaacagaatcggccgaggaggtccaccagaccagacgacgacgaatgcttcggttgcgtgcggtgcggtctgtctgtttgtatcccgtgagcgcgatggttgcaataatctctactccta

SEQ ID NO: 94 - DNA, 413 bp, Zea mays
agcgcccttcacttttattcacagtttgcaagctagctagctaggacgagctgccagcggcgccagccatggcgatccgtggcgtggcctccacccgcgaggaggacatgacgctggaggagttcaaggagtggctgaagcagttcgacgccgacggcgacggcaggatcagccggaacgagctccgggaggcgctccgccgccgcggccgcggccgcggctggttcaccgcctggaggagcgaccgcgcccttcgccacgcggacaaggacagcagcggcttcctggacgactccgagattgagaacctcgtcgccttcgcccagaaggatctcggcatgaagatatccacctggtagaagtagaagaagaagaagcgcagagtgacagccgctgcaactgcatggtcctgc

SEQ ID NO: 95 - DNA, 2657 bp, Zea mays
cgctttcctttcgcctcccaccaccaaaaagaggagcagaggagaggtttgtgtgacagcgtgagcgagcgagtgatgattaacacctcagccggcagacagccgccaaagcagtagcgtaagaaagagagttagtagagcccagatcgagggagggaggagtagcaccgagcacgagcatctccactccacgcgcgccccatgcccgtccgctccacctccatgagcgtcagctgagcaagacaaggaaggggaatctctccctcattcgccttgccgtcttgatctgtcggctcccggcggcaacaccctacaggtttcatctatggggcaagatgctggcttcaaacgcgaggatcattctggattgggatcaggtcctcaaactttgaaggtctcctgctgcactagtgaagaaaacgagagtcgaaacagaagataccatcagttgaaatgctcagagagcaactcgaggcagttgcacctggactacgtcccaaatttccactgcaggagcttgccaacgagaagccgcaagacgaatgctgagcaaagcaccgtggggaagcgtggttctatgtaccagagctccagcgaaataagcaggatcagaaagatccaggagggcaggaggaaaatagattctgcattcgatggggacgcgttcctgtcctttgatattgtcgatgcatcctctcgccctagcacaagtggagcttatctgcattcccatcagaatcggaggtcgggcgctaagccttctgtggacaccgctaagcgagcgtcaaaggacttcctggaccttcagttccgtgaacatcctgatgagaattttaagctagatcgaccacgcttggatagtaccttgttgaaaaacgatgatggtttcttggagatttctctcgagaaagagatagcaaagggtggcccgtgcagaaatgcagctcctatcctgctaaacactgggtcaggcaaatgcactgacctgcaaaagatgaatggatgccccagtgagaacaactgtggtgacaaggggagagattcagcaagcagttccaaatcaacgcctgtgaaagtaagctcctttgacggatcctgccaatctgacggtgctcaacaccatatcacagagaacaacactaaagctcgatcaagccccttcaagaagatgctggaccctattatgaagtccaaatctcctaggagcccatctatcatggaaagaggaggctccaactccgcaactgggccaggaagcaggaaaaactccgtgtctcgaaaatcactgctgggtgatttttcaagaagtgaacaagcatctaattgccagcccaatgggcaaacacagaagcgtgtaaacaaatctgctttgtcacctgctcatctccaagcggttcttagattggattccaagaacggtgtccaggtttttgaattctgtgttgacggcccaggagaatccatttccgccaggaattggaaaaacggtgatgagttgagctctatatacaccttccatagtggcgggaaacggtccagtgctgctggaaggatctccaaagatggaggctgggatttacccccaatcgttgggcaggtgcaggtttcatcatacttatgctctgaagttggaaaagacggtacggtgaataactctgtcgtcaccgagtttgtttcgtacgacattggtcatgcgaggcggattgttgaggagaagacaggggcacttcaacagccacagaggactagtctgacggaagagaacaagactgggagaaataactcagatgtatcgacatcttgcccgtggtccgaagaagaccttcatccttatttggagattgcggcgactgtgatagaggttccgtttagcagatacaagtccgaagaggtgaagaatggttcatctccttgtactgtcaaagttgttgcacctagtggactgcatggttcgccgagtgacgatgaagccggcggcccatctcccttgctagatagatggaggtacggtgggggttgcgactgtggcggatgggacatggcttgccccatcgacgttattggcaacacatatgataatagctgggctgagtctatagctaccaatgtgaaacatcccatggagctctttgttcagggtagcaaagaagagctccccgtcctttctatgaaggagaacgggagagggcagtttgtggtggatttccatgggcgactatcagcgttacaggcgttttcagtatgcatctctctgctgcactgttctgaagcttcgatcgccatcagcctcaagaaggggaagcagaagctgtattccagctcgctcaagttgctcctcgaggaggacgtgaggcacctgatcgaggcagtcacagctgaagagaagaagaagaagaagcggagtagagaaaaggcgcctcctccgtctgttctgcttgacccgcctttttctcccatcggaagagtgtagtgtagccaccaggcattgaagaacccattgcattgtttatgatttgtcttgatgttcatattttccttttaggatttcatacttgcatggagtgttagattctagcaggcagtaaggttcataatgtactgttgagatgttgaatagaagggggggaaataaagtaggaggagccagttttcttgtg

SEQ ID NO: 96 - DNA, 1612 bp, Zea mays
aaatgaacagtcgctcgcttttctcgacacgctgggctgctacgtgtcccgccagtactgggtcccacgtgcccgcctcctttcatcctcggcagtcggcactcccgagtcccccacaccgccgtgttcccctctcttgtcagttgtcccttcccccacttccctttccttcccgaagagacgggcgcagacggcagagccaccatggccatggaggacgccgcctcggagagcagcgactgggaggtgctctctgccacctccgcctgcgggggcggcgacgacgatgaggtattaatcgtctctggcgggggcggcgacgtcgtcctcgaccacttcgctctcacccccgacaccgcagccgcctggcctggcgacggcgagggctcgtggtcggacgaccggggcgcctggcaaggattagaattattggatgggttcgatccgattccggaagcaagtttcaatcttgcagctggtgtttggaaccagccgctgctgataagcggcgtggatgacgcccgcgaaggggcgcgcagtgcgacccgcagcgcagatggaaatcaagaggaggtggtagccgctgagattcagcaggagagtaattctgtgtttagccgcggtgaattgcgcccggtgctgcagccggcgtatcatggcgtgggagaaactctggattctgatgcagctacacgtacaggtgcctcgctccagggtgaggtatcggagagttcccttgtgcgattggatggaggaattggtactggtgtagaaagatcgtgccttgaagatgctgtgtcaagtgatgagatccatggtgaacaagaagagcaggaacaagggagcaaggttaatgctgccactggttgcgatgaaccagatggagaggtcaaggatggtgctctgcctctggctcacacggcaggtactgaagagggggagaagcaatttgttgtctggtggaagctgccgttcaagctgctgcactactgtgcttggaaggtgaagccggtatggtccttctccatcgccgcagcacttcttggcctggtcgtgctggggaggaggatgtacagaatgaagcgcaaggcaaggggcttgccccagattaagattgcgtttgatgataagagggcctcccaatttgctgatcgcgcggcatatctcaaggaagccttcctggtagctagacgtgtacctatgctgagaacatcatctggtgctacgcttccatggtcaatggttcaggagagatgagtgaagctgctcaaagctccattctggatggtgtacatcagtacgagcatctgatttggctttgtctataaccttttgttttagatgacgcgtcaaggaggattccaatgttgatgtcagtggtctctctttctcgatcttctccatttttactttaccttatctttcttttttaaggaaccacttcttgtgctcctgatttccttttttttctttgcccttactctgtttagtccgtggttagtagtggtgtcctaaatttatcgttcgtacagacgtgctcttttctttatcttgttaatttagatgctagttgttgacgctgaattggattggatgacatatcagtaaggct

SEQ ID NO: 97 - DNA, 880 bp, Zea mays
aatctattggcgggctggcggctcctgtctgtgagtcgcagactcgcagtagccagtagatgccggagccgtcgcagccactcaaaccccatcaacaaaacggcgccaactcaacagacttccagctagcagtgaccacggcgaccatcgccggctcgccgccatgaagcacctccacctctcatcttctcttcctctcctcctccaccgcccctccaagccccatctcctccaccctagccgccgccgcgcctccatccgcaacgccgcatccggcggcggctccggcgaacccacccccgccgcggaaacggcctcaggtacctctccgccagccgctgccaagcccgccggcgtcaaggaccgcctcaaggcgaggaaccaggcccgccgggtccggctggactccccgccgccggaggtggtggtggtgccgaagaagaagcccgcccccgccgcgtcgtcgtctcctgtgccgaagaagaaggtcgggcggaaggggtgggaggagatgagcctgggcgagaaggccgtggacctctacgtcggcgagaagggcctgctcttctggctcaacaagttcgcctacgcctccatcttcatcatggtcggcgcctgggtcctgttccgcttcgtcggcccctcgctcggcctctaccagctcgacgccccgccgctgccgcccaccgccgtgttcagcggcggctcgccgtgacggcgtcgagtcgttcccgagtgggcgtacactgtcactaggtcgaggcgtagagctagcgtagccgcggattaataatggtgacatgatatggaaagattgaggaagaggatgctgattctggagccaaagtttggaccttttactgccaatatgtgaattgta

SEQ ID NO: 98 - DNA, 844 bp, Zea mays
gtgccggctctttctcgctctttcgactccatcctgatcccgtgcgtcttcctcggccctcacgacctcgctcgtcgctgcccccgcacacccgcgcttcttccgtccctcccgctaaatccttccgtccctcccgccaaatcgcgccatttagtctccaaatccattcgctgcgcgccaaatccaagccaccatcctaaatcgcccccaaatcccaaaccctagaagcaaaacgcgttgaggcgtcaatccaagaggacctctgcaccaacgcctctggagatcccgccgcaaggggctccgcccgttcaaccaccaagggctcagcccatcctcccgcctggcttcccgtccatggttggacccggcacttggtttgccccacgtccaccgcagtccatggtgagctcttctgtaccatcaggcagcaatggaggctctgcagttcctcgttctttggctgagaatgttgctgacactgatgtacaagcatgaacaatataatgcttttgatgtggtgatgctgctgttctacttccatccttccagtgactgctggttgatgcaaatcggatggctactcctatttaccaaagttctaattatggttgtgtgccttctttcatcattttcatctatttaccaaagttccaattatggctgcgtgccttctttcaacattttcatgtaattcaataacaatggctttgtgccttgtatcgttgttttcatttagatcaataactatggctttatgccttttattatttaaagagtactgttgtaatgggcaattgttgatgttgacgtgaaatgactttatctacttgttgtgaatcggcca

SEQ ID NO: 99 - DNA, 3182 bp, Zea mays
cccaccgctctcgctctcctcctcgctctagccgcgaccacgcgacgccgtgggcacacgcacaagcacacggacccccctcccccctacccgctgcctccgccgcggctcgccggagatggatggctccggcagctgggacgctatagactggaaccaaatcgaggatccgaggccgcggaggtcgggccaggccgtcaaggagagcatggacgacttcttgctcgaggacgaggaggtgctcgcgcagggccatggagttgttctactaaacaaccgtgatgctggtacactttcagttacaaatttccgtcttctctttgtgagccaagcaaaaaaatgtgtcatagagctgggtaccattccactgacgacaattgagaagctaaatgacgatgtgaaactccaacccttgccccacctctctgataagaaccacccccgtgaacttcttcaagtaattggcaaagacatgagaatcattgtgtttgcttttatccccagaacacagcagaaaaatgaagtgtttgatgctttgaggagatacactaaacctgctaatttgtgggatctatatgcattttcttgtgatccatccaccattaagcatgattctgagccaaagtggcgtctcttgagggaatactttcgtctttttaggagaagtttaccgctacagggagtcgaggaagtttctttgtgtaatgaatggtggaggctaactagagttaattctagttattcattgtgttcaacttacccctctgaactcattgtaccaagaagcataagtgatgaagatttatttcaagcctccccatttcgatcaggcaagcgcttgcctgttatttcatggtgtgaccctgggtctggagctgttctggcaaggtcatctcagccgatggtggggttgatgatgaactttagaaacaatgcggatgagaagcttgtctgtgctctcagcagcagaaccatcgatgagaaaggatctccaaggaaattgtacataattgatgcccggccaagagcaaatgctatagcaaatggggcaaagggagggggctcagaatcatcttctaactaccataaatctgaggttctgtttttaggaatacaaaacatccacaccatgagagagagtctttctcgccttagggactatgtggatgctcatggctcaatttcatcaaatgggagcccttcagctgtatctgttgttggagatcggaggaaccgtggatcaacctggggtggaggcaatctaaatagcatgacatcattttcttcaacactgggggaatggctaaaccatatccagaatattctggttggtgcttcatggattgctgcacaaatttcagaagaagcagcgtcagttcttgtacattgcagtgatggatgggaccgcacaacccagttggtttcacttgcttgtttattgcttgatccctattatcgaactttcagtggattccaggctcttgttgaaaaggattggttagcatttggtcatccatttgcagagagaatgggagttccaacagtagctgagaatggggggtcacagtatgagctactaaggcaaccttcgctcggaaatttaagcagttccccgagtaggaacactttagggccgccagggccatcctctaattctccagtgcaatcccagacatcaaacaacacttcaccaatattgttacagtggcttgattgtatctcacagttgttacgtctgtacccatctgcatttcagttttcatctaaattcctagttgattttatggattgtgtgctatcgtgtcgctttgggaacttcttgtgcaatagtgaacgagaaagggagcaatctggtgtcacaatctcctgtcgttgcatgtggtcacatttggctaatctgagagcttctggcggcagcttccatgagcactataatccattctatgacccagtaaatcataatggtgcactattgccccctgctgcagcacttgccccaacactctggccccagttttttttgaggtggacatgccccattgagtcacaaggtggtgatcttgaatcccagtggcatgctatgaataaaaaatatgcagatacaatgaaggcaaaggatattgctgagtggagggcaaaggatatcaaattgaaattggaatctatgaaacaagacctgcagagggagaaacgtattaatagtacagctctagccgcagcccgaagtgctcaaagggagaatgctgcaattaagaaggcaatagaatctatagggtgcacaattaaattttcgacaagcgaaaacgaggacagaactgaagtgctgtcatgttcattaggaagaggcacagatggtagagctcagcaagatgaaaacggtgacttctctgtagcaattgaggacagcctggtctcggatgcaccggcggaccatttttgcgaatcactctgccccttccgcacaagagaagggtgcagatggccagatgctccgtgtgcacagcttggaagtcagtttgttggtttgaaggcaaattttgatgcttttgaccggctgtcaatacatgactgctattttggaccggagtagttgatcatgaaccagccgtgtcagtacacgcttggcagttgccaatggattttttcagtagttggcacctccaggtcggcatcaatagcaaaagaatgctgagaaacaactcaatgatgcatatttgacgagtatttacaaattccttgattcaatagtttttcactgtctgggtcctccgaatctgcatcaacagaataacctggaaagcaaattaaggatgcgtacctgatatgcatcggaggatcttttttttttgttccaatggtattataagcttctgtgagggaattccagcgttctttgttagttagcaatttgtaggaaccaccgagatagaaatcaatccctttgtatagtttggcaagccattcatactataagcaaaataaagcgaaacatggaagacggtagtagtttgttactctttttctgatagtacagtgttcgacttgtaactcttagctttagaataagatccatgcaaatcctgcttggaaaggaaatgttgtacatgaaggtatagacacgtggactggttcctgatccctccttatagttgtaacgatatagattttttcaagtgccattg

SEQ ID NO: 100 - DNA, 1138 bp, Zea mays
agaagggtgggagtacggcaaaaggcctgcctctctgcgactgatctccggcggcgaggcgccgcaccggggtatgggccaggatgtggtcgcgcacgtctacgacgtcgccaccgccggctccgacaccaccgtgctccacatcaaccgcttctttaaggacgccatcggcctcggcggcatcttccacaccgccatccaggtctacggtgatgaagaatggtcctttggctactgtgaacgtggcactggggtttttagctgtcccccatgcaaaaatcccatgtacacttatcgcgagtccatagtgctggggaagaccaactgctgtatcctcaaggtaaatcagatactaagggagctgagctgggagtggcctggacattcatatgaactcctgtcaagaaactgcaatcacttctgcaataccttctgcgaaaagcttgaagtatcgaagcttccaggttgggtcaatcgctttgcaaatgcgggtgacgctgctctagaggtcgctgaaaccacagcaggaaagctgaaacaagcgaaaaaggaaatcgtgaccgcatgcaaagcagcctcaacatttttgaccggcacatcgtcaagcgcctcttcaaatgcggaggatacgggtggctcaacctcgacaggaaattccctcttcgagggggcatggatccgaagtatcatcggtatgacaatgaagccgtcgaagagcctagtctgtgtagatagttcagatagcgacagctccgggagcgaatcagaatcagatggcgatcggcccaacagcgatgacaacgctgagcgacaagctaaaggcgtgaagcaggagcgaggcacgaaaaaaaagaataacggaccacattgccattcatgaagctcactcacaccaatactgcagagagaggaaagacttctacatgctgccgggagcagacctacagcaggaactaactttacaattatgttcatttctggttgagagctgggagcggcgaaagggccctgaggagtgcggaggcgatggagcgcaccacaatgcgtgcaatcttgagcttgatttgcccgcgccgtgggagcgggcgagccgtcctttgcctttcagccctgtaaactctggtgagacgggttgtgc

SEQ ID NO: 101 - DNA, 2479 bp, Zea mays
acaaaaatccccgatctactttactcccctggccctaagccaaacccaaattcccccatcccacgacgccgccgctgccaccaccaccaccatgggaagaaaggacacctcgtcctcctccgcggccgccggcggcgggaaaaaggagaaacctatgtcggtgtcagccatgctcgcctccatggacgcccccgcggcgaagcccaagtcctccaagtcggcggcgccgtccaaggccaaggcgaagccctccaaggcgccggcgtcctcgtacatgggcgacatcgacctgcccccctccgacgacgaggaccaagaggaggcccagctcgccgccgccaagcccaagccggcccgcgccgccgtcgacctcagcgccggcgctgcgccgtcgcacaaggacgccaagaagaaggacaagcgcgaggccgtggcggccgcagccgccgaggccgccaggcaggaggcgctgcgcgacgaccgcgacgccttctccgtcgtcatcggcgcgcgcgtcccgggctcctccgccgccgacggcaccgtcgacgacaacgtcagggacgtcgtgctcgagaacttctccgtctccgcgcgcgggaaggagctgctcaagagcgcctccctccggatctcgcacggccgcaggtacggcctcgtcggccccaacggcatgggcaagtccaccctgctcaagctcctggcctggcgccaggtccccgtgccgcggaacatcgatgtcctgctcgtcgagcaggagatcatcggcgatgaccgctcggccctcgaggccgtggtcgccgccgacgaggagctcaccgccctccaggccgagcaggcgaggcttgaggcctctaatgatgctgatgacaacgagcggcttgtggaggtgtatgagaagctgaatctcgtgggctctgacgtcgcccgtgcccgagcgtccaagattcttgcggggctggggtttgatcaggcgatgcaggccagatccacaaagtccttcagtggtggctggaggatgcgtatttcgcttgcccgtgcgctcttcatgcagccaactctgctgctgctcgatgagccgactaatcacctggatctgcgcgctgtgctatggctggaggaatacttgtgctcccagtggaagaagacattgattgttgtttcccatgaccgtgacttcctgaatacagtgtgcaatgagatcatacacttgcatgataaaagtcttcatgtgtaccgtggaaattttaatgattttgagagtgggtatgagcagaaaaggaaggagatgaaccgaaagttcgaggtgtatgagaagcagatgaaagcggccaggaagtctgggagcaaggccgcacaggataaggttaagggccaggcgctatcaaaggctgctaaagaggccgccaagaacaaggggaaagggaagagtgctgcagatgacgatgatgaccagaaacaggtagctgtgccgcggaagtggcgtgactacagtgttgagttccatttcccagagcctacagagctcacaccacctctccttcagctcattgaggtagggtttagctaccctggtaggccagacttcaaactctcaggtgttgatgttggcattgatatgggaacacgtgtagctattgttgggcccaatggagctgggaagtctacgctgcttaatttacttgcgggtgatcttatcccaacagaaggggaggcaaggaggagccagaagctgaggattggacgatactcgcagcattttgttgacttgctgacaatggaggaaaatgcagttcaatatttgttgaggctccacccagatcaggagggaatgagcaaagcagaggctgtccgtgctaagctcgggaagtttgggttacctggacacaaccatctcactccaattgtcaaattatctggcgggcagaaggcccgagttgtgttcacttctatatcaatgtctcaacctcacatactcctgcttgacgagccaacgaatcacttggacatgcaaagtatcgatgcattggcagacgcgctggatgaattcactggaggtgtcgtcttggttagccatgactcacgattgatatctcgtgtttgtgaggatgagcaaaggagcgagatatgggttgtggaggatgggactgtgaacagatatgatggcacatttgaggattacaaggatgaactcatggaagaaataaagaaggaagttgaagaataatgctgctccaagttagttgtgctttgctgtttatttatataataggctgttttcttgaactgaaattgcatgtactattactgagttctctttactctggtttgcagagtattcatatatggttccaactttgtaaaaatggggcatgcttgttttatgttatacaagagaaacctgagaatatggtattatttgtttgtatattttgttgtgacatatatgtgactggacgaccggtgcagcacttctcaa

SEQ ID NO: 102 - DNA, 844 bp, Zea mays
atcaaagcaaacactggccataaccgcagcatcgtcagccgccggacgggagcagcttaggaagaggaggccgacgccgtactgctagcacaagccaagaaatgggcgcgctctgcctgctctacccatccacgccgccgcgctgcccatgcggcgcccgcgcggacgcgaccgcggccttcgcgccttcccctttcctctcatcatgtgctgccaccggtgcacaaacaaggctgcagctctgcggcaggagccagaggcgcggcggcgtggcgcgggtaggtggcggcggcggtgggggcaagggggagagtggcaagaacggcgcggcggcgttctttgatgaggacggggtggtggacgacatggacgggtacctcaactacctgtccctcgagtacgactctgtctgggacaccaagcctgcctggtgtcagccttggacaatattgcttacgggaactggtgccgttgcctgtagttgggtgcttatccaatctgttgtaattactgctggggtttcttttgtaatatccgcatggtggtacatatttctctactcgtaccctaaggcatacaccgagatgatagcagagagaagaagaaatgtagccagtggagctgaagatacctacgggatggagaaaatccagtgaggatctacggcggcgctgcttgtagagtgcataactctcttgtgttgtgtctagcatttccttgctgagggtgatatttagaaatgaccgcacgctgtggcacgtactagcacgatttgtctgtaaatgtattcgccagaaattgcaacaataccatggaatcatgtcatgtgcttgctttgttcata

SEQ ID NO: 103 - DNA, 1200 bp, Zea mays
ctcgaagcccacttctggttccggtggacccgcgtacatcgctaaggaacgcagcagctcccccgacaaccaccagataaagctgcaagctgcttatcttctcccgtcccataggttgctaggctcggccgtgtagagcagcaagagcacgccgcgccaagcaacaaagagggaccccgcatccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaagtacatctacaaggacacgctcgccaggaacctcgccgccgtcatttacaaagacgaggacgtgatcatagacacagcgaaagagcagtaccgtgtgctcaagaccgaaaatcagtttcggtatggctacaaagttgtggagaaagggaacataaggtctgctctgacgacaagcaatgtgatcgaacttccaaagaaggacgagctcaaaaccgtggttgacaaggtgaaggacttctttggcgacgtgactgccggcgccaaagaatcctttgcgcagataacagggtctgctgtcagcaaggaggaagaggaagcagagagcaaagagaagttccgctccaagagacgaaagaagcagcggaagtcgaaggagggcctcaagacggagaaatgattcagtcagtcacacaagtaaagcaccggctgtagtttcgctatcgatgtccgagaactgttctgtaatttctccagcttccttttttttgtttgttttgtaaaaagacgtcgtgtaacttcattgcgactaacgtgtgctatgccttctcagtaaatctcacaaaatgtgaaggtactccctacgttctgaatcatgagtcgtttttggatttgtctaacgggccgtttggatcccttcattttagtggaattagaattcaccca

SEQ ID NO: 104 - DNA, 1416 bp, Zea mays
aaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctggtggaggtgctctacaacatgaaccaggagatccagacggaggacatcgacctgcccctcacccgcacccgccccgtcaagaaggtggccctcgtggtcctgaccggcgagcgcggcctctgcgggagcttcaacaacaacgtgctcaagaaggcggaaacccgcatcgatgagctcaagcagctgggcctccagtacaccgtcgtcagcgtggggaagaagggcaacgcctacttccagcgccgcccctacatcccgttggagcgcgatctagaggtgagcagcgtgcccaccgtcaaggactcgcaggccatctgcgacctcgtctactcgctcttcgtctccgaggaggtggacaaggtggagctgctctactccaagttcgtgtcgctggtgcgctccgaccccatcatccagacgctgctccccatgtcgcccaagggcgagatctgcgacgtcaacggcgtctgcgtggacgccaccgaggacgagctcttccgcctcaccaccaaggaggggaagctcaccgtggagcgcgagaaggtgaagatcgagacgcagcccttctcccccgtggtgcagttcgagcaggaccccgtgcagatcctggacgcgctgctcccgctctacctcaacagccagatcctccgtgccctgcaggagtcgctcgccagcgagctcgccgcccggatgagcgccatgagcagcgccaccgacaacgccatcgagctccgcaagaacctctccatcgcctacaaccgacagcgccaggccaagatcaccggggagatcctcgagatcgtcgccggtgccgacgccctcgctggctgagcctgagtccccttggtggtgcggtgctcctgctatatataattctttttcctcattttctccactctgcctgtaattcctgataatagcacaaacgcaacggagttctgtgttccttgcgacacacaagaatttcaatccagagatgccaaaatgtataatcttgccgcaactgagacgtcgaagctcagtgtatttttatgcccaagtcttccaaatgtttggcacgaatcagct

SEQ ID NO: 105 - DNA, 579 bp, Zea mays
atcctcatcacaggcaacaaggcaccacacctcttcttcttcttcctcctcctcctagcacagctagcgcctgctccccttcgcctgtgatcatgtcttgcagcagcggcaagtgcgactgtggctccagctgctcctgcggcagctcatgcaactgcatgtcccctaacgtggagaccgccgccgccagcagcatcaagaccacggtcctcgccgcgccgaccaccaaggccagcgccggcggcttcgaggcggccaccgagggcggcggctgcgactgcaacacctgcaactgcggcaccagctgcggctgctcctgctgcagctgcaactgagccggtcaggcgatggcgcacgagagtcgagaggacgacgacgagtcgtataaatataatagcggcgtctaaataagatcctgtcaactgcacccgccattatcgatccatggtcgctcctggggttcatgttcatctgtaacgtgctcgcggtcatgtccgtctcgtgccggatttaatatttatatgcatgtatttgtgttttttctgcgttattacatgtgccggtttcttgcgtgtcttc

SEQ ID NO: 106 - DNA, 661 bp, Zea mays
aacaaatctaggtggcttggaccgcccacgttcagtgtataaaggctgatactgtgatccttgggctatggctgttgctccccgccgaggcatgcaggggaccaattcttccctaaccattggagagagagaatggccgccaccttctagcccatggctgaagctgtcgtgctgccgcgcaattgcctcgcgactactctccagccacacctcgctgactccccctcgccggtggcctcggtggcgtcagctaggcaggtgatgtcgtcggcgcttggatggactccatggtcctcgggcgcgaaaagaggatcaccagtaggctccatcgcggctgcacaggaactgcgcgaggacacatgtcatctgaaaagcaagttggtacctgaaatctcaagtgccaggcaagttgtgcccttgattcacttttggttacccaataatgttctttataatcatttaccatgcataggtttaattttgatgggacccgataggtcaccttagattgtttatctcgttaccttgtttacccctgaatcacttgggtagtttgctattgctttatatggttttgggataatcatttattatatccatgttccagttattatgttatttatttatgttcatgtcaagatcattatattattgttaattg

SEQ ID NO: 107 - DNA, 511 bp, Zea mays
ctgtgaggaagctagcgcacaccaccgcatggaattgctctcgacgcccgattgagccgagcgatgagagagattgggagaccatgccctctccccgccaccatggattcccgcctgtgtggccaactgggcactggaggatggctttggcgcttcaccggtcaacagggatcatgcccagggcccgtgggatgatgcgagtttggctgggagaatggagctccgccgcagggccgcatgccgccgtgactagccatgccaccgccttccccgctgcgcgaggactcgtgtcatctgaaaagcaagttggtacctggaatctcaagtgccaggagaagaacaggtgattcaggaggagccacaaggcgaggagtatgatctgatctaggtggcgtttctcagttgacattggcgccaacgatccttagttcgttctatatttattctttattttgtaataagtcttccgctatgtaataaatactctgatgttttatgacatttatctcta

SEQ ID NO: 108 - DNA, 1148 bp, Oryza sativa
ctatttgtacgcgcaccacccgttcgccgccggcgcaacccgcgcctcgccgcgaaccgaacccgtgcgctctcgctctggttgattagttgccatcgccaccaccaatccggcgttgtctcggagatttgtctaggcgttcgcggcggttcgatcggcggatggcggcggcggcggtggcggcaccacccgtgagggggtactgccccgcggcggcgtcgacgtcgtcggtggcgagggtgcggatgccggcgtcgttcgtgagcgcgccgcggcgggtttcggtgcggctccgcgcggcggcggtggcggaggtgccccgagggctgcagctccggcgggaggaggagcgggggttggggttcttcggaggcgtgtttggtggggaggaggaggaggtggtggagaaggttggggaggagagggtggaggggtggatgagggagtcgatcgcagagatcgtgcggcacatcggggaggcgccgttcctggtgcacctgttcaacgacgacgacggcggcagcgggcggggaggcgcggggcgcgtgacggtgcggcgggagacggcgtcggcggagagctggcccgacgtgcggcggcggtggggcccgggcgggatgcggcgtcccgacggaatcatactggtcgagcagatcgccgcggcggtcgaggagggcggcgcgtccgccggcgccggcgccgccgaggcggcgcggcaggtgtggggcctggtggtgcaggcccgcgggatggagtgcgcgtcgtgctacgtgctcgacacctgccgcgtccgctccccggcggggctctgcacccacttctgcctcgccagggcgcagtgcttcggcgaccccctcgagctccagctccgcaacgcctggctcaaccgcctctccggccgccggtagccaccgccgccgccgccgccgcggcgtactaatgtactaaagctaccggccttgatgcgtccgattcttgctgtgaagaagagcaaacgaagcgtgcagattgcaacggaagaacatattcagattctttctttgttttctttcgttccggtttctcccaaatgcggatttgtacagattattggttgcgaatttgcaatttgctacctcgattattccaacgaggagcgattcatcctg

SEQ ID NO: 109 - DNA, 1425 bp, Oryza sativa
ctagtcgcggttcgctcgagaggaacgcggcggagacagcagaggcgagatggcggcggttttcctccgcgccgccgctcgtgccacgaggtcctccgcgctcgtccgcgccatcctcgcgagccggagccccctctcgtcgtcctcctgtgccgcctcccctacgaccgcggcgcccgtccccggcaccgcgccgcgcgccgccgcggctggcgatggcgacgagggatgcgcggcggccgcggccacgcccgcggacgtgggaggggacgaggacgacctgagaagccgcgtcttccggctgcgcctggcgaagcggagcgcgaccgcggcgctcgagaggtgggccggggaaggccgcgccgcgtcggcggcggagctccgcggcatcgcccgcgacctcagccgcgcaggccggtacaagcacgcgctcgaggtagcagagtggatgaagacacatcatgagtccgatttatctgagaatgactacggaatgcgcattgacttgattaccagagtttttggtgctaatgcagctgaagatttttttgagaaacttccagcttgtgtgcaatcactggaagcatatacagctctcctacattcttatgctcgatccaagatgacagacaaagctgagaggctgtttaaaagaatgaaggatgccaacctttccatgaatatccttgtttacaatgaaatgatgaccctgtacatttctgttggtgagcttgataaagttccggtcattgctgaagagctgaaaaggcaaaaattttccccagacctcttcacatacaatctccggatcagcgcttctgcggcatcaatggatctggagggcttcaaaggaatccttgatgagatgtcaaaagatccaaactccaatgaagggtggaagctgtaccagaacctcgctgtgatttacgtcgacgctggtcagcttgttggttcaggaaactcgctggtggaagcagaggcgaagatcagccggagggagtggatcacatacgatttcctcgtaatcttacacaccgggctcggcaaccgggatagaatcaaggacatttggaaatccatgctgatgacttcacagaggatgacgagtcggaactacatctgcgtgctctcatcctacctgatgtgcgggcagctgaaggatgccggggaagtcatcgaccagtggcagcggtcgaaagccccagagttcgacatctctgcctgcaataggctgtttgatgccttcctgaacgccggtttcaccgacacggcaaatagcttcagggaactgatgctgcaaaagagctgtatactgacaagcaggcaagaacgctcttcctgagtggccatccatgctgaaactgttgagtaggattatgtcattacatgatgcaataataatagatactttccagttggttgcta

SEQ ID NO: 110 - DNA, 2178 bp, Oryza sativa
ttccccgacaagccttccgcctctctcctgcctcctccccacttcccttcccgcaccgtggtctcctcctcctcctcctctccacccgcatccgtggctccggttgcgctgctcgggagggagggagggttactaggaggttgctggagcggccgatgagaggggccagcggcggcggcgagggattcgtcggcgcctcttccgtttcaaacaatattagcctaccaaatgagggtactagccctagaggaacagataatgctgaatgttctgagacatcttcagacaggtcgaattcggaaagcataaaacctgaagaatgtgcaatgccatcttcaatatttgataagaagatttccataaaaaagaagctcagattgttaagtcgaatggctatactgaaagatgatggaactgtagaagttgatatccccactaatgctgaggctgcatctcttgacctttcttcaaatgattactgtaatgaagcctttagtggggaaccattggcatcttcagatttccagcacagacctcctatgcaaattgttatgctcattgttggtactagaggagatgtgcagccttttatagctataggaaaacgattgcagatctatggccatcgtgttagactggcaactcatgccaacttcaaggattttgttgtgacggctggcctggagttttatcccctaggcggagacccaaaacttcttgcaggatacatggtgaagaataaagggttcttgcctgcaactccatcagaaatccctatccagcggaaggagattaaagagattatattctccttgcttcctgcttgcaaagatcccgatactgatactggtgctcctttcaatgtaaatgctataatagctaatcctgcagcgtacgggcatgtgcatgtggctgaggctctgaaggtaccaatccacataattttcacaatgccatggacgcctacttgtgaattccctcatcccttctcccgtgtaaaacaacctgcaggatatagactatcataccagattgttgactcctttgtttggcttggtattcgggatattataaatgatcttcggaaaaggaagttgaagttaagaccagttacgtacctaagtagcgcacatgcttattcaaatgatattcctcatgcatatatctggagtccttaccttgtacccaaaccaaaggactggggacccaaaattgacgttgttgggttttgcttcctcgatcttgcttcaaattataaacctcctgaaccccttctcaaatggcttgagagtggtgaaaagcctatttacataggttttggcagccttccaattccagaaccagataagttgacaagaatcatagtggaagcacttgaaattactggacagagaggtatcattaacaagggttggggtggccttggaaatttagaggaacctaaggaatttgtatatgtaatagataacattccacatgactggctttttttgcagtgcaaggctgtggtacaccatggtggtgctgggacaacagctgccagtcttaaggctgcgtgccccactaccatcgtaccattctttggagatcaattcttttggggcaacatggtgcatgctagaggattgggagccccacctgtccctgtggagcaattacaattgcatctactggttgatgcaattaaatttatgatggatccaaaggtgaaggagagagctgttgagctagcaaaagcaattgaatcggaagatggcgttgacggggcagtgaaagcatttttgaaacatctcccacagcccaggagccttgagaagccgcagcctgcaccgccatcgtcaaccttcatgcagccctttctcctccccgtaaagagatgttttggcatcgccacatagtccgttgctctcaagcaatcgtgttaatattttggcaacacaaccaacaaccatgttaaaagagaaatgctctcctatagtttttgttcgtcacagtatagaatgagcggtctcctgcagttttcttcaaacgtggagagattgttcttaccttaatttaacacctgttcagctgttatagcttgattcatgattggtttgtatagcagcggtaacgggctcgtttgtttagccttaattgtacagttggcagtcacaaagaatgttgcttggcactgca

SEQ ID NO: 111 - DNA, 1664 bp, Oryza sativa
ggaggaagaacagttcttcccgtttcccccgggactcaagagagagaaagatagagagagctccatcactcccactcgcataagtacccacccaccaccaccaccaccacgcaagaaccgcaaaggagaagagaaggcggtttccggtgaaaattttggcctctttttcggaagttttttttttcttcccctctcgttctctttttattccaccgctttgtcgttctcgcaatctcgctgtccaccttccccaccccccccccccccccatttactcgatcatcacaacgtgccaatcaattaatcgatcgatcagttttgtgcgtacgtgagcgtgtggagagggagagaaatggacatggaaatcgtggtttttctgaggtaatgtgctggaggaggaagaagaagaagaagaagaagcagctattgttgctgctgctgctttctgggattccgaggaggcgatatgcttcgcaacagatcgaggagatcagtcggtgccaagcaaggaggcgtcaccgccatggcgcagcctgagccgccgccgccgtcatcgcaatcttcgtcgtcgtcttcctcctcttctcccgtgttcccttccccgaggccgttcatggcgctcccgcacccgccgcaggctgggttcttggacggcgccgccgaggggccctcgtcgtcgatgagccccacctccattcttgagaccaagcagttctgctgctcgtccgccatgccgccgttcctgtcggagaggagcctcaggaaggcccacgtggagatggccgccgcaccgccggagccggccggcgtcggcctcgccgacgtgctccgggagcaccacgggggcggcaaggccggcggcggcaaggtggtgttcgggtcgcagctcagaatccaggtgcccacggggagggccgtcgagctggtgtcctccccgatcgagttcggcgtcaagaaccgggacgcccacttggcggcgatgtcgccggcgaggaggttcctgccggaggtggtcagctcgccgtccgcgcgggtgttcgccgccgccgtggtgtcgcccggggagatggccatgtcggaggactacacctgcgtcatctcccgcggccccaacccgaggaccacccacatcttcgacgactgcatcgtcgagagctgcggcgatgtgctcgtggagaaggtggccggcggcggcggcgacggcgacggcgacgcggtgcgaaccaatgggttcctgaactcttgctacgcatgcaacaagcagcttggacatggcaatgacatcttcatctaccgaggtgataaagcattctgcagcagtgagtgccggtaccaggagatgcttttcgacgaggcggtggacaatttgcgctaggctgttgaacgaaatggtcgttccacatgagtatttctatggaggaggaagaagacaatagtcctaaataactgagatgagatttgttttctttctttttttgtttttgttttctccacttttgcgagattggatgctgtttttggccatggagaagggggaatgatttattagtcttttttgcggattaaagacctttgcccacttttgtaagatgttgattattgattgcttggggcatcatgtttttgtgactttcgagttagttgcaatctgatgctttgctcta

SEQ ID NO: 112 - DNA, 2000 bp, Oryza sativa
ggctggctggctcgcctatataaagggggagggaggggcttctcctcttccagcacaagcaagcagcttgaagcaacccaccacagcttccttcttcctctgcttcagcagagcaggggagcagaggagggagaggtcactcattcacaacctcatacagaaggaagaagaagaagaagagaagaagattcacacatacatctatagataaaatatatttatacatatagagaatactcagagagtagccaagagaggaggaagaagaagatggtgttggtggcgattggggtggttgtggcggcggcggtggtggtgagcagcctgctgctgcggtggaacgaggtgcggtacagccggaagcgcggcctgccgccggggacaatggggtggccgctcttcggcgagaccaccgagttcctcaagcagggacccagtttcatgaaggcccggaggctcaggtacgggagcgtgttcaggacgcacatcctggggtgcccgacggtggtgtgtatggaggcggagctgaaccggcgggcgctggccagcgaagggcgcgggttcgtcccgggctacccgcagtcgatgctggacatcctggggcggaacaacatcgccgccgtgcagggccccctccaccgcgccatgcgcggcgccatgctctccctcgtccgccccgccatgatccgctcctccctcctccccaagatcgacgccttcatgcgctcccacctcgccgcctggtcctcctcctcctcctccgccgtcgtcgacatccaggccaagaccaaggagatggccttgctatctgcactcaggcagattgccggcgtctccgctggcccactctctgacgctctcaaggcagagctctacacccttgtgcttggcaccatctccctgcccatcaaccttcctggaaccaactactaccaaggcttcaaggcaaggaagaagcttgttgcaatgctagagcagatgatcgcggaacggcgatcctccggtcaggtacacgacgacatgctggatgcgctcttgaccggtgtcgagggcaccagggagaagctcacagatgagcagatcattgacctgatcatcacccttatatactctggatatgaaaccatgtcgacgacctcgatgatggctgtcaagtacctgtcagaccatcccaaagctcttgagcaactcaggaaagaacattttgatatcaggaaaggtaaagcgcccgaagatgccatcgactggaatgatttcaagtccatgaccttcactcgagctgttatcttcgagacattaagattagctacagttgtgaatgggctgctgaggaaaactacccaagatgttgaaatgaatgggtatgttatcccaaaaggttggagaatatatgtttacacaagggaaataaattatgatccattcctgtaccctgatcccatgacattcaatccatggaggtggctggagaagaacatggaatcacatccacacttcatgctgtttggaggaggtagtcgaatgtgcccggggaaggaagtaggcaccgtagaaattgcaacattccttcactatttcgtgactcaatacagatgggaggaagaaggtaacaacacaatattgaagttcccccgagttgaagctcccaacgggttacatatccgcgttcaagattactgatcctggaacattttgcgaagttagataggaattcaaatcagatagaaaataagagtgcaattctgatgctgctgccctgatgacaggattagaacagccgtttggctcttgtaacatatgtccatgaaaataggaatattatagagataatataggcattataggaccattaggaagctaatgtagattgccatcagatgctcctgtattcttttggtccatcaattgttgaactaaaacagaagtgtcatttggcttctatgcttctgaacatgatagagagttaatagacaccagctgtccataagaacagaacacat

SEQ ID NO: 113 - DNA, 1146 bp, Oryza sativa
gagagtgaccaagtggcaggtggtggccactgggcgagctaaccctgtccacgtctgctcgtcgccatggcctctcgttccttccccagcactgcagccacacacacctgcgactgcgagctccccgtctctcgccaatggcggcgttgtcgtctgcctccttgctccctcctccttccaccttcgtccccgtcctctcgccactccgcaagccgccgccccagcacctcgccatccgcggctccccccaccgccgtcgcggccgccgcctctcgctcgccgcttcctccgccgcctcaccggacttagagaaggagccctcgcaatcgccctcgccctcgccgcaggagaaatcccctggtgatctgtcggccgtggcggagagcgtgaaggtgctgaaggaggcggccaagacgaggaaggtgccgtcgccggagttgctcgcggcattggccaagatcaagaaggcaaagctcgacacatccaccttcttcgagaccctcggtgggacacagtccccgggcaggacatggatgctcatcttcactgctaagggtcggctggagaaaggacagtacttcccagtgaccgcagtccagcgctttgatgctgcaggaaagaggattgagaatggcgtgtatttggggcctgttgggtccttaacctttgaggggaggctgtcatggaagaagaagatactcgcattcatcttcgagcgggttcgcataaaggtcggccctttcggccccctcgaaatcagcctcggaggtggcaatgatggtagggagccgagcacaaaggaccctttctttgtgtggttctatgttgatgaggaaatcgctgtggcacaaggcagaggagggggagtggcttactggtgcagatgtaagcgtgttccatgaactctgaagattcagttcagtcatcattccaggatgttcagttcagtttatgtatagataatttttcatcttctacatgtgtaaaaaaacgaagtattgaaaatgataccagttcgatgatgtctgcctgtacctgtaaattgtgttggtatagaatgccaaacgattgagcatagatgcaaagcatatggagtatattatgagataattgaccatcatccccttgtgattactgaacccggcg

SEQ ID NO: 114 - DNA, 1120 bp, Oryza sativa
cgattctagtggagtattattcggcgcccggtgcatctgcgcgatggattacgagtggtaactccgatttcctcgccggcgcagcgccgcaggttgggtttcttcctgcgcaagttggtgtcgccgcgagctgaagccgagccgtccgctcgttctctcgcttcgctcgctcgctcgcgtccctcccaaattcccccaaaataattggaaccccactccgccaccggtgcggccgcggcggcgccgagatcggagagagagagagatggtggtgcggcggctgggcggcgccggccgcgcgctgctgtcccgccaggcgctctcgctgcccaacctccgccgccgcgcgtccaactcctgggccgccgtgcgcgacaccttcttctccaccaaggaagtgttcgagagccaccgcgtcgtgttcaccgtcggcacatccatcgcctccgtcctcaccgcatgggccggttattctttgcggcacatgcaacaatcaaggattgataagagacttaactcaattgaacaatctctgaaggatactcacaaagtcgaacatgaagagattaaaaagattgtcacttccagtaatatcagcactccagcctgtgtagccactgcattgacaacttcagttgtcgggtatgcgctagggtggcggggtggagcctggtacgctcggagaggcttccgaagagagcaacagaagctgatgggccaaatcaattcacaccacagatggcactggcggcctttcagtaaactcaaaaacagactcagaaggaaccgaccagcggccaagactgtcgaggcccctcggttgacaggcgaaagcaccatctgaaaatgttaacagtaactctcaggcagcaggatgtgcatgattcctctgaaatacagatgaacatcgatgcccatgtgcctgagaatagaaaccaaagaagcctgttcatatgactggcagacgttccaaattttgcaggattggaacatccttttcaataagattaggatcggaactagggagattatcttcctaattctcataggaaaatgccttgcgctgatgttaccgtttactactagccaggctgatatttgtcatttttgtcatgctgtt

SEQ ID NO: 115 - DNA, 2489 bp, Oryza sativa
ccccatgtcagtgactgcagccccacctccaaaaaaatccgtaactctcgcctcaccggccaccgctcctcccccccacatgagcggcgatgacgtcgagggttctcgtctcctcctcctcctcctcctcctccgccgccgccgccgcattcctgccgcgaattccgaacccctgcgcgaaccctagccaccgcggcgcgcctccttgcggggcggcgctctggcggcaccattctggccgtgcggtcaccacggccgcggccgccgccgccaccggcgaccactggggcgctgagtaccacggcggcggaggcgggcgcggcgggaagagcgccgcgggccccggcgtgcagtgcgacgtggacgtggtgtcgtggcgcgagcggcgggtgttcgcgtccgtggcggtggccgccgacgtcgacaccgtgtggcgcgtcatcaccgactacgagcggctcgccgaattcatccccaacctcgttcacagtgggaggattccatgcccgcatcagggccgagtatggctcgagcagagggggctgcagcaagcgctttactggcatatcgaggcacgcgtcgtgttggatctcaaggaggttccggatgctgttaatggacgagagctccacttctccatggttgatggtgactttaagaagttcgaagggaaatggtccatcagatctggtccaaggtcatctagtgcaattttgttgtatgaagttaatgtgattccaagatttaatttcccagcaatatttcttgagaggatcataaggtcggatcttcctgtgaatcttggagcgttggcctgtagagctgaaaacatatatttaggaaaccaaagacatggaactgcaaaatttagtggtgcaggctccaggtttcataacttccgtaatgcaaccactgagaatgatgccattgctcctagtaagttcaaagaaacacctccttctggtcttggtggtgtgcttgcttcacctccttctgagttgaacagcaaatggggagtatatggaaatgtctgcagacttgataggccgtgtgtggtagatgagatccatcttcgaagatttgatggtctcctggaacatgaaggggctcacaggtttgtgtttgctagtatcactgtgaaagcgccagtgcgagaagtatggaatattctcactgcatatgagaagttgcctgaatttgtgccgaatctggctatcagtaggattattcgtcgggataataacaaggttcgcatactgcaggagggttgcaagggtctactttatatggtgcttcatgcccgtgttgttatggatcttcgcgagaaacttgaacgtgagataagctttgagcaagttgaaggtgatttctactcatttaaaggaaaatggcgcctagaacaacttggtgatcagcacaccttattgaagtatatggttgagactaagatgcataaagatacctttctctcagagtctatccttgaagaggtcatatatgaagatcttccatcaaacttatgtgcaatccgtgattatattgaaaaggcagaagctgagagcggtaactccacaagtagctctattgtagcatcaaatgcagatactattgctattgattatgcagaaggtaggcaatcagaacaagcatccacgtcatgttcttcgagtcctgtgaagcagagaccaaaagtcccaggccttcaaaaggacattgaggtcctcaaatctgaacttgagaaatttattgcaaaatatggtcaggatggcttcatgcctaagagaaaacaccttcgtttgcatggaagggtggatatcgagaaggcaataacacgcatgggtgggttcaggaagattgccagcataatgaatctttcactttcttataaaaaccggaaaccaagaggttattgggataatctggagaacttgcaagaagagatcaggcgattccagaagaattgggggatggaccctgcttatatgccaagtagaaagtcctttgagagagcaggacgttatgacattgctcgggcgttggaaaaatggggtggagtacacgaggtttctcgccttctttctcttgaactcagacgacctagaaggcgagccaactctgatgatgagagtaaggctggatcctcatatgccataacaaataaacacgcaagcaagccaaacaaaccaagcgtttctccggacaaacagaaatggctcctgaagctgaaggatctggatgctaattggattgagtactaactaggaggacttcactaatacggtccttcaaatttatcatctgacttcaatgaagaaggatctgataatcatgtacagataaaggtgggcaagtttcttgcctacaatactggattacaacactgtaagttttccacgcaaaactccccgctctgtaaagtattccacagcttttcttcgttatctgtcctttttcttcaaaagaaaatttgaagtgcttgggtctttctg

SEQ ID NO: 116 - DNA, 2385 bp, Oryza sativa
gtctactactcccccatcgccatcgtctcccacacctccgaattccgaatccctcctcacttgctccctgcactgcagtgcaccaagcagcagcagcagcagcgacacggcgacgtggtgctattaatttcgtcgccgccgtctcgcgcagctgccaggccaccactgtgcgcgcgatgctctttgccccccgcgaagacgagcagcggcagcagcttccatgcttggcgattcgatgccatgtaggaagacgaagatgatgaagctagcgtagcctagtgatggctcaacccgccatggaagggacggtgcagggtggaggaggaggaggaggaggagcacaagaacctcgcggacagtacggcggaggcggcaagaacggcggcgacgcctccccgcgcaagcatgccgctgccgctgccgctgccgccttgccgcgacaccggcgatccaagagtgcttcttccgatcggagcctggagccatgcaagcacgcggcgttgcacgatcagcgctgcacccaagcagcacaggcgacgccgagctctcatcaccaaccggacgcgacgacgaggaaatcccacgccgccgccgccgccgccgccgagggctcctccatccaccatgtactgacgagagatcgcagcagggcgagcgcgtcgccgaaccatcgcgtctcgctggagaatgatatcaggcagctgcagcttaacctgcatcaggagaggtcgatccggatcatgcttgaccgggcgattggccgcgcatccagcactctgtctcctggccacatgcatttcccagctcagacaaaggaactgattgcagagattgaattgcttgaagaggaaatcgcaaaccgtgagcagcatgttcttaccctctacagaagcatcttcgatcaatctgcgtctggagcatcctcagggcagagttctggtctttcttccccagcgcataccaagagtatcagctctagaacaagacggcatccgagcataatatcgagtgcattttgctcatctaagaagctcccgctccaacctttccaaatcatgacatcggtatcggagtcggggagatcgaagagtatgctgaaaaccaagattaagcatgaatctttctcaagtgaaacattggatattcaccctgcaaccttcccaccagatccaaggaagcttccttattcaggaagtagttctttgactcggaccctgaaagatcacctctaccaatgtccaagcaaaatatccgaagaaatggttagatgcatggcctccatatactgtcttcttcgcaccgagtgtcccgaaaaccctgaaaaggtccgttcaccattcttgtcgaggtcatcaacaaatgtcattcttcctcggagaggaaacggagaggacactaatttgtcaaacaccaaatgtacggtggaagtatcttcaatatcagctgataagaatcacatgccagatgtctcttatgcaattacgcactacaggttgcttgtggagcagcttgaaagggttgatctgagtatgtcagaaaccaatattaaattggccttctggatcaatgtgtataattctcttgtcatgcatgcatatctagcatatggcattccaaacagttctctgaaaagaatggctctatttcacaaggctgcctacaatattggaggccatgcagtcacggccaattccatcgaacacgctctactatgctgcagatctccacggattggtcgttggtttgaatccatactgtcgacggcgatgcggaagaaatgcgcagatgagaagcaactcgtccagctcaaattcggcctgccggactgccagcctctcgccctgttcgctctgtgcacaggagcttcatctgatcccatgctgaaggtgtacacggcgaagaacatcagtgaggagctggagcgtgcgaagcgggagttcctgcaggcgagcgtggtggtgaggaagtccaagaaggtgttcctgccgcgcctcgtcgagcggtacgcccgggaggccggcctcgccggcgccgacgagctcctcgcgtgggcgcgcgacaacgccgacgcccgcgccacccaggacgccatccagcggctgtgcgtcgacgccggcggcggccggaggaaggcagcgcaggccgtcgagtggctcccctacaacgccaggttccgctacgccttcccccggaccatggtcgacaagccactcttctgagcaagaaacaagcgtacattctgatgctccaatgtttcgcgctgcattgttgttttgtgatcttgagatgaagaattgaagatgagatgagatcagtgacaaagttcagaagtgctacatctatttttgctgtgccgtgtacagaattggattgttgctaatatct

SEQ ID NO: 117 - DNA, 1264 bp, Oryza sativa
agatgtggctaatctgtttatctctatcaagagaacacaactactacttgccactgaagagtggctgcttgcaggcttggcttgcagctggggagagagcatgagcagcggcggcgtcggcggcgggagcttgggcgccggcttgctgtaccacaagttcgtcagcttcgcgctggaggagacccgactccggaccaccctcacccctcacccctcccaggaaaagttcaagtctataaaacccaatgatgataatacagttttcaatgctctctcattcagtgcaccgaaaattagattgcttcgcagcttgacaatcgagaagaaaaactcatatcaggttcttgactttgccgctttctctgaacctgaatacgatcttcctatattttgcgccaacgtttttacaactcatgcacaaagtattgttgtattggacctcaatcctctatatgatactacagtgcacaaggattacaaagataagtactataggagtataatgcctcttgtacacaagtataacgagcttcttccttggggtggcaagattacgagtgagtcattgaagttcttctctccaattgtgatctggacaatatttgagtcaactgaacacaaccaccatgttctacattcagctttcgtggattattataaggtctggcttgaattaatggaccaagcaattaaagaaaataacaaagcaacaattgctcgtaaccaagaagaacaacataaatatctcacatggagggctgagaaggatcctggctatccccttttgaagaagttaattggtgaaagtcgtgccgaggatctggtgatggagtttctgtttgaaggagtaaatactcttggaacaaaatcatttctggattatttccctgaatacgcccgtgatgatgggtcagtgaacaagaaaaggagtatgatcggcaagtcttttgaaactaggccttgggacgccaatggagaattcattggcgatgccgaagcacagtaaaatgttcgctacgcctttcggcctgatcaatctctcttatgcttgtagtactgttttctttttttttagaaaacttacatttttcatgctcatatccctgaacttggattgaataagaagagattggtgaatctgagtcatgtattattgttctccggttgcactgattgtcgttgttagacgatggtctctgctcctggtagtagacatgatctgaaacaagaggggtcatcctgccctgcccggattaggatcctc

SEQ ID NO: 118 - DNA, 4129 bp, Oryza sativa
ctcacattatgctaaattgcattagaaaaagggagcaaagtcctcctccctcatatggtggtgacatcttgcaaacctgtacactgcctggcctcaaagtctcctctcctttctcacccatttttctgagcttcacatcacaagtcttccttccttccttccttgtcgtctgctagttactccatgtcacactagtctcacacaggagcagcaacaagaagaggaagaataggtggaggaggaggaaggccgttcttggtgcttgtgcagcagcttcttgcactcacacttgttctccagtgaggccattgatgttcctgatgctcacacagtcacaagatcccctccctctgggctggttcattcattcagagaagatttgctgagatgttcttgttggtgtgcttgagctggtagcaagggcgccactggttggtggctccacctccctgcattcctggaatttcttgggatttctcctcctcttgaggcggtggtggttgctgagatgccggccaagtacttgcagatgctcggggaggagaggcggccggagcttcaccggcagcaggcggggtgcgtcaccgggatcctgcaggcgttcgaccgccggtatcccctcgccgcccaccattcccacaatcgccttcttcccccagcccatgcactgtcaagcagtccaagtgttggggaagagcgaacaagatattcatctcagattgttcttgacaagaacatgagtaaaagctggatcgataatcaaagagcaccattaacagtggagttgtcgcaaggatcttattcatcgtcgtcttgttcttcgtcgtcctcccttgatggaaacagatcaggacagcaagacctatcctccactgatcgaatgctatttccggagaagccattcaaaagctcaccgaagctcaagagctcttctgacagtgactgtggagtggattactaccttgatgatgcccttgccaagctctcagcccaacctagctacccaactcttggtataagaaatctcgtaaaggattcaatatatagagatactcgtgatttttcaatcagaactttcaccaaagaggcagaaaaagatcacctattcaattgtggagatccgcctagaatcttgaatgagcctcctaacagtgctatccaagagaaaaacaaaggaaccatggacattgacgaatccctccgagttttagccaagctcaggaatccatctgaatcagtccagcaaccaaggctatcatatgatgctcctcgcttctcgtgtgaaggaagggaatcagcgtcaaaacttagggaggtgccaagattgtcactagacataaaggaaagccctcttaggaaccgcgaaatcgacgtaaggccaaagccaagcatgactgatgaagacaggagaagcagcatcagtaaagattacagtccacccttggagacccagcaagaacacaatgcctgtaaacgtctccctagcgttgttgcgaaactcatggggttggaagacttgccagagcataaggacaatactgcgatatcttcacaggtatccaaatcagttacagagaggagtgaagaacccaccatgctgaggcctttgagcctttcttcccaaaatgaggctactcctaggcagcagaggaatctagatgcaacaatcaagaatgttcctaactctaagttccctgtggaaactgcaccttggaaacagcaggagaagattgtgctacctagaaaattgccgaagggatcaaagggagctcatggaaaagagcaacatgctgcatcagtttacagtgagatagagaaacggctcaaggaccttgattttcagcaatcgaacaaggatctcagggcactcaagcagatcctggactcgatgcaagcgaaagggttgttgcagaacaagaaacgtgaggaaccatcgatgccgaagatatatgatggagaccatgataacggagatgtgactgatgtaaacctgagactgaatagcaccagcaacaccaaacaggcacctgaaggaaccccatcatttacaacggaagaagatagcactacagaaagaagcttcaaatcacccattgtaatcatgaagcctgcaaaatctgcagacctgttaagtgatgtaaccgaggattccgctgttggtccattaggcggtttatcagagctaccgcagctgagaacagccaatagtgctgataaaaggaaaagctcaaagaaggtcactagggaagctgtggagcaacataccaaatctagttcaagggcacctacacctcaacaccttgcttcttttgacaagagagcaaatggaaggaatgaagaaattagcaggaaacagaagtctacttcacagctgatgactgagaactcagctaggagacagcagatgcaaagagaaaataatggaagcttgctaaagcataaaaattccactagccctagagtacaacagaaaaaacctgattcagagcggagggccagaccgccaattccctctcccgattcaagcaagaatcaaaggcaatctgtggaaaggagccatttggattcagtatcacccagaagtaaatttagaagaaaacctgctcaagcacaaggtgaagatttccatcaaaatggtgtaagtagaaggacaaggagcctgaaccaggaaggcaatgatatgtccgcaaggtcagatggtagcataagtgttgcatcagagctggatgtagaagtgacaagtacagacagatctgcagaagttaacattttgagatctcagcatggcactcaaacaccatcaggaaggaatcctcaaaaagtgaaaacctcttatgatgcaaacaaggacctgccatctatggatcctgcagcaactattactgagcggcctagtccagtctctgtattggactcttcgtttgatcaggaggaatttttccataccagcaagaccacaaattcatctaatgttgatgatgagcatcacccatcaccatcagaagagtcctgcaagccttctgaaaagaagtccacagagctccccacacaacccaagaacagcaagctcgcaaacatagccagcctccttaagaagctccagcaattgagcgtaaacaaggatgaggcacctcctgtcgatcacattgccttcttgtgcgagacgccaagcccagaccatcgctacgtatccgagattctactggcgtcagggcttctgatgaaagaccttggttcagggctgtcacaaatgcagctccacacatcaggctaccccatcaaccctgacctgttctttgttcttgagcaacgaaaatctgggtggacatccaaacctgaggggatccatcagagcaggagcaccacaaagccagatgatcccaagagagcgcaccggaagctaatgttcgaggcggtgaacgagcttctccttgacaagtttgagaaggaaaccacactcatcactggagtagcagcaagggatccagtgatgagcagcgggcagcagctggtgaagatgatatgctccggcatcgaatgcctgaagacggagagatcgcgcatgtgccaagaagacagcagcgtgatccctgacgcagagatcctcaacaggttggaagggtggtcgccgagcttcatcaggagggagcttccaggcatggtgctggagatcgagaggtcgatattcaaggagctcgtcgacgaggtggtgcgcggcgagtccgccgacggtcagccggcgaaggccggaaggcgcagaaggaggctcttcgcttgacagtcactagtgatggctgctgacttgcattggagtgcgaagcgtgaagcgagtgtaactgtgatactgtacctagtagtagcatgtccattgttgaggtttgatttgtccagagagagagagagagagagaggaggaagagcaatgcagaaacctgaagtaggaatgcaatgtttgaggcacttgcctagttgttgttctgcgataaatattataagtgaaattataacctgagacactggcagttttcttgcattgtgttactgtacttttgtttttgacattttacatcttatcgctggagtagcagcaatggatccaagtgatgagcagcaagggatccagttttct

SEQ ID NO: 119 - DNA, 2080 bp, Oryza sativa
cggggtcggtaataactaacccgagacagggagagagacgagaccgaccgacgccgcgggcttagtccagtggaaggtgttcgtccactcgcgctcgcactcccgccgttacgcgcgcgcgcgccgccgccgccccgacctcgccgcgcgcgccgacgaacctagatgcggtgatgggaagaaggggcgcgggcgcgggcgctgcggtggtggtggtcgcggccttcgtggcggcggccgtggcgtcgggggacacgctcgccgatctcggcggcgccgccaaggggatcgacagcgtgccagaagtgaataacttgggaccatgggcgaaggggcttctgaaagggatgccggactcggcggcagggccagcagagggccccatcgcaaagtatccgctggttctggcagaggagaggacgcggcggccggatgttcttgaccaccttaggatgtatggaggagggtggaacatcactaacaagcactattgggcgtctgtttcattcacaggaattgctgggtttgttcttgctgctgggtggtttatttcgtttggaattgctgtagctgcaagctgcttttggaaatcaagaatagacaaagaaaatgattttcatgcagatatactgcgccttgtgttgcttgtggtcttcatatttactttaacggctggatctgttatcctcttttgtggacagagtaaattcggacaagaagctactagcactgtcgattttgttgtgaatcaatctgatttcaccattcagacgctaaggaatgttaccgattacttatcgcttgcaaagacaatcagtgtggcagcactctatcttccttcagatgtacaagggcaaattgacaatttgaaagtggacttaaataaagcggctgatactatatcccaaaagacatcagaaaactacagaaggataagaaaagttctccataacttgtcagttgctttgatttgcatagctgcgttgatgcctgttcttgcattcttgggatatgttttggagctgtatggacaaagaagtacagtttatgtatttgttaccttatgctggacagtagtggcaactctcttcattcttctagggattttcctgatattgaacagtgctgcaaaggatacctgtgaagcaatggatgaatgggcacaacatcctcaagcagagacagctctcagcaacatccttccatgtgtagatgaaagcacaaccaatcaaaccttgtaccagagtaaacatgttgtggtaattcttgtaggcatagttaatagggctatatctgctctttcaaatcgaaggccacatcataaacatcctgggcagttcatgccttacctgtgttctccctatgatgcgaacctgactgatcggcagtgcaagtctagggaggtcaccttcgataatgcaaccacagcatggctgaactatacatgcacagttcctgactcagatttgtgctctggccccagaaccataactccagagatatacagtcagcttgttttagctgccaatgtaagctatgctctgtaccattatgcccctctcatgctcaatctccaggactgcaagttcgtccgcaacacattcagctccatcgcttcgcagtactgccctcctatatggcgcgacctcagcttggtctcagcaggcctggctctcattgcctctggcttaacacttggcctcctcttgatgctttttgcggaccgcccccaaagggaggaggtgtccgagctgccatcagggtcaaggatcaccccagtagactgctctccatgacgagctcagtctctatggtcattcagactagtatagcaattgcctgtaatagttaggaaaagaagaaggtgaagcactggggcaaagccccattttgcagtggagatgatctaggtggatgagtgcttccttccgtggtatacatggtatgtttcagggaatagttgtaaaggctaatgcctaatggcaaacaaaatttgggcaaaaccccactatgatatgaagagcaatgttctgtatcccctatgattgttcagctggacatgtttctttcttatgtacat

SEQ ID NO: 120 - DNA, 720 bp, Oryza sativa
ctgggcagccggtctcgtctttatatataccaccactcgcttcccttctctcctcacattacccccggccgcaccacccccttcttctccaacctcttgcagctgcagacacaatcgttaaatcgcgatcaccgcagcaagccatgtcgtcgcagcggcccggccgtcaccagcggagggcgtcgcagagcgtgttcgtgctcccggataacttcgccgacctcgacgacgtgccggccggcgccggcggcgccggcgaggacggccggaagggcgccgccgcgacggcggacgcggccggcgggcagcagcaggctcgcccatcgccggcggcgcgccaccggagggcgatgtcggtggccgtggcgtcgtccagggagctggagatgatcaaggaggacatgggcagctacaagatcggcgcctgatgcagcatcgatcgcacacacaggggcgccgtgcttagtacttgcggctaaatcgtcatgtgtatggccggttaattttcgtggttaagcgcggcacgcgtcgcgtcaaccgatgtctcgcttgttctctctcttcttcttcttcttcttcttcttcttcttcttcttcttcttcttcttcttcttcttcttcttttctctcttttggtgaggacatgtaagatgggagatgtaatcttatgcttcctttttccacacgatgactgaatgaatcactaaaatgtgtgaactc

SEQ ID NO: 121 - DNA, 909 bp, Oryza sativa
gtccagacaacaatatgggcttcagatgggccgtaaaaatgcaggcccaccttaattttaggcccataacaactctacattgctttcctcctccgtcgattcgtccgccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccggtccaggagatggaggcggcttacaagttcgggccgtacaagatcgacgcgagggaggtgttccactccacgccgctgtcctacgccatggtcaacctccgcccactcctccctggtcatgttctagtgtgccccaagcgtgaagtgaaacgatttgctgatctaagttctaatgagattagtgacttatgggttaccgcaaaggaagttggtatacggcttgaacagtaccacaaagcgtcttcacttacatttgctattcaggatggtccacaagctggtcaaactgttccacatgtccacatccatgtcatccctagaaagaaaggagattttgagaaaaatgatgagatatatgatgcgattgatgtcaaagagagggaattgaaggagaaacttgatctggacatagagagaaaagatagaaccatgaaagaaatggctcatgaggccaatgagtaccgtggtctcttctcttagatgtaatttttgcgataaatttcttgtaaactatctctaaattgcagttactcttctccagaaattatttttgtaactgtttgtcatccatcatgggaattcaagtcttcgaatgatattatgaaattatctaatttggtacgat

SEQ ID NO: 122 - DNA, 720 bp, Oryza sativa
caagttttccccatatatacggttagcaactccctgaaataaaaaatcatcttgcaagtgttgggctggattccggcccaaaacgagttgctgcacggcccaacgtctatagatatttctgcccattactgccgatgtggactctattcaggccaaagaaaaaagaaaaaaaaatccaaagccccgcaacgctgagcagagagaggaagaggaagaggaagaaggcatcatggcgacggcgaaggcagccacggcgccccccacccaccgcgcgtcgtcgccggcggcggcgtccccgccgtaccccagcgccgccaggatcgccgactccgactgcttcccccagtacaccgcctccctcaagtgtttggaggccaaccaagacaagagcaagtgccagcagcagttcgacgactataaggagtgcaaaaagagagagagggaggctcggcttgaacgaaacaagggtcggtcattatttggttgagcagtacagaggaccgatgtgcgataagatgttagtctgaagcacgtgaacggatgacttttatttcctgatgttcctttagcttgtgaagttagaaacagtagagaattctctgcctctccgggttcagtgtgaaatgtaaggtttgagacgataatttactgtttggtcgtgaccaaatttcccaaataaatggtatttccagaacgattgcataatcctggatctttgac

SEQ ID NO: 123 - DNA, 874 bp, Oryza sativa
attgccaccaccagcagcagctcgccatccaagcatcaaagcttctaaactgaagcttaatctatatataaggagagttcattttgattttggtgaggaagaagtagtagaagtgaattagtgatatcgatcagagtgtgaagaagatgtctctggtgaagctgtttgatacgttggcgttcgacgcctggaacccgttcagcatctttgggacgacggtggcggcggacgcgtggctggcgagcgacacgtcggcgttcgccaacacgtacatcgagagccgggagacggcggaggcgtacgtgttccgggcggacctgccggcgggggtgaagaaggaggaggtgcgggtggaggtggacgaggggaacgtgctggtgatcaccggcgagcgcagcgtccggcgggaggagaagggccagcggtcgcaccacatcgagcgcagctgcgccaccttcttcggcaggttccacctccccgacgacgccgtcgtcgacctcgtcagggcgtccatggacggcggcatgctcaccgtcaccgtgcccaaggtggtcactgacaagcagcccgccatcgccgccgccgcacccgtccccgccgtcgtcgcacccgctgtcgaggcgaaggcaatcgaagccagcccgtagtgatgcgatgaacacacacacacacacacagacagtcagtcaatccaacgatccgtatgtatacgttgtcgtcgatgataagttcaaagtgcttgcgagtaaggtgcttgctgtacttttggtttaattacctttggtgtgaaatgctttctcgatgtaagacaagaaagctagtagcaaaatcatactatttgcttgatgcaatacatgttccatcttagttccct

SEQ ID NO: 124 - DNA, 1053 bp, Oryza sativa
acagtctcactgagccactagcccaccaccaccctcatcctcctcccagctcacaaaaacctcaaacccccagccttctcgggcctccacagaaagccgaggaagagaaaaaaaaaatggagctcttcgtctccaccgtcgcctccgcgcgcgccaccgcccccttatgcttcgcctcctccttccaccaccgccgcgctgctcctcccgccgtcgccgccgccgccaccctccgccgcagcaaccgccacctcccgactcgaggatggcggtgcgcgagcgcggcggcgccggacccggtgccatcggaggagcccgcgtcggcgtcggcgtccaccgtcgtcgtcacggaggacaagcccgatccgccgccggcggaggagaagagcgaggaggtcgcggcggtctctaatggcgggtctctggagaccgtggcggcggcgccggtgtcgtcgggggcagccgaggaggacggcggcttggatgacatcctcagcaagctggacatccaagtgacaccaactcttgtcctctatggatccggtgctttggttgtcctatgggttctatcttcagttgtttctgcaatcgattccattcccttggttccaaaagttcttgaactcataggaactggttactcaatttggttcacttcacggtacctcctcttcaaggaaagcagggacaaactgtttgcgaaattcgaagatctgaaagagaggattatttgagctcacgatgaatgatcctatggtgtatgttaggcttcgcagccaacttattattaggtcttcttttttctattactgaaagggaaaaaagttgtgtatgtaagccacgtttctttcgcttcaaatatgatcagacatccatagatttttgtttgttagagcggagcttgctcaagtctttctggtttttttaccacttgatccgatgtatatactccatactgaaagtgccgccaactgtgaagctgtgtaccttggatacataataatatatcaaatgggtcgaccttcatatttggtaaattgcttcagcacataa

SEQ ID NO: 125 - DNA, 832 bp, Oryza sativa
gcagctgaaggcttgagcatcgcagtatcgcactcgtggaatctcctcccgtcccatctcctctccaccggcgatgcagcagatgaggtccgccgccgccgccccctgctccctcgccgccatgctcctccgccgcttcgcctacacctcctactcctcctcctgtgggcccatccgccgtcacgccgccgttgccctctcctccaccaccaccaccaccaccaggttcgccgcctggtcccctcctcctccttcgggcggcgccaggagcagggggttcgctgcctgggcgtcggcgcccgggccggcggggtccacggattcccccgccatgcaggcgctggagaccaagatcaaggagcagctggaggcggacacggtcaccgtcgtcgacacatctggcgacggccgccatgtctgcatagatgtagtttccaaggtattcgaagggaagtctgccgtaaatcggcagagaatggtttacaaggctatatgggaggagctccaaagcaccgtgcatgctgtggaccaaatgacgaccaagacgccttctgaggctgctgccaaccagtagcaagcatctgcttgagataaatttggagtgccacagtgggaactgttgtactgggacctgaccattgccgagagggatcacgattctttatatgtacacaactgaatggttaatattttttttttgatacgattggcatggcttcaagcgttcagaaatatattctatggtagtcttaggatttacctttcagatttccagggcaggaaaattttgaatatttttaggcaacaatattttgatgttatggtgcccaaa

SEQ ID NO: 126 - DNA, 1148 bp, Sorghum bicolor
gagagtgtgctgtgtgttatccatttcttctcctctgctctgctcgccgccgccgctcccgctgccgctgctgcagtccagttcggtagttatggcggccgggagtgccagtgccacggcgtctctctccgtggcggcggcagcggctgctgctctgcgcgtcaggcggccatgcgctcgcgctcgcgcttgggccccctcgcagcggccgcagcaaggggcactcctcagcctcaagccttgcgcctcactggcaccacacgcgcctctgtggcgggcggagtcggatgccgcgggcggtggtgccggcgccggcgacgtcatgggcctccttctccgggagcgcatagtcttcctcggcaacgagatcgaggacttcctcgcggacgccgtcgtcagccagctcctcctcctcgacgccatcgatccggactctgacatccgcctcttcgtcaactcaccaggggggtccctcagtgcaacaatggccatctatgatgtaatgcagcttgtgagggcggatgtctccactattggaatgggcatagctggatcaacagcttctataatccttggtggtggcacgaagggcaagcgatttgccatgcccaacaccaggattatgatccatcagcctgtcggaggtgcaagtgggcaggccctagatgtagaggtccaagcgaaggagatattgacgaacaagaggaatgtcattcggatcgtgtcaggcttcacgggccgcactctggagcaggtagagaaagatattgacagagatcgttacatgggccctcttgaggctgttgattatggacttattgatggtgtgatcgatggagacagtatcatcccacttgagcctgtcccagagagggtgaagcctaagtataactatgaagagctgtacaaggacccacagaagtttcttacaccagatgtcccagatgatgagatatactagtctaaaagttgtattttctacgaatcttaagtctgttgttctgcaaacagttgcttttgatcgcttgtagctgtcaaacaaatttagcactagcagtagcttattgatctggtttactgcctattttactgactgaatgttgattcgagctggcaactagaaccagttggttgtgtttgtgtttgcc

SEQ ID NO: 127 - DNA, 2026 bp, Sorghum bicolor
cgacctatatgtaaaccacccgcccgcttccaccctacgccacagaaaaaacgcaggtgccaaacacagagaatcaaacgctccgcagcgaattcaattttgaaagccccagagagcttccatggcttccgctaccacctccatctcatcgcaccctgccgccctccgcgatgtcgtccaagctgcgaggattggcgcgctgaggcagcaggtgggcgtggccccggcggcggcgcgcggccagcgcgctcgcgcggtgcgcccgctgcgcgcggcggagcccgcgaggcagccggtggcggcctccgcggccgcggcggcgccggccgcgcccatggccgacgaggctgcggcggccctcgcggcggtggactacgaggccctggcgcgtgagctggatggcgcgtcgccgctggagatcatggatcgggcgctggccatgttcggctccgaaatcgccatcgccttcagcggtgctgaggacgtggcgctgatcgagtacgccaagctgacggggcgtccgttccgggtgttcagcctggacacgggtcgtctcaacccggagacgtaccagttcttcgaccaggtggagaagcactacggcatccgcatcgagtacatgttcccggacgcgagcgaggtgcaggagctggtgcgcaccaagggcctcttctccttctacgacgacggccaccaggagtgctgccgggtgcgcaaggtgcggcccctgcgcagggcgctcaaggggctcagggcatggatcaccggccagaggaaggaccagtcccccggcaccagggccagcatccccctggtccaggtcgacccttccttcgaaggcctggatggcggagctggtagcttgatcaagtggaaccctgtggccaacgtcgacggcaaggacatctggacgttcctaaggaccatggacgtccctgtcaacaccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggaaacatcgagaaggacggccaggcggcggcccccaggtccgccaacggcaacggctcggcgggcgccccggacatcttcgagagccccgccgtggtgtccctcacccgcgccgggatcgagaacctgctgcgcctggagaaccgcgccgagccgtggctcgtggtgctgtacgcgccctggtgccccttctgccaggccatggaggcctcctacgtggagctggccgagaagctggcgggctccggcgtcaaggtggccaagttccgcgccgacggcgagcagaagccgttcgcgcaggccgagctgcagctgcagagcttccccaccgtgctcctgttcccgagccgcacccccaggcccatcaagtacccgtcggagaagagggacgtcgactcgctcctcgccttcgtcaacagcctccggtgaggccgccagtgagcgagaaccatcgttctctgtcagtatgtacttgtaccgtgttatgttggcgtccatcttaggtgctgtatgtagagactagagagggagatgggagggaattgggatgatagaaacacatggaggggattcaggaaaaaaaaacagatgcaggttatccagacaaaaaaaaatccagatgcaggcgttgcatgtttagtttatgtaactgcagaaggagtctgaggtcctgtgttatttgggagctgagaggaagaggttatttgtgtgtgcttatagctagtggcgagtggccatagagtattggaaggaaaatcaaataagataatcaaataagaatcgaagttctgagagttcttgtttgttcatgttggttgtcaactatgtagacagtacaaagcgaaggttttgcataatttatttatttagagtttgtgcgtcgcttcatcaggttcctacacatgtttttttatttattctttcaattaattagtttccttgcattgccca

SEQ ID NO: 128 - DNA, 1117 bp, Sorghum bicolor
tgcgcaaaacacctcgctttttgtactcttccgtctttgccctcccgctatcgctcgcctgcgttgcgttgcgttgcgttgctcggcgtacgtacgtgtacacacagcgcgagcccgagagggaggaagagcaacagaggaaagaaaaaaaaaagaaaagaaaggaaagccaagtcgtttgctcatttcatggagagctcttctcacaagcgggcgcgggaggtggtggacctcaccgccgccgggcccggagaggcagccgcgttgccggaggcggacgcgaagaggctgcggccgcaggatctcctggacatgctcgatgacgacaccgacgcggccgccgccggcgacctagcgtccgtcatgaggagcctggaggaggagatagctagcttcgacgaggccgtgggggccgcggaagcggcgcctacgcagcagcagcagcagccggagctggggttcctgctggaggcctcggacgacgagctggggctgccaccggctggcgcctccgcctcgtcgtcggaggaggccggcggcggcggcgggggcctcgccggggcgccgccggagtccgccgagctggacggcggccagatctggggcttcgaggacgagatagacggtggagcgggcttcggtggctactcgccggaggcggccgccgcggccgtcgccgccgcggcggcgtgggacgacgacggcttcgacgccggcctgttcgcgttcggcgaaagcgacgcgtacgggccgtcggatctcgccgcgctgcgccacgagaccatgccggccgtctgatgaccggccggggcagacacaacagccgcagccagtggtggattagccttgtttttcttgctttttttgttttaccttttggttggctaaccttagcgggcaggggggcaccctttttttaacctgaatgtaaagtttttttagaagggtaaaacaggggcgtggaaacttggggaaggttctcagctagcagggaaaaaagaatctgaaaatggttttccctcaatttgcccttcgaatttatttctcgcttattagtacaaggaaaaagcaaataagcaagcgagtgtataaagtaatgattaattaagttataaat

SEQ ID NO: 129 - DNA, 1455 bp, Sorghum bicolor
cagttgcggcctcagcccaactggtgccgtgccgtgccgtctcctctcctctcctctctcgtctcatccccagcccacccagcaatgccctcctcctcccctcccacatgacctgcgccgcgccgcgcagccacccttgcctggtcacgagaacgccgccacgcacatcagttgaagcgcttctctcccaccctcttattcgtggattggaatcgacgcctggaagtggatgacgatggcgggttcttgcgccgcgccgcccgttgccggtcttccctcgttgaggacgccgccgccaactcacctcagacttggcggcttcttgccctgttcctcggccgcgcggagtcgcggcgccgccgtgctgggatgcgctctgggggccaagaagcagacgccgggtgttctgaaccggttgctctgcggatacatgcgaagagatggccatgaaggtgatgtaagcagtcaaggaagggatgacactgttatgtttgggccagatgatgatggtgtaaagattcctactcaggtagagactcttgtaaagggcactgcaatggttgctgaaccagaatacaaggcgatcccagatctagattacctacaggagcttctggctattcagcagcaaggacctcgtgcaataggtttctttggaacccgcaacatgggatttatgcatcaacagcttattgagatcctgagctatgctatggtcataactaaaaatcatatattcacatctggggcttctggaacaaatgcagctgttatcaggggtgctttaagagctgaaaagccagagttgcttactgtaattttaccacaaagtctaaagaagcaacctcctgaaagccaagaactgttgtctaaagtacaaaacttgatcgagaaaccgcagtatgatcatttgccactaattgaggctagcaggttatgcaatatggacatcatctctaaggtccaacaggtgatctgcttcgcgttccatgacagcaagctgctgatggaaacatgccaggaggccaagaaccttcggaagatcgtgacactcttctacttggattagctcctccggaagggatctagtctcctattttttgtccgtggcgtaggctaatgttgggtgatataaaaaaaaagcaagctgaacggtttagttagtttcgaaatatattggataggtggtgcgttgaccttccatttggtggaggagaaagtcattttgtttcgcccattgttttgattcttgtcacaaagaaaccaataatcttgtcgatatgcctagttcgtcagcgaagggaataagactatcagttggagtttatttgtagttgatctcaggcttataattagttcttgctttcagtttctcctgttttgtctttttcccgctttttatttgatgatgaaatgttatctttattgatgacttaattttctttttcaagtggg

SEQ ID NO: 130 - DNA, 684 bp, Sorghum bicolor
ggccaagcgagcgaaaggagtagctaaacagagagcctacgaccgacgcggccaaacggagataagagcaagataatgtcgtcgacggcgtttagccacctgttcccctccgccgccgtcgccgcggtatccctcctccctcgctgcgtctccttcggcgccagcggtggagctgcccctggatggaggagaagaagccgcagcatggccgcggccaccgcggaggcggcggcgcccgcctacacctccgactccctcgtcctctacttcaaggcggagggcaccatggaggagagggccattcccaagatcaccgagtctcttcagggtatggaaggagtcaaggacctagaggtgctcattgaagaaggcatcgcgagtgttgtgttaacaaaggagacaaccgtgcaagctactggagtagcctcgaacctagtggaagctatccagggagctgggttcaaactgcaaacactaagcttgagcttcgacgatttcgacgacataacagcaggagcaggaggcaatgtccaacccagcgagtgagctaatttgtgcagccgtgcttagtgccaaatgcatataattctgtcgggtacttttacattgtgtttaccccgttgaatttcccgagcacgtccttgtaattttttgcaaatggtgaagaaatcaacgattcttttc

SEQ ID NO: 131 - DNA, 1830 bp, Sorghum bicolor
cacagtgcctccttcccgaccgccctccccggcgcgaccccgcccggcagcccctctccagctccggcgcccccccctcctcggctctaccccgcccggcgcacacccctcggcgctcagcagctggtgcctggtgcttctcatccccacctcactcgtgctccgcgcccgtttcaccgcctgaacagagatggaggccttcctcgccggtctcttcagggcgcctccacgcgccgtccccggccctcggggcacgcctctctccggccttcctctctttcacggcaggcgccgcaggcggccgtcctcgtccgtggtctgcatggcggagccctatctgattgccaagctggattctgcggagaaggcctggaaagaaatgtcggttaggttggcagatccggacattgtctcagatccaagcgaataccaaaaactcgcgcagtctgtttctgaactggatcaggtcgtgaccacatacaggcaattcaaggattgtgagaggcagcttgaagagacaaaagctctggaaaaagagaacgaagatgaccctgatatgtcagagatgataacttctgagctggaggctctatctaaccagcttgcagagcttgaagaaaaattgaagttactactgcttcccagtgatcctctagattcacgcaacatcttacttgaagtaagagcaggtgctggtggtgacgaagctggaatttgggctggtgaccttgtacgcatgtatcagaaatactgtgagcgcaacaattggaagtttaagccagtttcttgctcagaagcagacatgggtggatacaagacatatgtgatggaggtgaaggggaaacaagtctatagtaaattgaagtttgagtcaggtgtacaccgtgttcagcgtgttcccctgacagagactatgggtcgtgttcatacgtcaacagcaactgtagctattatgccagaggctgatgaagttgatgtggttattgatccaaaagatattgagcttaaaacagcacgatctggtggagctggagggcagaatgttaacaaggtggagacggctgttgatcttattcacaagcctacaggaataaggatattctgtactgaagagagatcacagctacagaacaaagagcgggcatttcaattgttgagagcaaaactttacgagataaaattaagggagcaacaagagtcaataagaaaccagaggaaaatgcaggttggtactggtgctcgatctgagaagataaggacatacaattacaaggataacagagtgacagaccatcgattaaagatgaactatgaactgaccggcttccttttaggagacatcgaatcggctgttcagtcttgtgctacactggagcagcaggagctcttggaggaaatggccagttccgtgggcgcagtgaacgtatgattcaggcaattcggcgttgagatcaggtcatcaaatagaatcaagaaactcatgatgtgttcaaaaccgataaagatgattgatagttgtacaagaaactgacaaaatgaactccacataggaaatttttctgtagtccacatggtcatgagttcatgactaataccatagaacacacccatgcatctcagcttccttaacgacatcagatttttgagtattagaaaatatacacggtatgtacaattcaactgctccagtattcacagtttaatgcattttaggtttgttgttctgtgaaattcttttgttcccaatgtgtaattcttcaagaaaaaaattgcaaatacccatttataaagacgctatagccatgtgctgagttaagtgaccagttctcc

SEQ ID NO: 132 - DNA, 1126 bp, Sorghum bicolor
ctggcacaccactctcgctcgcactcctcgtcggcgtggttcgttcgtggttgcggctttccgcgaagcgaagcgccgtccacggtacgtgtagaggtagcaagccagagccactggtgctgatcgatcggccggtatggccgggagtgcgaggtcgtcggcggccgcgaagcacgcgtaccggatgttcgcgccgtccaggggcggcggcgccgcgacgagggggcccggcgctggcgccgcggaggagttcgacgagtcggacgtcgtctggggctcgttcggcggcggcgcggactcccactccagccccggggcggagctgcaggccgcggccggctgggcgcgcccgatccccgcctcccgcgccggggccgggcggaagaagcccgccgccgtggacggcggcggcgcggcggggtcgctgccgatgaacataccggactggcagaagatcctcggggtcgagtaccgggaccactaccgcgcgggcgagtgggagcctgacgcggacgacgacgaccacggcagggcgcgcggcggcggcggggccggggcggagatggtgccgccgcacgagctggcgtggcgcagccgggccgcgtcgatgtcggtgcacgaggggatcgggaggacgctcaagggccgcgacctcagccgcgtccgggacgccgtctggaagaagaccggcttcgaggcggactgacctgatcgtcggtgatccgccgccgcgcccgcgccggcgggggatgagcgcgcgcggttgccggttggtgttggtgtaggtattatcggtaggttagaaaatgagcagtgctgctaatttcttatctcttgatttctttctctctcttttttttttgcccttgctatcatcacttttccatttttttttccttttgcgtttccatgcttgtaaggggaaaaagtcggggtagtaagctttttcttgtttttgttcgtgttgatgcgagccagagggttgggtgttcgttattcatggtgtgacaattttaagggcacctggagaaaaaggacgaatttgtacaaccgatcagttggttgatcatgtctttttttttttgtccttctctaatgaaaaatttcaattttttccatgttccag

SEQ ID NO: 133 - DNA, 2158 bp, Sorghum bicolor
gcactgcactgctctgctagctactaactcactgcgctccatgtgacctcacttatttctcctgtcagcgcagcgcagcagcagccacctataccgatcgagcttcgctcgtccggtccgtcctcccgatcggatcagcgtcgtgccgctcgatcggcaaacgaaagcaagcaagcgatggaggccggggcgtgggcggtggtggcggcggccgtggcgctgtacatggcgtggttctggcggatgtcgcgcgggctcagcgggccgcgggtgtggccgctggccggcagcctcccgggcctcgtgcagcacgccgaggacatgcacgagtggatcgccgccaaccttcgccgcgcggggggcacgtaccagacctgcatcttcgccgtgcccggggtggcgcgccggggcgggctggtcaccgtgacgtgcgacccgcggaacctggagcacgtcctcaaggcgcgcttcgacaactaccccaagggccccttctggcacggcgtcttccgggacctgctcggcgacggcatcttcaactccgacggcgagacgtgggtggcgcagcgcaagacggccgcgctcgagttcaccacgcgcacgctgcgcaccgccatgtcgcgctgggtgtcgcgatccatccacgcccgcctcctccccatcctgggcgacgccgacgccgacgtcgtcgtcgtcgacctgcaggacctcctgctccgcctcaccttcgacaacatctgcggcctcgcgttcggcaaggaccccgagacgctcgccaggggcctccccgagaacgccttcgcctccgcgttcgaccgcgccacggaggccacgctcaaccgcttcatcttcccggagtgcgtgtggcgcttcaagaagtggctgggcctcggcatggagaccacgctggcgcgcagcgtccagcacgtcgaccggtacctctcggccgtcatcggcgcgcgcaagctcgagctcaccggcggcaagcagaacgacgcgtcggccacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctcgtctccacgcacccggacgtggagcgcaaggtcgtgcgcgagctgtgcgccgtcctggccgcgtcccgcggcgtcgaggacccggcattgtggctcgccgcgcccttcgacttcgacgagctcgaccgcctcgtctacctcaaggcggcgctctcggagacgctccgcctgtacccctcggtgcccgaggactccaagcacgtcgtcgccgacgacgtgctcccggacggcacgttcgtccccgcgggctcgtcggtcacctactccatctactcggcggggcgcatgaagacggtgtggggggaggactgcctcgagttccgccccgagcggtggctgtccgccgacggcaccaggttcgagccccacgactcgtacaggttcgtggcgttcaacgccggcccgcggatatgcctgggcaaggacctcgcgtacctgcagatgaagaacatcgccgggagcgtgctcctccgccaccgcctcgccgtcgcgccgggccaccgcgtggagcagaagatgtcgctcacgctgttcatgaagcacgggctccggatggaggtgcgcccgcgcgacctcggcgccgtcatcgacgagctccgcggcgccggggggtacgacgcggcggccagagccaccgcggcctctgcctagaggttcgtgcaggtcgcccggggaaggaaacggcggcggacagttgggaacggcaaatgaaaagttatgtagatatagacagtaagtaattaaagagttcggtgaggtatattactcaatttggaacaaaaaaatgcatgtgtaaaaagtccatgtcattttgatttggatttgaatggaggacgaagaaaagagggctggactgctggggggagcaataataataataatctctcatgtaacctgacgcggaggcgccaaattcgtttgggcggcttgatgggccgccaggactgatgttgtttgtaaaacaaaacccaagcatgacatcaatcatttgatcagtctcaaactctatactcat

SEQ ID NO: 134 - DNA, 1196 bp, Sorghum bicolor
agcgcgagcctgccagccaaccaccgccaccggctttcatcccgcgcgtgcgtcctgcgctagctgcgcccatggctgccgtgaccagcaccgcctccctctgcccggccgcagccggcggcctctctgcctcgtcgtcgtcgccgttcacgcgcaagcccagcagcagcaggaggctgcaggcagcgtccacggcctgccactgccgccctgctcgggtagtagaggggctggaccggagggacgccttgctcggcatcgtcctctccgccgcggtggcgccgctgctcgcccctgccggtgctctagcggacgagcccaccaccgagtcgcaggagggcttcactacgtacgaagatgaggccaacaagttcagcattcaagttccacagggctggctggtcggcgccggcgaggccagcggcatcaagtcggtcacggcgttctacccggagcaggcagccgccgattccaacgtcagcgtcgccatcaccgggatcgggccggacttcaccagcctcaagtccttcggcgacgtcgactccttcgccgagggccttgtgaacggcctggacaggagctggcagaggccgccggggctcgccgccaagctcatcgactccagggcggcaaacggtttgtactacctggagtacacgctgcagaaccccggcgagcggcggcggcacatcgtctcggccatcgggatggcgttcaacggctggtacaaccgcctctacacggtgacaggccagtacatcgacgacgatgacgattccgaaaagtacaggcctcagatagagaaggctgttcgatcgttcaggctgacatgaaagatgccatgtcattcagcagaggtcttgtgcctgaaaattgacaccttgccatttccatgagatgagacaagacaagacatgtatgccaattcttgagcactgtaacactgcaagtatgcgaatatattttctcctttttgaggtggatataaatatgttttttgtaactcttgtgtaacgttgctgcggtgtttttttggttgtgtatatgtaatgtttagagggtcgggctgaaggagcaactatgtgacctttattctctttttaaggcaaagttcgtgtcacttcttttcaaaacaagcaaatggttttgtttcttgagctggaataacaagcaaagttagtattccctctgtcgac

SEQ ID NO: 135 - DNA, 750 bp, Sorghum bicolor
ccccccaacatccatttgcaaaggccggagaccaaaaaaccccaccacctttaacccccgaaccctagcttactcgccgccaccgcccaccgtctcctgatccaatggcgcgcatccacctcgtagccgtggcaatggccatgctcttagccgtcgcgacggcgcaggcaccaggcgcgtcgccgacgccggcgcccagggcgcagcctccggcgaccccgccgccggggccggcaccagccccggggtctcctcctccgggctccgcccccgcgccctctccgacgcagaagccggccccggctccggcgcccaaggccacggcacccgccccggagatccccgcctcgccgccggcgccgagctcgatcgggcagacgccaacggaggccccgacgtcccctccgcctcccagcgacgcgtccagcgtctcccccgccttgttcctggccgccggcgccgctgtggcgtttttcttctgaggtcggtgggtgggccggccggccggcgccgatggatccgcatccgcctgtgttgtgagtgtgacacgatggctctcgctacttgtatttgttggccgcgtcgtcgttgcattgcattcgggtttattactagcatagcatagcatactactgctttcctagctgggttcgatctgtgcgtgcgtggtgagtgagagagattgatgagtcgagagacagacagttgctatgtgggttgggatgccattgtataatccctcgttttttt

SEQ ID NO: 136 - DNA, 1209 bp, Sorghum bicolor
cactcactcaaacgttcggcaagacgggcggacacttggcgagggcgatggccgtgaaccacatggaaagtttacgctcgggagctgggatattttgccgtggcggataaaaccaaacgagcccgcgtcacggatggatatcttcgcgccatccgctgcgtcgcgagctcgccgccatggctcttcccctcgcccgcctcgtcctacccgggttccccgcctgccagtgccagccacggccccccctgcgcttcccgaagcaccacgtctccttcgccgcccctgccagttctcgcgccgccttcgctgcctgcgcggcggctagtgcgccggcggccccagctgcccaagcgccggaggcggagacggtcgagcaagtgggcccgaggacacgcctcgtcgcgcagaacatcccgtgggactccacggccgacgaaatgcgcgcgctcttccagacccacggctcagtcgtcggcgtcgagctttcaatgtacagtgccagtaaaaacagaggattggcgtttgtaaccatgggttcagaagaggatgctcttgcagctctcacccatctcaattcaactattttaaatgatagaaaaattaaggtggactttgcaagacctagaaagaagcaacctaagcaacctgttgtggtatcaaatcccatggaaaagtatattgtgtttgtcggaaatttgacatggagagtaagaaatcgtcaccttcgggaattatttgcctctgccccaggtgtgatatcagctgaagtcatctttcataccaccactccgaggcgatctgctggttatgcatttgtttctttttcttcaaaagagaccgcagaggccgccatatctgctttcaatggaaagatattgatgggacggcccattaatgtgatgctcaaagatgaaaatggtaaaaagaatgaatcttctgtcccaaaggaggaggccgaggtggaatcatctaactagagtgatagctaagcacgaactgttcctagagcaagaagacaagcgaaaggaatagatcatatctgtcattacgtatattctgacccatggtattttctttttagaaatagttttatcccttgttttattatgctctatttatcgagacttttacctgtgtgccattaaaaaaattgtaattatacacaagctattaaaaaagttaagctcccatgagtgccaccgttctgaa

SEQ ID NO: 137 - DNA, 3008 bp, Sorghum bicolor
accgtataggctcgaggctcgacccttggcccgccgccagaactcgtctcgcccgcggccgatcgtctccatccgctcgccgcgccgcaacccggagaggagactgcgctcggtcgagcaccacctgaggcccagcgtcctcgcgagtcgcgaccagctccggcgcggcgtccgccctctgtagccccggtgtccccgcgaccgtcgctgctgtcctacttcgccactcgctaccttggccggcgacgagaaccaccaggacaccaggtttagttgctccgggtttagataggttccttcaatgcatcgtgttgggagtgctggtaacacagctggctcgactcgaccgagaaaggagaagcggttcacatatgtgctcaatgatgctgatgataaaaagcattgtgcagggatcaattgcttggcttatctaaatggttccacatttagtacaagtgactatctttttagcgggagtcgtgatggtaccttgaaaagatgggaattaaataatggggatgcaagcttctcagcaacttttgagtctcatgttgattgggttaatgatgccattatagttggagaaaagcttgtttcctgttcctcagacaccacaataaaggtctggaattgcttctctgacggtgcctgtaccaggactctccgccagcattctgattacgtgatttgtcttgctgctgctgagaagaatagcaatattgtagcctctggtggccttggtggtgaggttttcgtttgggaccttgatgctgctcttgctcctgtagcaaaatctgtggatgcaaaagaggatgaggttcctaatggaaactctgggcctgctttgtcaacaatgtgcagcgcaaattctagtagcaatattgcttcctctaatggtcaatcacatgggtacaatccaattgccgccaaaggacacaaagactcagtttatgcactggctatgaatgatacgggaacacttcttctctctggtggcactgaaaaggttgtccgagtgtgggatccgagaacaggttcaaaaaacatgaaattgagagggcacactgacaatatcagagccttacttgttgattctacagggaggtattgcctatcaggatcatctgattccatgataagactatgggacctaggacagcaacgttgtgttcattcttatgctgtgcatactgattcagtttgggcgcttgcaagcactccttcatttggtcatgtctacagtggtggaagagaccaatctgtatatttaacagatttgtccacaagagagagtgttttactgtgcacaaatgaataccctattctacagttgtctctgcaagatgacacaatatgggtggcaacaactgattcttctgtttatggatggccagctgaagggcgcacaccccaaaaggtcttccaaaagggtggctcattcttagctgggaatttgtcattctcaagggcaagagcatctttagaaggatcagcacctgttcctgtatacaaagaaccatcatttgttatcccaggagttccagcaataattcaacatgagataatgaataataggaggcatgtactgacaaaggacaccactggttcagtcaaattgtgggagatcacccgcggtgctgttattgaagactttggcaaggtttctttcgaagataagaaaaaggagttatttgagatggtaagcatacctgcttggttcaccatggatgctcgattaggatgcttgtctgtccacctggatactccacaatgcttttctgcagaaatatatgcggttgatctaaatgttgctggagcacaagaagatctcaagattaatttggctcaagagacccttcggggtttgctagttcattggagtaaaaggaagcagaaatctagttcgcacagcttgcctaatggtgatagttcaatagggaaagatgttccgtcaaaagactcaccccggtcaagatctgaggtggatgatgccactgaaaatcatgcaactcatgtgcttccatcatttgagttttctacagtttcacctccctcaattatcacggaaggttctagtggagggccttggagaaagagaattaccgatttggatggaactgagggtgatcttccatggtggtgtgtggactgtgttactcacaatcgatatccaaaggagaatacaaaatgtggcttttatttacatcctgctgaaggctcgcctgcgccaaacataactcaagggaagcttagtgctccacggatattgcgaattcataaggtagctaactatgtggttgagaaacttgtgcttgacaaaccggatggaggctctgatagcgcgtttgttatgggattgagttctgctcaatcgcagctctcagcgctagatagttcttcgcggcttggactaaagtcatggcaaaaaacaaagccatgtattgagatattgtgcaataaccaggttctatcaccagagatgagtttggctacagtgcgaacatatatatggaagaagccagaagatttgattcttcattatagagtggtccagtcgagatgatcacggcttcagatgtacatgctcacatggttctccagatatgttcagcatgtctgcacgatagatggttttgttgaagatacccttggcttagagaggaaaccatcatctcactgaggaaatattttgcccttgtgcccccgtagccgttcccagaatcccgacttgtttgcatctttgtaaagttcctgatctcgccctggtagtaagatgtatcatagcacaggtataaggttctctgctggctgccaagcttgtaaatgtagaagattgggtgcttaataaaggtcagatggatatgtttttcttttttttttcgtttttctttgacaacgtttgtaagaaaaaaaaaggctgatgctctgctcagaccgtggcgttccgacgtcgattattggattggatttaaccctggcgcatatgctcttggaccctgtcacccagg

SEQ ID NO: 138 - DNA, 2143 bp, Sorghum bicolor
taaatgaggaagctcaggggaaaaaaaaggggtcaggggagggcaatgcccaaataaagaaaacgagactcggtaagaagacccctgaacagtaggcactctcctcacctcagtcactactttcccgctctatccatatataaacccccctccttcctcctctgcatgcctcaacaacccgtctccaagaaaccacctcccctcgctccaatcccaatccaaatccttcgccacgaaccaatagaacccaatccgatcagttccccccacgcaatttcccatctgagtttcatctctttctttttcaccgataataaagatccgatcgatcggagtccggcggcagctaattcaccggcgggattggagatgaaggtcgacagggaaatggagattctgctcaacgagatccccctcctccaccacggtggcctcctcggcggcagcggcgaggctggtgcggacgacgacgccgacctctctttcctcatccacgaactcgccgcgatgggcgtcgtggacggcgacgacgagccaccggcgccgggcgctgccaacggcttcggcttctccagcatgatgatttaccccaagaaaggcggcgagaatctggtatccctgcacccgttctccatggccggccactgcgcgcacatgccgtctctgtttgatcccgtcaccttcgctgccgccgacggctgggacatccggtgctccccgccgccttctgtttctgtgtcgccaccgcccgccacgccgagggcccggtgcaagaacgtgaggaggaagaacggcggctgcggcgcggtgacggcgacgagccccaagaagtgcggagccgcggcggcggcggcggcggcggcggccaacaagtcgcacggcgagagcctggccggcctgcgcggggtcatgtcccacatcgcgcgcgaccagcacgggtgccggctgctgcagcagaggctcgacgacggcaagcgcgaggtcgacctcatcttcgccggcgtgtcgcgccacgccgcgcagctgatggtggacccgttcgggaactacctcatgcagaagctgctcgccgtctgcgacgccgggcagaggatggcgctcgtgctcaccctcaccgctgacgccttcgtcctcgtcaggatatccctcaacgtccatgggacacgggcagtgcagaagctgattgagagcctgaggacaagggaagagattagtcttgtcatcgatgctctgcgcccggggttcttggagctcatcaaggatcctaatggcaatcatgtcgtgcaaaagtgtttgcaggcgtttgaagccgacgataacaaggcgatatttgatgctgctgcactccactgtctcgatatcgggatgcaatgccacggttgctgtgtcctacagcggtgcattgcacgatcgcgtggtgagcacagggacaagctggttgctgccattgctggcaatggattcaaacttgcccaagatgcatatgggaactatgttgttcagtatgtaatagacttgaagataccaaatgcaaattcaagtcttgcacaacagtttgaaggcaagtatatccacctgtccatgcagaaattcagtagcaatgttgttgagaaatgcctgaaagtcttcaaggaggttgacaaggccaagatcatactagaaatcctcgccacgccacacttggagcaattgcttcagcacccttatgcaaactatgtcatctactctgctctccagaattccaagggttcacttcattctgcactgacaaatgcaatccgacctcatgtggaactgcttaggaccagtccatactgcaagaggatatactctcgagctttgctgaagaaatgatgagttgatgacaggttttcagcttgtaacaagaacgattgctctcttgtgatatttgtttttttcagtttcaaaaggcataaagatgatcacaaaatagatctgtataaattagtattctttggtcatgtacttctacttgtacctgtaattgatgcacggcttgtgcctggtgctgcatgatcatctgggacagaataaaattcaatcgaaagtattctacaaactatttcatatatatgtaatgttttacgttgtttatggctgcaaagatattgctgttgttacc

SEQ ID NO: 139 - DNA, 1326 bp, Sorghum bicolor
acgcaattggaacgcgtatagcgtttgctcgcgtccctcctccacccggacccggcctggaagttctcggcgtcagccgaccaccgcgccgaattccggcacgacgtcgccataggccaaaacacgatgggattcccagatgaaagagtacaagtagatgcactggagagacacttactaactggtttatcttcaaacgactataatggaagttttgaggatgaggtcctctatgatgcatcatttgcagaaatggaagataattttgtcaagtatcaaattgctcagtggactttattatctctattactaatcatagcttggggagtaggactgctcatgctactttacatacctattcgagcatatgtatgtcgaagcgactttcgctcgaggaagctatacttgacaccacatgctgttatttacaaggtaaacaagccttttgcttttccttgttttggggttttcaagaaggagaaacattgtatcctcccttcaatttctgatgttgttgttgagcaagataagctccagtccgtttttggggtatattcgatcaggattgagaatatcggtgtcagaaagcctcgtagttatgatgtaaaaattactggggttgctcatccacatgatttcaggaaggctgttctagtccatcttttgaacactaggaagctgaagttcagtcaaaaagcttcatcgcatgaccaacagagcagaagtttgagttctacagctagttcttcggaggctcctcttggagatttgatgctagagaagcttgatgaagttgaaatctctgtaaagaaaatgcaagcactgctgcagggggctgaaacttcaaagattaagaccacatccagttgactcaatgtatgttgacatttcacaggatcgaacaagatgtgactggtgctgatcgacccctctttgctctggtggctatcagtatcatggatttatcatcgtggctgctgttgatagcagttcggctcgtgcaaacatttttgcagtggctgtatgaatagctaatggtgcttgttgtaactttgttattgtcatatgctccgtcctgtatattattgtccaatacggatggtgatggcttgctattatatgcagctttttctgtaaatcgtgcagggaacttcactttctgcacataaagtcgtgtatagttgagagggagcaatcattcatattgtaatttgagaaagatccacttggtgatcagattaattagtgaaaccaagtcactaccttgcaactgatgatgtcaatatcgtgcattgataaatgatataagacctttactgtttgcca

SEQ ID NO: 140 - DNA, 2103 bp, Sorghum bicolor
ggcaggttgcgctgcaggatggcgcttgcccgcagtggatccgaatcgccacccccgcaatagcgaatatcctactcgctccgcctctgtgctcgcccctcccgcccgctgatatgatatccatccattccaatcccacctctcccgctccgcctccctcttcgtcctcgtctccctctcgcagccgtccggcgtcctcgtctcgtcccccccaaaagaatccggacgtggactgaccactccttttctgggcatttacatctctaagctcaaagaggaaggattatgaaaatggcgcacttgatcactaactgtagtttcagtacatctcctgctgttcagacattctccagttctcctaattactgccgcagtgttggccaattacagaactcaaaatcttcaaatttatccctcaaatcttgttccaggagacaaaagaagtcatatgtttcctgtgctagtgcagccgtacaaggacagacacaaacacctcttactggtagccagcaagcttatgagcattcatcctccaaacctaaaaaggtaatggttattggtggagatggatactgtgggtgggcaacagctcttcatctctcaaacaaaggttatgaggttgctattgttgataatcttgttcgccgtctttttgatcaccaacttggtcttgattcccttacccccataacttcaatccaaaatcgtgtccgtagatggaagtctctcactggtaagacaattcagctctttatcggtgacatatgtgattttgaattcctctcggaagctttcaagtcttttgagccggatgctgctgttcactttggtgagcaaagatccgcaccatactctatgattgatcgttcgcgggcagtctacacgcagcataacaatgtcattgggacacttaatgtcttgtttgccataaaggaatacagtgacgagtgccatttggttaagctaggaactatgggtgagtatggaacaccaaacattgacattgaagaggggtttatcactattactcacaatggaagaacagacaccttgccttatccaaaacaagcgagttctttctaccatctaagcaaagtgcatgactcccacaacatagcatttacctgcaaggcttggggtataagggccacagatcttaaccaaggtgtggtctatggggtcagaacagatgaaactgcactgcatgaagagctatctaacagatttgactatgatggcgtctttgggacagcactaaataggttctgcgttcaggctgctgtagggcatccacttacagtttatggaaaaggtggtcagacccggggatatctggacatcagagacactgtacagtgcgttgagctagcaatagccaacccagccaaacctggcgagttcagagtcttcaaccagttcactgagcaattctctgtcaatgagctagccaaactggtgacagccgcaggagcgaagcttggtctagaagtgcagaccaaatcggtgcccaacccacgagtcgaggctgaggagcactattacaacgccaagcacacgaagctcattgagctcggcctggtgccccacctgctctcagactccctgcttgactcgcttctcaactttgccatccaatacaaggatcgggtcgacacagcacagatcatgccaagcgtgtcatggaagaagatgggtgccaagccacggacagtctctgtttagagggtgattcaacttcccctggcttatagtgtcaaccaacattgacattattgacatatgtaatgtaataattatgcacattagtatgatgtgctaggtagtgaggtgtttattacgatattaaatttcatttttgttgccggtacaactgaagttcatgtttgattttgttgcccactcgagctcttggtctaatgcacctgagggttaagctgtcatatgtcgccattcactgatcgaaccctagtgcaacgagtgtagatcaagatcttgcaagaattgttagtagttactataatagaccaaatggatccatgattctgttcttgcgcagctatttggatgtaaaattgaagctgagtgtaaatctctttgctaata

SEQ ID NO: 141 - DNA, 1415 bp, Sorghum bicolor
atccgcatcacatccgacccggaagcgcacgtggggctcgcaacatcgcggccggccgcccacagcaccacccgggcgcagcaattcgtcgagcagctgccgcgcgcgcttactctcctgcggctgcgggcaccgggccaccagggcaccatggcgtccaccgcgcgtgctctgggggcgctcctccacagggcctcgttcctgtcctcctccgcttccgctctccggggagcgtcgctcctccgcggggatcgacctattggcctgttccggaggcatgcggcgaggcggcggatttcgtcattccagccgctctgcatgggacgacgctcctgcaaaatcgctggaaggaaggatgcccagaatttgaagaagatgaagcgcaacagcaaaattggaaaagaaattgttgcagccatcaagaagggtggcccaaatccttcatccaacacaactttagcagctatactggagaaagcaagggaacttgatgtccctaatgaaattttggagcgcaacatcaaaagggcatcagaaaaaggacaagatacttacactgaaaaggtttatgaggtctatggttttggtggagtaggtatggtcgttgaagttctaactgacaaaattacaagatcagttgctgacattagaaatgtggtaaaagactgcggagcaaaattggctgatcctggatctgttacttttagattcagacaagctcgagtggtgaacataaaagttactgatgcagataaggaccaactgctcaccattgcgttagatgctggtgctgatgacgtccttgaaccaaattttgatgatgacgactctgaagaagaagcagaaaggttctacaagatagttactacatcagaaaactatccagttgtgctatctaagctacaagaagaaggattgaagtttgaaactgataatggctacgaacttcttcctctgaacccaattgaggtcgacgacgaggccatggaactaaacaaggaacttgtttcaaaattgctagagcttgatgacgttgacgccgtctacgcagaccaaaaatgagtgaactcatgagctacagctctcaattcaagacacgcttagcccatgggtctttgttggagtatatttactttacattgataggaaaaaaaattgataggtctgcttatgatgcctggttacattggttctaagttcccaaaaacttgagttagtgatctagcatttttttaagacagatcagtttataccttgggtttttgcccagcccatcctgttgggaaacttatcagcgtctgctatattctcagaaagcagatctgagatgtgagaagccattataaaataatacgatgatgcctatcaatttgttggtatttggtaaagcgttgaaatgaaaatgctttggctct

SEQ ID NO: 142 - DNA, 847 bp, Sorghum bicolor
accgtaagccacaagcaccacggcagtagaattcccctcgcgtatctccagctttcagacgtcaaagacgatgctgccgctgaggtccgccgcggccgcgccgtgcttggttgcaggattgctgctccaccgattctcatcctgctcgtcctcttctgtctattcggtccgccaccacgcctcgtatgctgtctcctcccagccctccacctgccccaccactacctggttccctttcccccattccagcagccctaggatccggggatttgccgcctgggcatcggcgccggggcaggcggggtctgcggattcccccgctacaaaggcgctagaggctaagatcaaggagcagctgcaggcggacacagtcacggttgtggatacctctggggatggccgccatgtctgcatagatgtggtttccaaggtatttgagggaaaatcagctgtaaataggcagagaatggtttacaaggctatatgggaggagcttcagagcactgtgcatgctgtggaccaaatgactacaaaaacgcctgatgaagctggtgccaagtaatcgatagctgcataataccggggagacagattatctgtgcttttaagatcaggccattgtgtcgacaaaaaattctcttgtgtagtattaatttgcgtgtcaactgaatgatcaataatttggagtatgattagcgtggcttcaaaaacaatatatacatgtttcttctctgacagttgatggcttgttagtgctctctctgttttgcacatggccttggagccaaggtgttaaggacgaggaggtggccttgcactgctttggcgagatacacattgatgaaag

SEQ ID NO: 143 - DNA, 1237 bp, Sorghum bicolor
ataattgaggtaaaataaaatagctacgacctacgagtagtgaacaagccgtcacgcaatttgttgccactcctttgctaaccgcaccgggagtgccactgcaagggaataatttcccacgatcagcgtcgtcgcttatctccgaatctctctctccctctctgcagtccgcaccatgggttccgacttcaaatcgatccccttgatcgatatcagcccgcttgtcgaaaagattgatgatccaagcatggccaacgacagggatttactgcaggttgtccggttgctggacgatgcttgcaaggaggctggattcttctatgtgaaaggccatggtattgacgagtcgctgatgagggaagtcaggaatgtaacgcgcaaattctttcagcttccttatgaggaaaaattgaaaattaagatgacacctcagagtggatatagagggtatcaaagattaggggagaatattaccaagggcaagcctgatatgcatgaagcaatcgattgctatactcctattagacctggcaaatatggagacctcgctaaaccaatggaaggatctaacttatggccagaatacccatcaaattttgaagtactgctggaaaactatatcaacttatgtagagatatttcaagaaagataatgcgaggtatagccttggctttgggaggggcgattgatgcttttgaaggggaaacagctggagatcctttctgggtgttaaggttgattggttatccagtagatattccaaaagagcagcgcactgatactggctgtggagctcatacagattatggacttctaacactggttaaccaggatgatgacatatgtgcccttgaggtgcaaaaccgctccggtgagtggatatatgcaacgccgattcccggaacctttgtttgtaacattggtgacatgctgaaggtttggacaaatggaatatatcagcccacacttcacagagttgtcaacaattcgcctcgttaccgtgtatctgttgcgttcttctatgagtcaaactttgatgctgcaatagagcctgttgagttctgccgggagaaaaccggcggtgctgccaagtacgaaaaggttgtctacggagagcatttggttcagaaagtactgacgaactttgtcatgtaaatttgctgggtgcagatgtggaggaataaatctgtattgtaaacggcacattatatttcatctataaacatgttttttttt

SEQ ID NO: 144 - DNA, 542 bp, Sorghum bicolor
agccatccagccagctcacgcacacaacacagctcacgaccagcgacagagcaagcaagaaagcaagcaagcggagcaatggagtactggtacccctgcaacggcagcagcggctgcagcaaggagaagaggccgccgctcaagaggggccagctcaaactgcagatcgccaggaccctgctcggcagcctcgcggcgccggtcgccaagaaccgggatcgcggcttcgggagttaatcagtggtaggaggagtagagtagagtagctcatgccgtcgagggggtgcttgtaatagggaatgtgcaatctgatgaattttcctctttagaacaggatgtgttggtgtcaagttttgccgcgttcgttcgttatccttgcgctcttgctcaccttcagcctcttggttggctcctgctagaacagagcaccaagcttaagagccctgttcttgaatgaagcaatgtaagtagagcgagaggactacagttccttgctcttcttgtctacagctaccaagttctaacagtctacagttctgcta

SEQ ID NO: 145 - DNA, 2128 bp, Sorghum bicolor
tcagtaatcactccactcctcagcccaccacaccagcaagcaggccaggccgctacaacgcacaacgcgacgcgaccgccgcctcggggttcgcgcaccaccaccgtatagtaccatgtccaccatgggctcctcggcgcagctcaggcggctgaagcctctgtaccagctggtggtgaacaacatcctggccatcgtggccgtgccgctcgccgcctcggtcctcctcaaggcggcgtcgctcgggcccgaggagatccttgcccgggccctggcgctccggccggcgcacatgttcctgctcgcgttcctgccggccgcggccacggtgctgtacctcatgctccgcccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctcctggagcgctcgggtctcggggaggagacttgcctgccgtacgcgcagcactacatcccgccgtcgcgtgacctcgagtcctcccgcgccgaggccgagctcgtcatcttctccgccatcgacgacctgctcgccaagacgggcgtctccccgcaggacatcgacatcctggtcgtgaactgcagcctgttcgcgccgacgccgtccttcacggacatgatcatgcaccggtacgagctccgcaaggacgtgcgcaacgtgcacctctccgggatgggctgcagcgcgggtctcatctccgtggagctggcccggaacctgctgcaggtggctccccgtggcgcgcgcgcgctggtggtgtcgacggagaccatcaccccgaactactacatgggcagggagcgcgcgatgctgctcccaaactgcctgttccgcatgggcggcgcggcggcgctgctgtcgaccagcggcgccggggcgcggttccgcctggctcgcgtggtgcgcacgctgcggggcgcctcggacagcgcgtaccgctgcgtgtaccaggaggaggacgaccgtggcaacgtgggcatcaacctgtccaaggacctgatgaacatcgcgggcgacgcgctcaaggcgaacatcacggcgatgggcccgctggtgctgccggcgtcggagcagctgctgttcgcgctgtccttcatcgcgcgcaaggtgctcaacaaccggatcaagccctacatcccggacttccgcacggcgttcgagcacttctgcatccacgcgggcgggcgcgcggtgatcgacgagctccagcggagcctcacgctgtcggacgagcaggtggaggcgtcgcggatgacgctgcaccgcttcggcaacacctccagcagctccctctggtacgagctcgcctacatcgaggccaagggacgcatgcgcaccggcgaccgcgtctggatgatcggattcggctccgggttcaagtgcaacagcgccgcctgggagtgcatccgccccgccgccaacgccgacgggccatgggccaactgcatccaccggtacccagtccacattcccgacgtgctcaagcactgagccaccgtacgtacagccattcctgccctcccagtcgcgccattgcacctgctggctgctgctacatttgtctctgtgggtgcagatcaaaacgaaccgttggaacagtgattggttggaatctgggatcgacggagaggacttgtcgtgtcaattacatgggctcaaggcggcggggtggtcgtcataaaggaggcggggtcggaccaggctccagtcagtcagtcagtacatgtgcgcccggggaacggaacggatgtgttgtgtctcggtccggggcgtttgtatactacatacactcgtttcgtggtgtgagtgacttcgtgtcgcgttgtgttcacatttctttatctactcttataatatacgtatgtttttcctatttctttcaaactcattattcatccagtataccataaggagagatatgacatgagctactagtagagacaagccgagcaaaagctttcatgtacggagtaatttcacctactcttatcaatcaatattttcattcatttattaaaagtgctgccttgtgcagttgtg

SEQ ID NO: 146 - DNA, 1945 bp, Sorghum bicolor
tcgcagaggcgatgtggcagatgaatttaggagaaaccatggcccccatggaactggggccatacccagagcgtgttggtgagccagactgtagctattacatgaggactggcatgtgcaggtttgggatgacctgtaaatttaatcacccagcagacagaaagctggctgttgctgctgcaagaatgaagggagaatatcctcaaagaattgggcagcctgaatgtcaatactacctgaagactggcacatgcaagtttggagcaacttgcaagtttcaccatccccgagaaaaggctgcaatggcaactcgagttcagttgaatgaactgggctacccactccgcgcgaatgaaaaggagtgtgcttattatttaagaacagggcagtgcaagttcggaagcacatgtaagtttcaccatccacaaccatccaccatgatggttgctgtacgtggctctgtttattcacctggacagtctgcaacttctcctggccagcatgcttaccaaggggctgtaacaagctggcccttgtcgagatctgcttctttcattgcaagtccaaggtggccaggtcattcaagctatgcacaagtgattgttcctcctgggcttgttcaggtcccagggtggagtccttatactgcacagattggttcttcatcctcggatgaccaacaacggacacccggagctgcccaatactatactggctcacgccagagtggaacagctggcataggcgatcaaggaatgttttcatcctaccaagcaggttctgttcccgttggactttatgcagtacagagggagaatgtatttccagagagacctgaccaacctgaatgtcagttctatatgaagaccggagactgcaagtttggtgctgtatgcaagttccatcatcctagggagcgaataattcctactcccaattgtgcactgagtccattaggcctacccttgcgcccgggagaaccaatatgcagtttctataatcgctatggcatgtgcaagtttggtccaaattgcaaattcgatcatccaatgggaagtgctatgtatggccatgcttcatcgccaactagtgaggccccaacttctctgcgtatgctggcacatgtaccatcgcatccagaagtatcacctgacagtggctcgggaaggtctaggaggattgcccattctgattcccagcaaataccctctgttgaaaggagcactgagagagaggcgtcctaagccatcctcggtgttttcgttcatgctgcctcccattcttgactggagtaattatctgcaacaacatttgaggatccgaagctgtacaggtcttttgcctcacctttgagctttacataccggagcttgcttcaacatgtattgcattcaggcaggaaaaagttcttgcctgttcgggatgctcatttgccccccattgaaaacgggaacaaacctaccttatttaaacatatgtatggaaccaactcacacctctggacattcaaacccattcgagtaatgtgccctggtcccggtgttgtagttatagaggctgtgtttcgatggacaatgcttttgcgaaactgactggggatgcgcaagcataacctcttttgttaattattatctcgttttttcttagtatttctcttttcataagggcaaccccgcgcaatctgaaagtgtgcgtgttgaagattgggaaataataggttgccatcatatgctctgtattacccatcatatttaaactcggttacttgagagccattttatctgggtggttctggcttagtcggttaatttgcctggagattttgattctatatcctgtacaaactgctcttggtgctaataataaagtgatggtagagtttgatcctggaccagtggcaacttgtccgaccataatattttgttaagttcacacccatttctac

SEQ ID NO: 147 - DNA, 889 bp, Sorghum bicolor
tgtttgctgctgatgtactataagaacagtagaggacgtagctatcgtaggcagggtcagatgttgacgatcgtggagtattttctacttttgtaccgtgcattattgcctacacctgtgtggtaccgttttttcctgaacaaggagtatggaagcctattttcatctctaaccactggcttgtatctcactttcaagttgacatcagttgtggaaaaggttcaatcatttttgacggcattgagagcattatctcataaagacttccattatggttcatatgcaacaagtgagcaggtggttgctgctggagatctgtgtgcgatatgccaagaaaagatgcatgttcccatccttttgcgctgcaaacacatcttttgtgaagattgtgtatccgaatggtttgagagggagcgtacatgcccgctgtgcagggccttggtgaagccagcagacctccggtcattcggtgatggttcaacaagcctcttcttccagctattctaatcaaagagagccaaaagagcggcaagttggagcgctccactctatgcagatgttagcggggtgtgtgtgcgtgtgttgctgctggcagcccctgcaagcagtgcggccctgatgtggtgctgggagtgtacaccaagctgaagctgaaggcgtacatgattgtgtattctgagtttgtgactgtgcatatttccacccctgtataggctctcgctggatgcttgagcacctgaggatttacctgaccatatatatatatacgtacaaattactacataaatagaaatggtgagtatatacaacggattcgaatgcgtcgataaatcctgacgttccttgtttatgttgtgctccgttcaagctgggatataaaatcgtcgag

SEQ ID NO: 148 - DNA, 1206 bp, Sorghum bicolor
gacaagtcggaaaaagaggaggacaagtcatcaagccgtcacggaaaagaggggaaaaaaaggagaaagaaacaaaagaaaaggaaaaaaacagggcgccctcacggcgaactcccacctcctatcgcctccccctctcctttctctctctctatagccccgcacaaatctctcctccccctctcgccctcgccgcattgcccgccgacgacccccgccggatagagaggaggagagcggcgcggctgcgggagaagcgggcggcggcggagcgggcggcatgtgcgacctggtggcccgcacgggccggcaccagcagcggtacgaggatggccgtcggctagtggccggatgcataccatttaggtatagagctaataatgatgaaacctctggtgacaaaactaagaaacttgtggaagttctcatgataaattcccaaagcggacctggtcttttgtttccaaagggaggatgggagaacgatgaaactgttgaagaggcagcagctcgagaagctatagaagaagctggagttcgaggtgatatagtgcattttctggggctctatgacttcaaaagcaagacacatcaagatgcgtgctgccctgagggtatgtgcagagctgcagtgtttgcgctgcatgtaaaggaagagctggcctcatggcctgagcagagcacccggcagaggacctggctcacggttcctgaagctgcatcaagatgccggtaccagtggatgcaagaggccttgctcacaggcttctccgactggcacgacaagtggagcagaggcggcggcggcacaaactgtgacccggcctaactgctgaacccatctgcagtcgtccattttttttcatctcctcttcccctaggctccaaccttgcataatgcaataacagtgtacttctcttgatatgctgggttggtcattgacccttgatgtcaaaatgtcagaatggttatctagttatagtgggacgaggtatatctcatcaagatgagaattctcacaacttttaagtgtcgattctcgggccctattatttctctgtttgagctgctgttgtcgcggtgctgcagtcacgcaccgcgcgcattttgtaactccgctcctgattctggagatgcatatgctatatatgaactggtatcacttgaaatcaaaagttgccaccgttgactggagtcaccatgca

SEQ ID NO: 149 - DNA, 960 bp, Sorghum bicolor
ctccccggttttcccagtcccccaccccccccgactcctttaacccccgtcaccgcgccgcaccggcgacttgcctctccactgctccaactccattcccccacacccgctcgcgcggttgctcaatggcgggaggcggggcgtcgtcggcgtggggcccgagcccggctctggtgaccgcgctggtggctctgctcggcctcggcctcgccgcctacatcgtcggcccgcagctctactggcacgccgcggaggcgctcacggcggcggccgcgtgccccgcctgcgactgcaactgcgacgcgcgcccgctcctcgacctcccggaagattgtgctaaacacttcaagggggtcaagagtcgagcatctggtgaagagacagaaaaaagtttcacagagctgcttgtggaagaactaaagcagagagaagaggaggcaacacaagctcagcaagaggctgatgttaagttgctcgaggccaaaaaattagcttcacagtatcagaaggaggctgacaaatgcagctcaggcatggatacctgtgaagaagctagggagaagtcagctgtagcattggtccaacagaagaaactgacttctttgtgggagcaaagggctcgggaactaggatggaaacccgagaataccaaggcacacctatagtaaatcaaatacccttgtggatggggttgtatactatgtgtaccatagatcacattgcaaatacaacccactaagagctcgagatgatgtggaaacaaatgggtttctgtttgagcggactctagcacttgactctctttacaagccaagggcctccttgtccatagtaaatttgtattcagtttgtagtttactttcgttgctgtttgtgaacactgatgtgtgttgggatggtcataggatgacactgttcattattgtctagatgttctaaaaggagaaaagttattgtctg

SEQ ID NO: 150 - DNA, 1634 bp, Sorghum bicolor
acaagtagcagtgaccacctgatccgaaaagcaacaaggggacaaaatccaagcgtcggagggagcatggacatgaggaggcgcctctcgctggcccgcgtgccagcggtggcgacgatggtggtggttatgctgctgtcgctgagctcgtccttgtgcgtgtcggcggcgagggcggagcagcagcggcacccggtggtgctgatcccgggcgcgggcggcaaccagctggaggcgcggctgacggaggactacaagccgtccagcctcgtgtgccgggtgtggccactcgtgcgcggccgcggcggctggttccgcctctggttcgacccctccgtgctggtcgcgccgctcaccaggtgcttcgccgagcggatgacgctctcctacgacgccgacgccgacgactaccgcaacgcgcccggcgtcgagaccagggtctccgacttcggctccacctccaccctccgctacctcgaccccaacctcaagctcctgacggggtacatgaacactctggcgagcacgctggaggagaaggccggctacgaggagggccgcgacctgttcggcgcgccgtacgacttccggtacgggctggccgggccggggcacccgtcgcaggtgggcagcgcgtacctgcagcggctcaggctgctggtggagtcggcgtgcgcggccaacggcgggcgggccgcgatcctggtggcgcacagcctgggcggcctgttcgcgctgcagctgctggcgcgcagcccggcgccgtggcgcgcggcgcacgtgcagcgcctcgtcacgctctccacgccgtggggcgggtcggtgcaggagatgctcaccttcgcctccggcaacacgctcggggtgcccttcgtcaacccgtccctcatccgcgacgagcagcggtccgccgagagcaacctgtggctgctgccgacgcccaaggtgttcggcaacaccacgctggtggtgtcgcggagccacaaccggtcctactccgccaagaacatgacgcagttcctccgggacatcggattcgagcaaggcgtggagccgtaccgcgcgcggatacgaccgctcgtcgaggccctgccggagcccggcgtgcccctgacgtgcctcgtgggcaccggcgtcgtcacggtggagagcctcgtgtacggcgacggcggcttcgacgaggaccccgaggaggtggtctacggcgacggggacgggacggtgaacctggccagcctcgtgggcccgatcaaggcctggtctgactcgcccacgcaggtcgtcgaggtggtggagctgcccaaggtgtcgcactccggcatgctcaacgacaagagcgcgctggagcagatcatcaggatcgtcgattctataaacttcaacaccacgagctatcatcagtcctcttagagcaactccaacactaccctaaacttcacttggcaaatcttggattttgccaagtgtaaagctcaaatgccaagtgaaaaaaagaggcttctccaaaagttagctatttttgtagcaaatttggactatcttgtgattcctgaaaaaaatcagaggaacttttatgcaaaagttgcaatctatttaaggcatgcgtgcatgctgaatgtgtgggtcccaccgcg

SEQ ID NO: 151 - DNA, 2019 bp, Sorghum bicolor
cggtaaacatcagaccagtgacgaagcaaaatctaccatgacatgggagcatgacaaataccctctacctccttgtcctcgccgccgcggccggatcgtggtgcttgaccgtcgctggtgagtccatgagacgtgtgtcatccggtcgttagcctggccgttcagcgcggagcccatccggccatcccgttcgtatcgagccggcacttcggccgcgggtcaatccggcaagccagcgcgcgcgatgcgccagcggtggggcagctgcttctcgggcggcgacgtccgcgtgggcgggcgcgtccccgaggaaccggagccggaggtcttctccttcgcccaccccctccccttctggcccccaggcggtggattcgcgcaggggaggatacgcatcggcggaggggagctggagctcgccgcggccaccgcgttccagaagatctgcaccctgtcgtcgcggcggcgtggcggcggcagcgccaccttttaccggccggtcggcgtcccggcggggttctccctcctgggctactactgccagccaaactgccgcccgctgcacggccacgtcctcgttgccagagcgggggagcgcccgcccggcgccacgcctcagccgccgccgcttgcaaagccgctggactacgcgctcatctgggaattccatgccggtggcagccgtgccaatgccggccacggctacggccgaagcgacgcctacttctgggtccccgtgccgccggagggatactgggcgatcgggtgcctcgtgacgacggaacggcagagtccacctctcgaggaggtggcatgcgtccgcgaggacctcacggacgagtgcgagccgcacgggtcgctgctccgcctgcagctgccggggccgtcgtcgttcttcaccgtgcagggcgtgcgtccggtgcgcagagggatgtggaggaaaggagtgtgcgtgggcaccttctgctgcgccgctgacgggctcccgccacgcgagcacggcatggcgtgcctgggcaacgtcgagctcgacctgtcggcgatgccgacgctggagcaggcgcacgcggtgatccggcactacggccccacgttgttcttccaccccaaggaggtctacctgccgtcgtccgtctcctggttcttcaagaacggagccgcattgtacaagcgaggtggagacaccgccgcgggcgaggagatcgacggcgaggggtctaacctccctggcggcggttgcaacgacggggagtactggatcgacgttcccagcggcgagcggggccgcgccgtgtgccgcggcaacatcgacagcgcggagctctacgcgcacgtgaagccggccatgggcggcacgtgcaccgacgtggccatgtgggtgttctgcccgttcaacggcccggcgaggctcaagctgggcccgatcagcctcccactgggcaagaccgggcggcacgtcggggactgggagcactccacgttccgcgtcagcaacctcaccggtgagctcatgggcgtgtactactcgcagcacagcggcgggcactgggtggacgcctccgcgctggagtacatcgacggcaaccggcccgtggtgtactcgtccaggaacgggcacgcgagctacgcgtaccctggtgtgtacctgcagggctcggcggcgctcgggatcggcatccgcaacgacgccgctcggagcagtctattcgtggactccagcgccaggtaccgcatcgttgcggcggagtatctgggcgagggcgccgtcgtagagccgcagtggctgcagttcatgcgggagtggggtccgacggtggtgtacaagtcgaggaagcggatggagtggatggtcgggcgcctgcctccccggctcaagtgcagagcggagagcatgctgaacaagatgcccaacgagctgtctagggaagaagggccgaccgggcccaaggagaaaaacaactgggagggagacgagagatggtagggaacaatgctcgacgatatgatagatatacattg

SEQ ID NO: 152 - DNA, 1731 bp, Sorghum bicolor
gcgctggctttgccgtagcccgtggggtctttgggcttttggccatttcggcccaattctcgttggcttcccttcttccccttcccccgaaaccctcgctctcgggcagcccgcacaaagccgccggagcgccgcgccaccatgtaccggcttctcctccgccgcttctccacggctgccgagggtgccgccgccgcctctccttctccctctccctctccatccccctccacctccatgtccccgaccctgcggcaacctctgccggacaacctgtaccgccgcatcatgaatgtcgggcgcccatccatcccgctatcccccgtcctcaagcaatgggatcaagaaggccataccgtcaagaagttcgtcatccaggccatcgtcaagaagctcgtcggcctccgccgcttcgcccacgcactcgagctgtcgttctggatgaccgaccggaggcacctccacctgacggccggtgacgtcgcgtaccggctggacctaatcagcaaggtgcacggccttgagaaagctgtcgagtactttggcatggtgccgaagcggctgaggatgccgcagtgctacggctccctcctgaaatgctatgtggaggcaaaggccgtcgacaaggctgaggagcacttcgcgaagatgcaggagatggggatgaagagttcttatacatacacttcgatgatgaagctttacttagagactgggcagcttgaaagggtgcacgccatgttccaggacatggaagagaaaggtgtgaaacctgatacgttcagtgtggagagtatgttagctgcgtacattgctgctgaagatgtcgagggggttggtaaggtgctcgacaaggccaatccacatgaaaagcttgtgaagtggcatggacaagctttggcagcgagcttgttcatgaaatctgggatgcaggtgagagctgtcatggctctcctggaagccgagaggcggatatccccaaagagtagtaggatcgcatacgctttcttactgaagacatatactgatctggggatgtatcctgaggttggacgaatttggagtgtctacaaatccaaagtgccaccatccaacacgatgtacttgtcgaggataagtgcgttactcaagatgaatgacattgatggggcggaagcaacattgaaagagtgggaaacagtgtctcttcgttatcatgatttcagattaatcaacttgatggttgatgcttattgcagagaaggtcttgtggagaaggcagtagctcttgtggatgacgccatcaagaaagggaggacaccttatgctaatacttggtataagttggctggtgggttttttaaaaccggtgaggtatcaaaagcagtggacatgacaaggaaggctcttgaatctgcgactcctccatggaaacctgacctaacaaatgtgctaatgagcctggagcacttcatgaatcaaaaggatgtagaagcagctgaggagattgcgagtatgctacagaagctgggtcctttgactaaggaggtttaccattgtttactgaagacctatgtccgtgcgggaaagccagtgtccgatttgctcgagcgtatgaagaaagatggccttgaggctgacgaggaaacagagagaatgcgagtagatttgcacccgttgtcgatcactaaataatccattttctctgttcatgtgttccttctttgttcttgagctcttctcattagcttg

SEQ ID NO: 153 - DNA, 1760 bp, Sorghum bicolor
tccacggccaatccgattccaacctcaccgacggcgcgcgcctccgtttctccacctccaactccagctccagctcttcctcccggttcctcctcgccgcccccgccgacgacgcctccctctgtcggatccaccgctgaccgggccgctccgtctgcgccggcctgatcaccggctggttcttggcctcttcgcttcctgcgccgcctagacgtcgccatgggcaagagtaagaggaacaagggcggtcgaagtggcggtggtgccgatgaccagcttgacggtggcagcgatgccgatagcgtgacctctatgtcgactgcgctgtctgaccttcagctcgcgcaggccaccgagcatgttagctcgcaggaattcgttcttgacaactacattgacgctctctacgagaagaggggatccacaagagagaaagcactgggcgctcttatcgatgcttttgaaagttttgtgcttcttggtttagtggaaaacaaatatgtcaccctattgagccagttcaccaattcaattaaaaaaggatctacaaaggaggtgtgtctggcttgtcgctgcattggcttactgtcaattacactaggtgcgggaagtagttcgcacgaaataatggatgagtcacatcaacagcttttgagagttctccaaacttggcctgatgcaccaaaaatgatctctgcacttgattgcttagcagttgtcacatttgttggtgcaactgatctttctgaaacccagctatctctgaaagccatctgggatgtgatccatccaaaatcaggatcaaatgttggcattgtcagaaaaccgaagcctcctttgttagcagccgccgtatctgcatgggcatttcttttaacaactgttggttcatctagaagaaatactgattcttggaaagagccaattacatttctctgtagccttcttgaagcagaggatcgtgctgtgcggattgctgctggtgaagcattagctctgtgttttgagctaaaactgctggatgtttcctctagttatgaagctgatgttgacattgacactagagagaccagtggttctaaacatcaacttttcttgaatatgcaagcattgaaggccaaaatatctggtctagtctatagtctctccatggaggctgggggcagaggtgctgacaagaaaaatcttaatgatcagagagacttgttccaacgaatctcagattttattaagagtggtgagtgccctgaagaatcacttaggatttcaggcaagaatggcattttaagagttacaacatggcgtgaatcaatacagttgaactatatgaggcggtttcttgggcgaggattcctgaagcattcacaggataatgatttgctgcatgagatctttgacatcaaaattgatcgtactgaaaacatgtcaaccactaaaaagaaaatgtttagatccgaagaagagaaaggaagagctctgaagttgaataaagagcgtcgtctagctcaggagaggaaacagaatatcttgaacgagcaatatggatagaacctacccagaataccagagtttttgtatagtcgaactgttaccagatagcgagtgctgtgtatatgacggtatcgatgcaatgtcacaatggtgaggtgtattgcccggtattgatgggtaagtagaatacagtttcataccgaggaacatgtacagcgtcatgtttgaaattgcttgctccaaacattgagtattatagaaaggatcat

SEQ ID NO: 154 - DNA, 2106 bp, Sorghum bicolor
cgaggaagcaagagggaaaaagaaaaaaaagaaaaatcttggatgaggcattatccgtgaccacatatcgctggaccacgacctcctgaccaactgtcagcattcctcacaaagcaatcgccaagaacatcaacgtctgttcctgaaaatcgatatcaaaaatctaccaccggtccaccgctccggccgagatccatgctcgcagccaccccttcccggtccactgatccgatggccgccacggcggccttgagcttccacccggccgccttctcagtctcagctcacccacgagaggcagcagcagcgacgacgaagcagccgctccgccattgctcacctctcaggagcgtcgtccctagaagaacttgccttctcagggccaggtcctccaatgggcgcccgcagatcagtgcctcgttcggcaacagcaatgaggtgctagatgggatgccaacaggagatggtccaccggcaccggggcagggagggagcaccgtcagcatcaccgtcgttggcgcctccggcgaccttgccaagaagaagatcttcccggccctcttcgccttgttctacgaggactgccttccggagcattttacagtgtttggttatgcccgtagcaagatgagcgatgaggagctcaggaacatgatcagcacgactctgacgtgtcgaatcgacaaaagggagaactgcggcgacaagatggaacagtttctgaagaggtgcttctaccagtctgggcaatacaactcagaggaggggtttgctgagttagacagaaagcttaaagaaaaagaggcaggtaggctaccaaacaggctattttacctatcgatcccgccaaacatatttgtggatgttgtaagatccgctagccgcaccgcgtcatcttcaagcgggtggacgagatttatagtggagaagccattcggccgcgactcggagtcctcaggcgagctcactcggtccttgaagaagtacttagtcgaggagcaaatatttaggatcgaccattatctgggcaaggaactagttgagaatctctccgtcctccgcttctccaacctcgtcttcgagccgctgtggtcgaggaattacatccggaatgtgcagttcatcttctctgaagatttcggcaccgagggtcgaggcggctacttcgacaactacggcatcatccgggacatcatgcagaaccacctggtgcagatcctggccctgttcgccatggagaccccggtgagcctggacgccgaggacatccgcaacgagaaggtgaaggtgctgcggtcgatgcggcagctgaagctggaggacgtggtggtggggcagtacaagggccactccaagggcggcaggtcctacccgggctacgccgacgaccccaccgtgcccaagggcagcgtcacgcccaccttcgccgccgccgcgctcttcatcgacaacgcgcgctgggacggcgtgccgttcctcatgaaggccggcaaggcgctgcacacacgacgcgcggagatccgggtgcagttccggcgcgtgccggggaacctgtaccggcggaacatcggcacggacctggacaaggcgaccaacgagctggtgctccgggtgcagcccgacgaggccatctacctcaagatcaacaacaaggtgccggggctgggcatgcgcctcgaccgcagcaacctcaacctgctctactccgagcgctaccgccgcgagatcccggacgcgtacgagcgcctgctgctggacgccatggagggcgagcgccgcctcttcatccggagcgacgagctcgacgcagcctgggccatcttcacgcccgtgctcagggagctggaggacaggaaggtggcgccggagctctacccctacggcagcaggggccccgtcggcgcgcactacctcgccgccaactacaacgtcaggtggggagacatcaccagcgatgacgccgccttctagttccatccatttacgactccgagtacaagttgattttttttgttcgtgtacccaactagtaattggtccatcctgtaaattccaaagaacgcggtccatcgatttagcctgttcgcttgattgaaaagccatgcc

SEQ ID NO: 155 - DNA, 761 bp, Sorghum bicolor
catctctccgactcacctctctgtcctctccctgtgcaagccgtcgctagcgcctgccgccggcgaagcttctgcgggtcctcgtcgtcggccaggtgctggatccgtggcagcggcggccatggacaagagcatgctcggcgacctggacggcctccccgaggaggacaagatgcggatggccggcatgatcgaccagctccagatccgcgacagtctaagaatgtacaattccctggtggagaggtgcttcacagactgtgtggacacattccgccgcaagaccctggacaagcaagaggagtcatgcgtccgccgctgcgcagagaagttcctgaagcactccatgagggttggcatgagattcgccgagcttaaccagggtgtggccacgcctgactaatagtcccatgctggtttcattgcacctgccaagtttctaaccttggggattttgttagcacagatttgtaatccaaaaatgatttcggcacttcactacctgagatatgtgaccgaccgagttaggttgtgtcttgaaccaaatgctgggtatctgaataaaattgccttgagtcgggttagatgcttcgtatcgtggactcgtggttgatcatgtatcattgatagcttttcagaagtgttgtacttcgattcatacttgaaccagcggtttatttgagccagataagtgcatgttattgcttctacggtcagatattctttgtactgtagacatcgcgatacaggatttgttaagg

SEQ ID NO: 156 - DNA, 1911 bp, Sorghum bicolor
gcgcgctcctcctcggctcgacgccgagccgcgccttgcccgcaccgttgctggagaagaggaggcgggcggagaaggagaagaggaggggccgtcggcggggactggtgacggggcccgcggagggcaccggcgtgggccttctccgccttcccgctggggaggacgggcgctggcgtggggtcagcgacgaggcgccggcaggataaggggacagcagcttcttgggtcgcggcggatctcgcggggtggccgtgcgacgtcgccctggggtgcctctgcctcgacgccggtccaaccgaggcggagctcatgcgaagaagccgctagatctgccggcctctccacacctgcctcgacgcaagtccgggagggtagcgagcggatcgatgctcgcggagagagcaggggcgaggatataaggctgagcggtgcagagtagcggcatggagcgcccgaagaagaccgcggtggctggcctacccgacgacctcctggtggagatcctctcctgcctccccatcaacgagatccaccgatgcaagtgcgtctccaaaggctggcgcgacctcatcgcggatcccctccaccacaagaagctcccccaaaccctccatggttttttcccttcctacgtgggggagttgggatctttcatcaatctgtctgggggatccgcgtcaaccttcgacccttccttcgccttcctcaagaagctgcctggcattcacaacatctggctcagggcgtcctgcaacgggctcctcctctttaggcacagcaccaggcttcgcgagcttggctatattgtgttcaaccccgccactgagcagtgggcggccgtgcccagcgagcatactctggctgataggcctattcgcttcagccacacctgtttcgtgttcaatccggctgtctccccctacttccatttggtcatcatcagcgcgcggggggtgagcctggcaacagtgcaattctactcctcagaaacaggggtgtggaggcacacccagattgactgggctgaagaagtagagctgcgaagacaatggaataagcgggatcctcagatcagggggtgcaccccttgtgctgccattttcaacagcatgctgtatttgatcttgactgataatcagatatttgaggtggatgtggaagggaacacaaaaaggataatccgagcgccatcttctgtgggtgggcgggttcatggctgcgttccgcttttcattggtcaatcccaagggcgcctatattgcatcaatgaagaacattgggcagatggtatcccatctgaactgtccagtcgtgtttttagaagagactccgatgataattctaatctactgtcaatctgggttcttgaggactatgatacacaaaagtgggcccttaagcacagtgtgagctgttcacgtctgtttggaaggacaggttttcttggttacaatgttgttgccattcatccagacaacaacaatttcatgttcattgtatatcggaaacaccagctgatatcatatggcttgaatagcaaggaagtgcggactgtcggcacatttcaggaatccttgcagcttcctccttatgttccttgcttctcggacttcttatcagtggcacggcatgaagagatactaggggttggcgtgtgagataagcgtgaaggacgttgccagggcaggcgaccgtgcagtggccattgatcactcaggacagatagcacggaggtgggcaagacgaaccctgtagcatccgctgtgtttctgcattcgctctagcatgcacaagcttttgtatttgcttatgaaataggctatctgcctgtgacttatttgtttcatttcttatcctctttcttgagacgtcttatctaattaatactgcaaccacttctactactgc

SEQ ID NO: 157 - DNA, 1670 bp, Sorghum bicolor
accgtttgttcacactcaaactccctcgattttaataataacagcgaaaagaaaaccatccgccggaggccggagggcagattctccaccaccgcctccaccccgccctcacgacgcgaatctgcggcgaatccccctctcggattcctcctcggctccccgccccgccccgccccgatcgcgccgtccagaggccgccaggctccggcgcccccgcccgcccgggctcgccgggggtcgggatgccctgctgcccgccgtcgctgctcggagtcgggccgcggctgcgctccttcctccgcgactacgacgcgctccagtccctcgccctcgcgctcatctacctccagattgtttgtgcactgatcggatcacttggggcattgttcaatggggttcttgtgatcaacctggtgattggtctatttgctgttgttgcaattgagagcagtagccagagacttggccggacatatgctgtccttctcttctttgctgtcgtcattgacgttgcttggtttatactcttctcacatgctatctggacgattactcctgatgagaagtatggtcgactttttgttttctcactcagactagcattgtggatgcaaatcattgggttttcagtaaggtttttgtcttcattcttatggattcagatgtatagattaggggcttcttccagcacgccaacatattttgaaaccaaccatgaagcaagaaatagtttcttaagccctagatctgattctgttagacggagttccatggcagatgatatattgggaggttcaatctatgatccttcttactactcgtcactgttcgaggatgttcgaaacaattcatgcaatcatcagggtgataaacaaagtggtagtaatgacagtggttctacatctgcaggccagtctccacgacttaaatcttttgcttgtagatctcttctggctaatgatgtggaaagtggactaagaagaccattgaactcctaggataaaacagcgggttcatgttgaaggtggaccatattttgagaacctatacctgtagccattgttcatcgttctctttgaaacatagaggtttgcacaccgcagcagttcatttctcagaccagtggaagggcgttgtccaacaaaaggagcttggcaaatactgtaacggtgactgcctgtgttaccgaggatccacagcatgacagcagtcttgctgccattttggaccacctttcgtactcagcgagcttgagccggatggttctgcacagagctgttcagtttatgtcatgcgatatgtttactgcccatcacggtccatttttcagacctgccttcctgtttcttttagctaccaaggaaaaagaagcaggtagttcgttagttctttagtcacttggttattttctagcgtaggctggcagttgcttctctccgagcattttggtcattgttcatagtcttatcttgacaaggagcacatctctggatcagtaaaggaaagaaatgtaaatttcattcggttctagaaagagttcaaattcctgttttaagtatgagttttgttagaaacgttgcagggttttcacatgaatctgttctgtccccataggaatatagaaaaaaaaatccacattttgcaagttatacaagtcaattccgtctgta

SEQ ID NO: 158 - DNA, 1518 bp, Sorghum bicolor
aaaagcgagagcccaaaaaatggtcagattcatgctgctctgctcctgcatgccaccatcctctgcaccttaaaagtgactccaggggacccctcaacatcaacactgttcagccaccaaagcacgggagagcagaggaaggacgaaggagagcagagctttgtgggagcagcaatggcaggaacctgggtgaagatggagcagaagggtggcggccctggagcacgaagctcccactccatcactctggtggggcacacggcctactcattcggcggcgagttcaccccgcgcgtgccggtggacaacaccatgtacgcgttcgacctcggcacccagacctggtccgccctcgacgacgccacgggcgacgtgcccccgccgcgcgtcggggtgaccatggcggccgtgggcggcacggtgtacacgttcggcgggcgggacctggagcacaaggagctgaacgagctctacgccttcgacacggcgacgcgggcgtggacgctcctgtcctcctccggcggcgggccgccgcaccggagctaccactccatggtggcggacgcggagggagggcgggtgtacgtgttcggcgggtgcggcgacgccgggcgcctgaacgacctgtgggcgtacgacgtggcgagtgggaggtgggaggagctgccgtcgccgggggaggcgtgccgcccgcgcggcgggccggggctggcagtcgccggcgggaaggtgtgggtggtgtacgggttctccggcgaggagatggacgacgtgcactgctacgacccggcgacacgggcgtgggctgtggtggagaccacgggcgacaggccgagcccacggagcgtgttctgcggcgccgggatcgggcggcacgtcgtggtgtttggcggcgaggtggatcccagcgacctcggacacctcggcgccggcaagttctcggccgaggcgttcgcgctcgacacggagacccgcgcgtggacgcggctggtggacgacgacgacaaggcggaggcggaggcggagcagcagcagcaccccgggccacgcgggtggtgcgcgttcgcggcgggggagaaggatggccggcaagggctgctggtgtatggcggcaactcgccgaccaacgaccggctcgacgacatctacttcttcgcgcccgttcttgaagctgcggccgcaagctagcgcgcgcgtctggcaaactggcagtggtgaaatgtgtagcagtgcaatctgcagggcttgtatgtatgtatgtatgtatgttgtggtgaattgtgagtttgtgacgcatcatctttgcggacgtctagttttcttgctgttttcctttggtcggtttgtgggttttatgttgcgtgattgtattgaaacgggcgactgacagtaacgttatagacgtagagtgtacacacgcattgaaaggggaggcgagtgcatgtacgtatatacgtattgtgaaacccaatgaaaataaattaataaaatgttctgaaatgtcactttgtaagatca

SEQ ID NO: 159 - DNA, 960 bp, Sorghum bicolor
cacacagagggggtgtagccgagtagcagagcagcgagcgccatgtccctgtccgtcgccggcgcgcggacctccacctctcccctcccctcttcgttcgccgcctcttcatcccgcccgcgcctcctcgcgcttcctctccaccgccgctcgcacggctccctcgcctcgccgccggccgcgggcaggcggcggctgcggcggctgctcagggtgcgcatggcccggacggagtccaccggcgtaggtatcggcttccgcgcgccggagttcgagctccctgagccactgaccgggaagctctggacgttggatgacttcgagggcaactctgcactgcttgttatgttcatatgcaatcactgcccatttgtgaaacatctgaaaaaggacattgccaagctcacctctttctatgtggagaaaggacttggtgctgttgccatatcgtccaactcagttaggacgcatccccaggatggcccagaacacatggctgaagaagcaaagttgttcaaatatcctttcccatatctttatgatgagtcacaagaagtagctaaggcttttggagcagtctgcacacctgagttttacttattcaaaaaagatgggcgaaggccttttgaacttttctaccatggacagttcgacgattcaagacccagtaacaatgtgccagtaactggaagggatctaagccgtgcaattgactgtgcgctcagtggccaagaactgccctttgtacaaaagccaagcgtcggctgcaacatcaaatggcacccatgaggtgctcgtaactcatagtgtcgcgctgtggcgagaaacaaagccatgtttcacttctcggtacaatacaaagatggaacacctgattgaggtgcactgagggctgaatttgaagtcagtgttgactgcctttgggaacagagttgtgggggcagaaacctgggagctttt

SEQ ID NO: 160 - DNA, 880 bp, Sorghum bicolor
ctgtccccgttctgtctacgaggtgaacgcggatcggcggcggcggcggcgcgaggcgagcaagatgagcgggaacggggtggtgaagaaggtgtccgacgcggcgacgaaggcgggcaaggcgatcgactgggacggcctggccaaaatgcttgtctccgatgaggcccgtaaggagttcgccaacctccgccgcaccttcgaggacgtcaatcaccagctccagaccaagttctcgcaggaaccccagccaattgattgggagtactacaaaaaaggaattggatcaaaagttgtcgatatgtacaaggaggcctatgaaagcatagagatccccaagtatgttgacactgtcactcctcagtacaagccaaagttgcatgctctgttggttgaaatgaaggaagcggaaaaagcatcactaaaggaatcagagaagatagagaaggagattgctgaaatgaaggagatgaagaaaaagatcagcacgatgactgcagatgagtactttgcgaagcaccctgagctgaaacagaagtttgacgacgagatccgcaatgattattggggatactaaggcgcagtgtcacctttctttggaacatccaataatacatttcgccccctaaatgtccttaggagttaaccatccaaacttcacgaattgtgtagcgcatgtattgggcgtgccaaagttccaagtaacttgtctgtccttgcaccatggtcagacctcacattttgagtgtcataagggtcttatgataattttggttttgctctccaaacattatggaaattaactcaggttgtggttgctggtttgtttgttttttttactagaaaaaagagttgctggtttgttggaatatacactcct

SEQ ID NO: 161 - DNA, 1753 bp, Sorghum bicolor
cgaacctcgagatagctggtggcgtcggagggaggcgcgagctcgcagaaggagacgaggcccgagatgagatctgagtcgaactccagcgagctgcccttacgctcccgaagttcctgcaaggcgcccttcagccactcgccggacgtgctcgccgacgtcgccatcgccgccgccgacgccgccaacaaaagggccggacaagaagggttaacttcttttttgctattcggaccctcgatctataggatatttcacgaatagtacttctacatttacatcttctatttttcaccttgtagtgtgcgtgattttcgaaagactcctcatcttatccccgcgagccgcgagacagacttcaccgtggtacgccgtacgcggcttctcttcagtctgagcattcgcagagcagagagtgtagaaggcatgtttccgatggcgtcttcctcactatcgccgccgccgctctcacttatcctcctccggccgctcccgtgcagacccgtcctcctctcgaggcaaaggaagccatttccaactgtccgcgtagaagcaaggcctgagcagcggttgcagcggcggccggtgaccggccggtggaggaggggcggaggcttcgcgtgtttctcctacaatgccaataacaagacgcccccgccatcagataagagttcagacaagtgggcgatccttcgccgatgggatgtgccatgggagtggcaaaccgttgtgctcagcatggtaggctgtggagtaagctttgttctgacaggattggttgagcaatcggctttgcaatacctgggatttaaagctgtggaggcaactatagatgagaaggcagaaatactcttttttgggcaactgagcgtgacagtagtagtccttggcgttatatttagcatcaccaacacttttcgaccattcccagatgatatgtttcgttatgatattaaagaaccattcaagctgcagaatggatggcttttgtgggctggagttggcctctttggagcaataatttctattgctttagccggagctgctatgacttatctgaatggtgaaactccagagagagagactgattcactagtccttttgttgcccctgattggctcatccactaccagcactgcctttttggtgggaatcactggagttctagcaccacttctcgaggagactctgtttcgaggatttctaatggtgtccttgactaagtggtttcctactccattttgtgtacttgtgagtgctgctgtatttgcccttgctcatctgactcctggacaatttccacagctgtttatacttggtgttgcattgggtttttcatatgctcagacccgcaatcttctaactccgatcacaatacatgcattttggaactcaggagtaatacttctgctaacctttcttcagctgcaaggatatgatctcaaggagctcttgggagcatcgtgaaggtttgaacaaaccagacattttgtgcataatatgatatgaagtagatctatcgggtatgtgctcttgcacacctgatgccagcaaaaccacgtgaaaaagaaatatgagtcttcaagttagctgatggttgcgtttccagaagtgttacgaggcatcactagtctgtaaaactgtttatactataagatggcagattggccttaatgtaagaacagctgtcctttttgagagtgtttcttacaactggagtactcaattaaattttgctgatattgtttattaa

SEQ ID NO: 162 - DNA, 895 bp, Sorghum bicolor
ttgaaccctttggcccacacgacagcacagcagccggaggagctaggacaggcgcggcggcggcggataggaaactgaggaagctagagccatggtggtacggatccgtctggcgcggttcgggtgccggaaccggcccttctaccgggtgatggccgccgacagccgctccccgcgcgacggcaagcacctcgaagtcctcggctactacaacccgctcccagggaaggatggaggcaagaggatgggcctgaaattcgaccgggtgaagtattggctgtcagttggggcacagccatcagatcctgtgcagagtattctctttcgtgccggacttctgccaccacctccaatgctagctatggcacggaagggtgggccacgcgataggcgccccattcatccaatgactgggcgccccttggatctcgagggcgtcacaattgtcgatgactccaatgctcctgaaggcgacgctgaagagcctacagatgaggtggcttcataagcctcttatattagcatatgaaaatatgatgtattttctatttagcatatgtagtggtgctgcaaaagaaaacttgtttgttgtgcttctgacaagacttgagtactagtacaatgtggcaaaacttttagacaggtaatctttcatccgattttcttctaaaaaatggcagtgccattgtttgttctcatagaaaatgtaaaaccaatgccattgtatgcatctttagcttttgttctgcagcaccatcagcttgtggtctctagtattctctgcgctttttgaaagaaaaagggcaggagctctgccttgcatttaagttctctatacttggctaataagatttgcatgtgaaatggaatatgcatgataagtcgagccttgatg

SEQ ID NO: 163 - DNA, 3332 bp, Sorghum bicolor
ctcccctctcgccgagccattcgattcctctcctctccgcttcccccaagcaaatcgccgccatttcaccgattgcggccgctgcctagggttttggtgtgagcgtagtcggagggctgcgtctgtgggtcacgttcccagtgtcgcgcgcggcggccgaaggtggagggaggggcggttctgcggagaggaggtggaggtggtggtggtggtggttgtggtcccggtggctgcggagcgcggtctccagggagcgagtctatcagatgctgcggcggcctttgaggtggtagtgtggccgtgtggagcgaataagtggcagcagcggcggcggcggcgggactggcgtaggcagccatgtttttcagcaggctcgatgactcgcccatgttcaggaagcagatgcaatcgcttgaagaaggagctgatttgctaagagagagatgtttaaagtttcacaaaggttgtcgaaaatacacggaaggactaggcgaagcatatgatggagatattgcattcgcaagttcacttgaaacatttggagggggtcataatgatccaatcagtgttgcatttggaggccctgtaatgaccaaatttacaattgctttgagagaaattggaacatacaaggaagtattgcgctcccaggttgagcatatgctaaatgacaagctgctccagtttgtggaaattgatttacatgaaatgaaggatgctaggaaacgttttgacaaggctacccttctttacgaccaggcacgtgaaaagtatttgtccttgaagaaaggtacaaggactgacgtagcagctgcagtagaggatgagcttcacagtgccaggtcttcatttgagcaagctcgtttcaatctggtgactgcactttcaaatatcgaggctaagaaaaggtttgaatttttggaggctgttagtgggacaatggatgctcatcttcgttatttcaaacaaggatatgaactactacatcagatggaaccgtatatcaatcaagttcttgcatttgcacaacaatcaagagaaaggtctaactatgagcaggctgctcttcttgagaggatgcaagatttcaaacggcaaattgatcgtgaaagtcggtggtcaccaaatggaatgaatgattcccctaatggtgatggtatacaaacaattggtagaagttcgcataagatgattgaggaagcaatgcaatcagcttcaaagggcaaggttcagaccattcggcaaggctatctctctaagagatcttcaaacttgagaggtgattggaaaaggaggttctttgtcctcgacagtcgaggaatgttatactattatcgcaagcagaacagtaggccatctagtggttataaccaaaggactagcattccctcagaacatggttctgggttgctcagcagatggttctcttctcattatcatggaggcgtgcatgatgagaaatcggttgcacgccatactgtaaacttgctaacatcgaccattaaagttgatgcagaccaatcagatctgcggttctgcttcagaataatttctcccacaaagaactatacattgcaggcagagagtgcaatggatcagatggattggattgaaaaaattactggcgtcattgcttctttgctgagctcccagtcccctgaacgacgtcttctattgagtcctaagggcagcagccatcatcgaactgccagctcaagcagttcattcagtagctcaacagaacttgaacattcaataaatgaagattgtatgctggaaaagaactcagggagtggttatttcgagcattctgcaagagttgcacagcatcatcgaacaagcatgatgaaacctgacaagccaattgacttgcttaggaaggtggctggcaataatagctgtgctgattgtggtgcttcagagcctgattgggcatccctgaaccttggagttcttttatgcatagagtgttctggggtacacagaaatatgggtgtgcatatatctaaggtaagatccctgacgcttgatgtcagggtttgggagccatctgtaatcaatctctttcagtcaataggcaacacgtttgccaatactgtctgggaagaaatgttaccttcatcaacctgtgttgaccatggtgatatttcaaggcctgatggattagaaaacatgtcacatcgctttgcacccagcaagcctaaacaatctgattctatcgcagtgaaggagaagtttattcatgccaagtatgctgaaaaggattttgtgcggaaacataatgtggatgagattcaacttgcagaacagatgtgggacaatgtaagttcaaacaacaagaagggtgtgtacagtttgattgtggggtcaaatgccgatgtaaatttttcttacggtcatacatcatttaattcggctttgactctgggaaaagctctccttctacaagagcaatcaacttctccatctaatggaagttctagatgttttgatctcaatccacttgagaagggttctaccggggattctgtttctcctgccagcacaagtgcccgtatagatggattggatgattacgttgaaggattatctttgcttcatctagcatgtcgtgttgcggacctgggcatggttgaactactcttgcagtatggtgcaaatgtaaattctacagattcaagagggcggacaccacttcatcacagcatcatgaaagggagacatgtgtacgccaagctactgctttccaggggtgctgattctcaagccgtggaccgagatggtagaacagcattaaagtatgcaatcgacagcggaaccatagaggatgaagagatccttgttttgttagaggacccaagtagataaatcatgtaggtagtcaagtctcgagttcctgcggtaccttgtgcttttgtggccgcctgttgcagtcacctggcacacggccgaggatacgtttgctgatatttcttagtttgtggcgagggaagttatagttttctagggctatctgcggttttggtcgcgcttagggtaaagtggcctgtttgtcgtggatggatgcagtttgcgagttgtctttgctgcctttgtttgcagatgttgcagtgtacattgggaagtggttgccattgttgtgacagatgtacatatagcgatgtctgatacaagtaatttatgcaagaattagattggtgaaaacgtggctgtgctgtatgtctgcctgtctttgagtcttgatcgatcagatacaaaagagtatgaatgaatgcctatacagcgcaaaccactggcactgatgtttctactccgctgttgtacatgttgcc

SEQ ID NO: 164 - DNA, 3028 bp, Sorghum bicolor
ggaggaggctgctgtgttatattgggggtggctctagcctctaggattggaggggctctggttggttgcctagacgttcgccgccgcctctcccctgccccgaccgcgaggctccgtcgccggcgatggcgtcgccggccggcggcgggtctccggctaagcccgtcctcctgcacggcgacctcgacctctggatcctcgaggcgcgcctgctgcccaacatggacatgttctccgagcatgtccgccgctgcctcgccgcatgccgcccgcccagctcctgcgggaccaagcacccgaccgccgccgcgcgcggccccggcggcggccgcggcggccgccaccaccaccggaagatcatcaccagcgacccctacgtcacgctgtccgtgtccggcgccgtcgtggcgcgcaccgccgtcatccccaactcccaggaccccgtctgggaggagcgcttcgccgtgccgctcgcgcaccgcgccgccgagctcgagttccaggtcaaggacaacgacaccttcggcgcgcaggccatcggcaccgtcaccgtccccgccgaacgcgtcgtgtcgggcgacgaggtcgaggactggttccccgtcataggcaccaacggcaagccgtacaaacccgacaccgcgctgcgcctccgcttcaagttccagcccatcgccaacaacccggcctaccgccacggcatcgccggcgaccctgaccacaggggcatcgaggactcctacttcccgctccgccacggcggccaagtcacgctgtaccaggacgcgcacgtcagggaaggggacctgcccgagattgagctcgacgacggcaagacgttccagcacaacgcgtgctgggaggacatctgccacgccatcctagaggcgcaccacatgatatatatcgtcggctggtcggtgtacgataaggtgcggctcgtacgcgagccatcgccgtcgcggccattgcctgagggtggcgaccttacgcttggcgacctgcttaagttcaagtcgcaggagggtgtcagagtgtgcctgctggtgtgggatgacaagacttcgcatgacaagttcttcatcaagacgggtggagttatggcaactcatgatgaagaaactcggaagtttttcaaacattcctcagtcatctgtgttctctctcctagatatgctagcaataagctgagcattttcaaacagcaggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcagcaggtgcaaagggacccaggcaaccatggcatgatttacattgcaggattgatggtcctgctgcctatgatgtcttgcttaattttgagcaaaggtggcgaaaggcaacaaaatggcgtgaccggtttagaagagtatctcattggaaagacgatgctttaattaagctggagcgtatatcatggattctaagcccttcacccaatgttccaaatgatcatcctagtttgtgggtttcaaaagaagaagatcatgaaaagtggcatgttcaggtatttcggtcaattgactctggttccctaaaaggatttcctagtgatagcaaagaagcttcaaagctgaatcttgtgtgccggaaaaacttggtaattgataagagcatccacactgcatacgtccgagcaatcagatctgcacagcatttcatttatattgaaaaccagtattttcttggttcttcatatgcttggccgtcctatgtgaattcaggtgctgataatctgataccaatagaactggccctcaaaattgcaagtaagattagagcgggagaacgctttgcagtgtatgtagtgataccaatgtggcctgaaggagtccctactgcagcatctgtgcaagaaatccttttctttcagacaatggagatgatgtataaaataattgcagatgagctcaaggcaatggacattaaggatatgcaacttgaagattacttgaacttcttttgtcttggaaaccgggaagaaccaccatctaatggcagcccagaatcagagaaatctacagataaaagtgcagcgggcttagctacaaaatatcgacggttcatgatctatgttcacgcaaaagggatgattgtggatgatgaatatgtcattctgggttcagcaaacatcaaccagagatccctggctggttctagagatactgaaattgcaatgggtgcataccaacctcattatgcatggtctacaaagaatggacatcctcatggccaggtatacgggtatagaacgtctctctgggcagagcaccttggaacggttgatgatcgcttcaaggatccttcgagtttggagtgtgtaaggcgtgtgaatcaaatagctgtagagaactggcaaaggtttacagccgaagaaatgagtacattacaagggcacctcctcaagtacccagttaaggtggaggctgatggtaagatcagctcactgccagaccaagaatgctttcctgatgttggcggcaagattctgggagcttcaacttcacttcctgattcgctgaccatgtagagttattattacattttttttttcagagtcgagcttcgtaattgtctaaacttggtgcaattgtcactgaacttgtactgtatctgtaatcatccatagttggcgcagggaaagctcaaggtgtcggtggtgtttgtagagtcgtgctcctgtaagttttcccagcatttgtaaatgaaccatatgataggatccttgacaatgcttccatttccattgctattatacaactgttctgaacatttttgttcaaccccatgttcacactgtggccgtgatggaagtgccatttcttattcggctggaaggactgaaatgctggggattct

SEQ ID NO: 165 - DNA, 2242 bp, Sorghum bicolor
gtcgccgctcgccggggccagggcagggcggttggtatactttggttgttgcatttccttggcgaaggagaagcaagccgcccgtccttttgccgctggcgatgctcgccggcagctgcgtctttgtcgccctcgcgctgcttctgccgtcggtaccgccggccgcggcgacccaggagttttactgcgacgattccacctatgcggacaacagcacgttccaggcgaacctgaacctcctcggcgcggcgctccccgccaacgcctccgcctcgccggcagggtacgccacaggcgccgtcggtgcggcgccggaccaggtcaacgggatggtgctctgccgcggcgacacgaacgcttcctcctgctcctcctgcgtcgcggctgcgttccgggacgcgcagcagcgctgccccctcacgaagggcgccaccgtctacaaggacgattgcacccttcgcttcgccggcatccggttcctcgacttcctcagagaggaccagtggctcgtctcagaattggttccctcgattgacccgggccctgggagcgtcaacgccgcagatgcctggttcgacgccgccgttacggggatcttcacggccctggtcgaccgcgcggcggcggcgagcaacgcgacgaggaagtacttcgccacgggggagatggatttcgaccctaagctctacgggctcgcgcagtgcgcgccggatctgacgctggcgcagtgccagagctgcctcggagacctcgagtcgagggtgacgacgcagttcctgagcggacggcccctcgggaacaacgctttccatgtgtggtgctccctgaggtatagtgtgtcgccgttctacgccggccgggcgatgctgcagcttccggcgccgccggcacctccaccaacggccacgcccacgccccattcttcagggaggaaaatgaatgcagcaggaatctctgcaggcataacctgtgttgttgtgttgatgttaattctttcggtctttttctttattcgcttcaggctaaggattaaagtgaagaaaaatgatcactcactgaagaagatagggagagctcaatgcacgatctttgatttgctgacgctggaagaggcgactgaacatttctcagagaaaaataagcttggagaaggtggttttggtattgtgtacaaggggatactgtcagacgggcaagagatagcagtcaagaaacttttaggaagagccgggtctgggttagatcagctacagaatgaggtgcagctactggcagagcttcagcacaagaatcttgttgggttacagggtttctgctcgcatcataatgatacactgctagtttatgaatacatcaagaatgggagccttgacagcattctatttgatgatagcaagggaaatgcacttgactgggagcaacagtacaacatcatctttggaattgccaaggggatattgtatctccatgaggactcaaccatgaggatcatccatcgggacctgaaggcaaataacattcttcttgatgacaacatggaaccgaaaattgcagattttgggttggcaaggcttataggagaaggccacacccatactcagacagccagagttgttgggacattcggctatatggcgccagagtatgtattgcatggtcgtgtgtcgcccaagatcgacatctttagcttcggcgtgttggtccttgagatcgtgaccaggagaagcaactgcaactctgatgaccacagcactgtgaatctccttagtgatgtctgggatcactggaagaaagggacgatgtcgcaaatgcttcatggatcgctgaatgagtttgctcgaagccaagcgctgcgatgcatccacattggcctgctgtgtgtccagccggaacctgacgataggcctgacatatcagccgtagtgttcatgctaaccagggatagcatagagctcaagccgccggcgcagcctgcattcttctttggtagcgaatcaccttcagcttcacggtcagatggtcaaagcagctatgtatatgcccggtctggtttcatgctggaacagggcgtctctgtgaacgggattacactcagtgaactgtatcctagataggatcaaagtctggatactgagctcatggaatacagctgaaacttaaccactttggttaacatgttgaactctctatgagttcccaaattggcatgcagaaatgggttttcataaaaatttcactaaga

SEQ ID NO: 166 - DNA, 829 bp, Sorghum bicolor
cgacgaagcgcacactcacggtcagagaaaaagctccgacgacagctgagatggcacaagccatggcgtcgatgaccggcctctcgcagggcgtcctgcccagcaggcgcgccgccaacagggccagggcggccgccgtcgtcgtcagggcgtccgccgagggcgaggccgccgcggcgcagccgggccgccgcgccgtgctcgggctggtggccaccggcgtcgtcggcggcgccttgtcgcaggcggtgcacgccgcgaccgtcaattccatcaagatcggagccccgccgccgccctccggtggactccccgggactgaaaactctgaccaggcgagggacttcggcctccccttgaaggatcgattctacctgcagccgctgccaccggcggaggcggcggcgagggtgaagacgtcggcgcaggacatcatcaacctgaagccgctcatcgacaagaaggcgtggccgtacgtccagaacgacctccgcctcagggcctcctacctgcgctatgacctcaagaccgtcatcgcttcaaagcccaaggaggagaagaagagcctcaaggagctcaccggcaagctcttcagcaccatcgacgatcttgaccatgccgcgaagatcaagagcaccccagaggccgagaaatactttgcagcaaccaaagatgtgctcggcgatgttctcgccaagataggctagacggaagggctaataatggccatttaatttcgaacttgtgtttgttcatatggagccggcaatgtaccattttctgttgatattgtatcagaaagcacttaactatgatgctatcctgagtt

SEQ ID NO: 167 - DNA, 1280 bp, Sorghum bicolor
ctccttcctccccgtctacccgtcagctggccgtcgcacccaaaaccccaggctgccagccgccgccgcgacccaccacgacaccatgtccgctgcctcggcgctccggccgaccgagctatttcccctccctagcgggctctccctttcgccgcgcctcaagcttctgctcaccttcttccgcgccgaccttaccgtccggcccctcgacgagtggcagctcaagtccgccctcctcgccttcctccgcgacccgcctctctccctcccgctcctccccgactccgacctctccgtgagccgcctccctgacctccagaagcgccgccgcgaggagcccgtagcctctggggtcctccacgttcgcgacctcaccttcctccgcccccgcaagggcgacggcgaggccgaggagatgacccgggagcaggaggaggagaagtacttcgagtggcggaacaccctggtccagaagctcgaaggcatcgagctcaacctcgagggagtgaagttccggatgaccgttgagatcccgtcgtccgacgacttcagaacgatgaagaagtcatgggaggatttctactcctccgagctactcaatagcaggaatccggtgagaaagatagcaaaaaggccagacactattatcgtccgtggcgtgccttccagatggtttgcggagacaagagtatcatccaaaccttccacgctggtcacccacactattttctcagctcttggtaaaataggcaacctaaaaattgccaatgatgatgagatagaagctaaaggagatggagccagtaaggagctcatatctggacttaattgcaaagtttgggtgcaatttgagaactatgatgacttccacgatgcaatgaaggcattatgtggacgctctttagagaaggaaggatctcggttgaaagtagactatgacgtgacctgggaccgtgaaggtttctttcgcattgctcaatatgagccagctggtaacaattcaggggagagggattcatcagcatcggttcatggccggaggaaacatcacacttcacgcattgagtcagattataggaagagattcagggattgatgacacaggtccatggtatgagcgatattcctttgtcctctggagagggaaaacagctgcattgtaccactattgtttcattctcagatttgaagttatatttctcctctgttcacacttaaccgaacagaaaaatcttctaactaattgatagttattattagtatcagttttatccttgttg

SEQ ID NO: 168 - DNA, 868 bp, Sorghum bicolor
gtgtgacgacgggcgaggcagacctctgcactctgcaaacctccccgtccgctcggcccggtcaaacaagtcaggtagcagcgtcgtcctccggtcagagctcaagaagcccaccgcgatcgacgcggcgcaggcgagacagcatgggtgggggcacggcggcagagcccccggcgtggatggccgccgccgcgcgcaggtggctggagaacgccggcgccacggtggaggacgccccgggccgggccttcaacgcgctgcccctctccggcgtgcgcgtgtccctcgccgagcgaggccgcgcgctctgctccctccgcgtgccgccccaactcacagacgcggaggggaactggcacacgggcgccatcgcggcggcggcggacgacgtgtgcgccgcggccatcatgtccgtcgagggcatcatcaaggtctccgtccactacgacatctcctacttcacaccggccaagctccatgaggaagtggagatggacgggcgggtggtcgagcagaaagggcggatgacagcggtgacggtggagatccggaagaaggagtccggcgagctggtggccatcgggagacagtggatgacggcctccaggcccaaaggctctcagagcaagatctgaagcttcctttaaatttaatcagtagcttgaaaattaatcagcaagatctgaagcttcgttgaaaattcagttccagatgttactggtgttgatgtcccctgtaatttaatcatgcattggcaagcaagatggaaattttcatctctgtcctgcgttaatcccggctctttttttatactaatcccacctcttttctgcgtcactttcagttgcattgctagcagcgtttttta

SEQ ID NO: 169 - DNA, 1840 bp, Sorghum bicolor
catcacccactctccacgcggccgcacacctataaatacgccagcaaccacccttcccgtccaagtcaatccaacaaccagatcagccaagcaaggcaaggcgcagcagcaacaacaggggagcttgcttacctggtccccaatccccattcccatctcctcccggccgcctgcctcttcccttcttccttcaacaatccttcaccaactccatcccgtgatccatggcggcggccaagtccatcgaccggctgccggcgcgcctggtggttccggccgagccgacgccagccggcccgctccacctctcctggctcgaccggtaccccacgcagatggcgctcatcgagtcgctgcacgtcttcaaggcggcccccgccaccgctaccggcggcattgacggcggcgccgccgccagcccggccaggaccatcgagcgcgcgctggcccgcgcattggtccactactaccctctcgcgggccgcctggtcctgtcggagtccggcgcgcagcaggcggtggactgcagcaacgccggcgtgtggttcacggaggccgaggccgcctgcaccctcgaggacgtggactacctggaggccccgctgatgatccccaaggacgacctcctcccgcccacccccgccgcaggcgacgaggaggacgagcgcgcgctcgtcctgctcgtccaggtcacctccttcgcgtgcggcggattcgtcgtcggcttccgcttcagccacgccgtcgccgacggcccgggcgccgcgcagttcatgaacgcggtcggggagctggcacgcggcgccgaaaacgcgttgtcggtggtgccgcagtggggccgcgacgcgatcccggaccccgccgccgcgctggtcgggcgcctcccgactcccgacgccgacagcaagcggctcgagtacctcgccatcgacatctccgccgactacatcaaccacttcaaggcgcagtacagcgcggcgcacgcgggcgccgcgtggtgctccgcgttcgaggtgctcatcgccaaggcgtggcagagccgcacccgcgcggccgggttcgacccggactcccccgtccacctctgcttcgccatgaacgcgcggcccatgctgcacgcctcgctcccgcgtggcggcgccgggttctacggcaactgctactacatcatgcgcgtgtcggcgcccgcggggaaagtggccgggtcctcggtcacggaggtggtgaagatcatcaaggacgggaagcggcggatgcccgcggagttcgcgcggtgggcggcgggggaggtgggcgccgccggcgtcgacccgtaccagatcacgtccgactaccggaccctgctggtgtccgactggacgcgcctcggcttcgcggaggtggactacgggtggggcccgccggcccacgtcgtgccactgacgaacctggactacatcgccacgtgtatcttggtgaagccgtgggcccacaagccaggggcgcggctcatcacgcagtgcgtcaccccggaccgcgtcgccgccttccacgagggcatgctcgacaccagctgttgaacaggtctgtcggtctgtgtgtgttggaatggatgagaagtacgtacagcccaaggcgttaatggattaaggttaatggagtgattaggtggtggtagtactatgtggggattggtattggattagctaactgatgatgggtggggttgaagagtgtggatgcattggttggtggtgatgtgtgtgttacctgctgaataactcttcagactcctcaattcagggagtttggggaaactgagctgtattgcatctggtggggggaagccgccacctactta

SEQ ID NO: 170 - DNA, 2366 bp, Sorghum bicolor
gctctactcggagagtgtcctcgcgcctcctccccctctccgcccggctgccctcccctcccctcccctcccctgccaccagcccaccaccacccctcctcaaaacgccaaaatttccccacctctccacgccctttcccctcctcccgagatcccatccatggccgcctcccgcccccggatctggcgctgagcccgccattgccggatccctgccaggcctcctccccgccgtcgcgctcccggcccggttttattgggcgcggcgtggcattccctctcatctcgctgcgttcaccggagggcggtggttgatctgtaccggcgggtgcggcgcgccttgcgatctcttgctgtcgccgcaggaggatcggccgctcgtcgacgttgccaagcgcgctcttttaaggcccggggattcgcgcgcgccccgtgtccgtgctgccgacaggaggccgggcctgtcggaatggtcgtttaattggggagatttgatgtgttgttggtgctgccggatctcgccgacatgtggaagcaatttattggaaagctgtcgtggaaggcgatgaaatccagctctggcggcgggggcacgggctcgccgcctgcgaagctgccgccgcacctaccatcgccgcgggagaatggggcctcgccgcgggagaatggggccacgccgaagcccaacgtctcgcctccgtctcccgcggcgggagccggagccggggccggagccgaggtgaggtctagggaggacgcctttgtccagaaggttaacatttgctgcgcggtgtacgacttctccgaccggggcaaggactcgccggagaaggagcggaagcggcagatgctcatgtccctggtcgactgcattggcgctgctgaggagcccctcacggagacaatgatagcagcgtgcgtgcgcatgttcgccgctaacctgttcagggtcttcccgcccaaagtccggtctggcacctcgacttcggagaccgaggaggacgagccgttcttcgatccgtcctggtaccacttgcaagtcgtttatgagtttctccttaggtttgtgacttcgccgctcgtcgatgctaaggtggctaggaagtatgtggatagccctttcgtctccaagctgctcgatctgtttgattcggatgacccaagagaaagggactgcttgaagacaatattacatcggatatatggcaagttcatgggaaatcgaccattcatccgtaaggctgtgagcaatatcttctataggtttgtgttcgagacagatcatcacaatgggatcgccgagctgttggaggtctttggcagtgtaataagtgggtttgccaagccattgaaggaggaacataagttgttcttatggaaagcattgataccacttcataagccgaaatcagtgggagtgtatctgccacagctgacatattgcatcacacaatttattgagaaggaaccaaagcttgctgggactgtgatcagaggcctgctaaagtattggccagttacaaatagtcagaaggaaattatgtttttgggggagttggaggaggtgctggagttgactgacatggctgaatttcagaagtgcatgactcccttgttccgaaagattgctagttgcctgaatagctctcattttcaggttgcagagagagccttgttcctatggaacaacgagcacctattcgatatgatctcccaaaaccgtcaagtgatcctaccgattatatatccagctctggagcggaacacccgctggcactggaaccaatcagtcctcaatgtaacaatgaacgtgcggaaaatgttccgtgaaatggatgagaggctgcttctagcctgccaaaacaacttccaagaggaagaggagaagcgagccgcgactgaggagcggcggaggctcatgtgggagcagctggagcggagcgctgctcgtgggcatcaccaacctgtgatcgccgcagacgcaagctttcctgcgcccccttcgtcggctcgtcttgtagccccaaccgtgacatgagaatgagattgcaacaaaacgtgctccgttttcaccaccttggtagctaagctagatgaagttgcttgcttcaccggggatgcacaaaggcattttgttaccttctgtatgcataaccccctgtcaaagtatgtaattaatagttgatggtttgaggacaaagggacattttgaattttgcatggcgtattcttgaaatgggcatgtgttttcttcttgcctgaaatcttgtctgattctaccagagtgctctctgctctgtatatctggagtctggacagtatgcatcgtgggactgtgggaggatgacaagtaacaagtttgcagc

SEQ ID NO: 171 - DNA, 1600 bp, Sorghum bicolor
tgcgtgaggccgtgaggggttgaggaggtctgggtgtactatgttggattggtgggcctgaactggtgggctggatgggcgcttgtgtgcccgggcgtctatttgtacctgaagtctgacctgaccttgctgccggagaacaccctgactgcgatggcggcggcggcggcggaagctccgagcgcatcggcctcttccgcggagaacaggctcctgcagtccctcgcagaccgcggatggcgcttccatgaccccaccgacgaggccatccaggccctgctcctcgcttcccccactccctcgtcggaggccgtggagtccgagctcgtcgacatggacttgaggttgttcggcgtcaagtaccttcccgaccgggccaccgccgccgccacgtcgaagcggctttcatacctccacggtcccgtcgtcttgcaggtagtctctgtaagggatatatatcgcagcatcattgatgcctcctttaagaacccacagcagcgtcgtcttctgcgctttggtctgactgatgggatatgtgaagcagtagccatagagttttctcctatcccattcatcactgaagagatagctccaggtgccaagattcgccttgagaataagattccaatcaataatggcatattgtgcttaagcgcgaaaaatgtgagtgtcattggggggactgtccaatcattgtatgaagaatggcagatgaaccagaagtactctggcttatctcgtccatccttgaggttgtctcaaagtgatgatggagttgggcctccaccatttgagaagttagacattgaggcacgtccctgcagggcaaccaaagttcaagcatatcctgctaggaagttggcagatactcatgaccatgccccagttaattctggtggcaaaccaatgaatgaggattcgaacgatgtgaacaaagacactattgaaagcaaggctgaatctaaggaaattactcaagatagcagacaaaaagaagtcagtgaagctgttcctgtccaaaaccaagctgctgctcagaagctactgcagaaaatgtcacaggctatgcctgaagacaggcgtggtcggggtcatagattcaagggcaaaggtaaggaagaagatgctcaggtttttacccttgatgaatgggagaagaggaaagccattggtttgaagcccgcagcagaaagctatgtgcatgacactagccgagatgaggagttggcaaggcaactgcaggaacaactagatctagaagatatgcatggtggggcagatgttttcagtggtggggcggagagttcagatgctgaacgtttacggatgagcatgttcagcttcagtggccctgatgaagcaggtggtggtagaagagattttcgaggcaggggccggggcaggggaaggggccgaggacgaggaaggggcagaggaagattttagtccagcgatacagttggaggtttaggtttataggtttgttgtgtgttcagtgtagtgcactggttgtaggggtaaaagtggtacgatgatgaccttctcaaatcatgtgcccattttcactagcctaagcctaatggataaggctgatgctagt

SEQ ID NO: 172 - DNA, 1840 bp, Sorghum bicolor
ccaacgacaacctccacatcgtcttcctctccgcgctcccgtcctctccacctctcgctcccacctccacctccaccgccaccgctaccacagcctctcccctcgccacgccacgcgttcccgccccgtgcatgaaaccctagccctcctaaaccccacctcactccccgagccatcccctcactccccgcgtcggcgatggccaaggcgctgctctcctcctccctcctccccgcgctgccccgcgccgccgggggcagcgcgagcaggccgctgctgctcccgccgctccgtctgcggcgcggcggccggcgcgccgcctccgcgtgcgcggtgagggcgggcctgcacgggctcgactccgtcggcgggccccacctccaggccacgctggagcgcgccgaggcggcgctctacacgctcgccgacgccgcggtcgccgcggcggacgcggggggcgacgccggcgaggcggctgcggcggcggtccagaagaacggcggctggttcggcttcatctccgaggccctcgaggtcgtgctcaaggtcctcaaggatggtctctctgcagttcatgtgccatatgcctacgggtttgccatcattctgctcactatcattgttaaggcggtgacgttgcctctaaccaaacagcaggtggagtcgactctggcaatgcagaatttacagccgcagcttaaggcaatccagcagagatatgcgggcaatcaggaaaggatacagctagagactgctcggttatacaagcaagctggtgtcaaccctttagcaggatgttttccaacattggcgacaatacctgtatggattggtctttaccaggcactttcaaatgtagcaaatgaggggctgttcacagaaggatttttctggattccgtcactgggaggtcctacaacaattgcagctcggcaaagtggttctggaatttcgtggctcttcccatttgtggatggtcatcctccgctaggctggcatgacaccatatgctaccttgtattgcctgtgctacttgttgcttctcagtatgtctctatggagatcatgaagccacctcagagtgatgacccatcacagaagaacacactgctcattttgaaatttcttccatttatgattggctggttctctttgtcagtgccgtcaggattgtctatttattggcttacaaacaatgtcctcagcacagcccagcaagtttggttacggaaaatgggtggagcaaagcctgtagtgagtaagggaggtagtgggataattacagcaggacgagcaaaacgctctaatgctgaaccagctggagagaggtttaggcagctaaaagaagaagagaacaggagaaaactcagcaaagcacttgctgcaggagattcagatgcatcatcatcaacatatgacatggaggatgaagaattagatgatgagaccacagaagagggaggacctgtggaggaagcatccagtactggcagtgacaagaaacttccaagttactcggggaagaagggcaaacgatccaagaggaagcgcatggtgcagtaatcgttacagcctaattggatgcattttttgtcacaactggttaatttagttgaccagttaggtgccacagttgatctcggagacagttttggtggtctgttggaggcctatatttgaggtgcagacaaatagacgatttccggggtcacaggtgagctcagtatatgctaggcctgagggtaatggacaggagaacaggagtcgggtatatgggcaagcagagatacaggaatctgtagaagtagataagatactctggtgtattctgtacaagttg

SEQ ID NO: 173 - DNA, 1936 bp, Sorghum bicolor
taaacggctcgctagtatcatggcaagcaatcaacaccatctataatccgggcatcctttgcattgtgtttaggttaggaaaattaaaagaccagcagctattgctagtaactactcctatatatatacataaccggctggcaggcaggcccatgcgattaacgcggcggcagggcagggcaggcgcagccatggagaaggaagagccggcggcggcagagcttgagatccccggcgagtgccagtacgcgggggatcccgtggtggtgcggccgagccagccgacgccgcgccacaccctgcacctctccaacctcgacgaccagcggttcctccgtttctccatcaagtacctctacgtgttcgcgtcccacgccgccgtgtccgccgacgcgctgcgggcggcgctgggaagggtgctcgtcgactactacccgctcgccggccggctccggcccagcgacgaggaggaagggaagctcgtcgtggactgcaatgccgagggggcgctcttcgccgagggacgcctcccggggctcaccgccgccgacttcctccgcggccgcggcggcgccacgccgcacaagtcctggaggaagctgcactacagggtggaggcgcagagcttcgtcgccgtgccacctctcgtcgtccaggtcacttggctcggctgcggcggcatggtcctctgcaccgccatcaaccactgcctctgcgacggcatcggcaccgcgcagttcctccacgcctgggcgcgcgccgtgcgcggcggccaagatgcaccgggcgccggcgccgacgacgacgacgacgttgccctgccgttccacgaccgccgcgcactgcgcccgcgctgcccgccgcgcgtcgcgttcacgcacccggagtacagcagcagccgcggcatcagcggcgccgtagtcggcaacggcaacggcaacgggaacgcgaacgaggcggcgccgagcctgctggcgcgcttgctggggcagccgctggcgcccgtgtcgctcaccttcacggcggcgcacctgctccggctcaagcggcagtgcgcgccgtcgctcaagtgcacctccttcgaggcgctggccgcgcacgtgtggcgcgcgtgggtgcgcgccctggacccgccgggcgcgctccgcgtgaagctgctcttctccgtgaacgtgcggcggcgcctgaagcccgagctgccccggggctactacggcaacggcttcgtgctcgggtgcgccgagtccacggcggcgcagctggtgaccgctgccccgtcctcggccgcggccgcgcgctacggagtgcggctggtgcaggacgccaaggagtgcgtggacgacgactacgtgcgctccatggtggacctcctggaggagcggcgcggcgcccggccggacctggcggcgagcctggtcatctcggcgtggacgcgcctggggctggaggacctcgactttggcgccggcaaggccgcgcacatgggcccgctcaccagcgagatctactgcgtcttcctccctgtaatgggcgacccgcaaggcgtcaccgtgctcctctccgtcccgcaggccgccgccgacaagttccagcactgctgcctcgaattcctcaaggacaccgacgtggacgcaaagctcagctgatcgagctatatcatccggctgctagctcgatcaccatgcattctgcatggtacttatatatcagaaaatgagtcatgaatactaattactccggccaatcgagttgaaagaatgatcatccgcctatgatcataatcatgcttgtatgcactccgatccgtagcaatatcaatcaatgggtgatgagctcctttttgtgttatcatcaattagctgctcattgcacatatttttgtctgtctctctaataaacatgtagtaccactccctccggttcattatatctagcg

SEQ ID NO: 174 - DNA, 1602 bp, Sorghum bicolor
tcaaaagcaaggccggccggcttcactgtcgtgtctcgctctcacctgattccttccgcctcgtcagcgaaccagacccacccgagccaacaacccatggccgccgcggcgccgcctctcctgctcgcgggcctcgccctcgccgtcgtcgccgccgccgtctggccgtccctagctgcggcgccggcggcgctgcaggacccggcggagctcctgcgcagggccaaggagccggcgttcgcggactggatggtcggggtgcggcggcggatccacgagaacccggagctgggatacgaggagttccagaccagcgagctcgtgcgccgggagctcgacgcactggggatcccctacaggcaccccttcgccgtcaccggcgtcgtggcaacagtcggcaccggcggcccgcccttcgtcgctctgcgcgcggacatggacgcgctgcccttgcaggaaagtgtggaatgggaacacaagagcaaagttcccgggaagatgcatggttgtggacatgatgcacatgttgctatgctgttgggatctgctaagattcttcaggagcatcgtgatgagttgaagggtacagtggttcttgttttccaaccagctgaggaaggtggcggtggggcccagaaaatgatagaagctggagctctggaaaacatagatgccatttttgggcttcatatagctgattctgtgcctattggtgtactggcatccaggccagggcctattatggctgggagtggattctttgaggccgtaataagtggaaagggagggcatgctgcacttcctcatcacactatagatccgatattggctgcctcaaatgttattgtgagccttcagcaacttgtttcccgagaagctgatcccttggactcacaggttgtaacagttggaaagtttcaaggaggtggagccttcaatgtgatccctgattcagttactataggcggcaccttccgagcctttctgaaagagagttttaatcaattgaagcagcgaattgaagaggtgattgtgtctcaagcatccgtgcagcgctgcagtgctagcgtggacttcctcacaaaggaccgtccattcttccccccaaccatcaacagccctgagctccatgatttcttcgtgaatgtggccagcgagatggttgggtcgaggaacgtgagggacagacaaccgctaatgggtgctgaggacttctcgttctatgccgaggcgatcccctcaacctactactactttgtgggcatgtacaatgagactcgtggaccgcaggcgccccatcactccccctacttcaccatcaacgaagatgccctcccctatggtgcagctgcacaagctgctttggcagctcgctatctactcgagcatcagcaacctgctgctaccactgataaggcaaaaccccatgatgaactgtagatacataacgtttgcttcgctctgttaatgaaattagattgagcaacaatttctttgccaagctattccacggctgtacatatcctgatatctccatgctttggtaataatcggttgctgatcaattgtgggatcaggcgttatttggcgtgatgttcagtc

SEQ ID NO: 175 - DNA, 2540 bp, Sorghum bicolor
ttagagctcatatggtctgaatgccacaattggaactttgcacctaaaaacagagaccaagttcactacttcattatatcctttcatacacagaaagtgaatagacatggaccgtgatgatatagctggtttcgtcagcggaggttgttatgagtcctgactttctaaccaagtatatataacagagttatgatatccagaaggcaggaaaatgtttcttttcattttctagttggtttgcatttgatgttatgcaattggaatggacacaactactggagacctcgagtttagtggtgatatcaacttcttgaagccatattgctcttggagcacaactcaagacacgactgtgcacaaagatagtacaccagaggcttattccagcctttttatttccaacccagaagcgtcaaaagggaagcaaggtgctatgtctagagcaaaaggtactggaaaccctttactcactttgggtttaggccgctcaccaagttcatctgataacagcaagctaagttctggcactgcttgcataacatcttcatctttattaaaggaaattgatgaggagtcttcagtagatcttggccttaaccttgggtttcatattggcaatgatattgcacactgccgacagaaatcccatgctagttttgaaaatatgctctcgacaaactctcctaaactggatcttcagttgagtttatctattggttcacctgaatcagttgtcatcgatgcaaatatgatgtcaccagatggcatggtgatgccgacgaccaatttgccacccgccactgtagaagaaggatcagtaccacctagttggggttttgagcattcgattgtttcatcatcatatgcttctgaagcaacatatgcccctgtgccttctcctgtcatgtcatcaactatgtttacaagtgtgaaaagtccagttgcctctacttttgagacaactaattcccaactacgcaacaataacacaaaaagctgtcagtttccaggatgtatgaaaggagcaagaggggcatcagggcgttgcatagcccatggcggtggtaagcgttgccacaaatctggttgtcagaagggcgctgaagggaggacaatctattgcaaggcccatggtggaggcaggagatgtcaatttcttgggtgtacaaagagtgctgaagggcgcacagaccactgcatagctcatggtggaggccgtcggtgcagtcatgaaggttgcccccgagctgctcgtggaaaatctggctcgtgtatcaagcatggtggtggcaaaaggtgtcagaaggagaactgtaccaaaagtgcagaaggtcattctggactctgcattgcccatggtggtggaaggcggtgccagtttccagactgcacaaagggtgctcaaggaagcacaaagttctgcaaggcacatggtggaggaaaacgctgcacattcttcggatgcaccagaggggctgaaggtagcacttcattttgtaagggccatggtggaggcaagcgctgcgcctttcagggtggtggtgtgtgcccaaagagtgtgcatggtggcactcagttttgtgttgcccatggtggtgggaaaagatgtgctagccatggctgcactaagagcgctagaggtcgtacagagtattgtgtgcgccatggaggtggcaagaggtgcaagtttgaaggctgcaccaagagtgcacaggggagcactgatttctgtaaggcccatgggggaggtaaacgatgttcatggggccaggcagacacaagctttggtgctggtgcacagcaatgcgatagatttgttcggagcaagactgatctatgctcagctcacagcgctttagtccaggaccactgtgttcatggcggtggtacattaggttctgctatctaccagtttgcggtggatgtcaaacctactgagatgaaggttgctttagtgaagggagatccacgcgagaagatcaacggtgataaaattttactggatccgggtagctctgttccaaatagtggtgttcatcatcctgtcctggttcagtctatggtcgatccactgccagagggcagagttcatggtggtgggctgttggctttactttcgcgggccggaagcagaacaagcaacggtggctcagaattgtactccgggcaaggtggtgtggatgtgaggctatcaggttctccaagaaattgattgcctacagttttgatcagttcccaagtttgtgctgtgatggactgagtcagcctttcagattcctccaaggttgcataggatctatccggacgtgtactgtgaaaataagagggtagctcttagagcagatgtattgtgtgttattgtaattacttaatgtggttgtggctagagagagtaaccttttgtttcagtgcatttaatcagtcaccttaatgctcaagtttggacttgatttaactctgagcaatttgcttgctttgggctgaaatataatgttcatttagttgcttattctggtgagtatagtaatttcagaaaagca

SEQ ID NO: 176 - DNA, 1566 bp, Sorghum bicolor
cttccgattcagcattccgtgccacctgtttccgcattccgccattccgccttctgttgctggggttttagacaaaaatcactcgtcccatttctcgcgtccccaggccacggtcgcgagcaaggccaccacccgctgtctcgatccaccgattcccctcctcttccgttcctccacggatctgctcgctgtggaagcggaggaggacgctggaggcgtctctcggcagcgcgaggattcccgagctgttgttgtggtgggaaatgaggatctgcgaattgggagacggtgacggggggctggtgcttcagcaggagcagcaggaggaggctgttcaggcgagcggtggcggcgagctcgtacggcttaaggcgaagcgcgcgctcgtcggcgccggcgcgagggtgctgttctacccgacgctgctctacaacgtcttgcgcaaccggtacgaggccgacttccggtggtgggatcgcgtcgaccagtttattttgcttggcgctgttccttttccaagtgatgttccacgattgaagcagcttggagttcaaggggttgtaacgttgaatgaaccttatgaaactcttgtcccaacatctttataccaggcgaatgagattgagcacctggtaattccaacaagagattatctctttgcaccttcactcgaggatatttctcaagccatagatttcatccaccggaatgcattacaaggcggtactacgtatgttcattgtaaagctggaagaggacgaagcaccactattgtattgtgctacttgattaaatacaggaacatgacccctgaagcagctttggatcatgtccgatccattaggcctagagtgcttttggcaccatcgcagtggcatgctgttaggtcatttggaagtctcaccactggacaacttccagttcggagtacgaacctgggctgcttcttagaagccattgaagctcgttgtatgaacacggaaaatgatgattaccacgtgatggagtttgactgcgaagatagtggcttaccactttctcaaattatgctatctaagccagccagccccactgggtgcaccgatgcagtcctcataacagaagcagatcttgagggctatgatacttatattggtactaggaaagatgccgtgtcattggtagtagccactcgcaggcccatcatgaggagattgtcctgcctctttggctccctgaaacttaacagcagcagttgtgaaccagcttcaagccggttcactgaggttcgtgcctgctaggtagtgtctttctccagttttccatgttgaatcaagagtgtatctctagataggcaatcatccaaataggatttgtagaagcctgagtttatagccatggcagtgccatcgggaagaaagttgtgtgcatagccagaggggttgtttagtttttagagtgtagagctgtgaacgtgtcgaatatccttgttttttttctcaaaagcatgtgattcattgcaatttgcatcattgtttacttgaaataaaagcaggccttttcagccgccggggcggcatcgacctc

SEQ ID NO: 177 - DNA, 2346 bp, Sorghum bicolor
cgcgcatgctacaggaatagcgacatcgcgcgcacctgaaagacctcctcgtcgtaggagaagggcttgagctgcagcgcgcggtacccgccgtcgttgaaggcccaggtgcgacacacattgagccccgcgccggcggcatccgcgagggcggcggtgactgcggggcgcgtggcggggtcgcccgcgaagtacatgagccagtaggtgttgaagccgtggacgacgaagggccgccccgacgcccacaggtgcgggccccggcgctccaccgccgcccactcgccctcgtttgcgccgcccggcggcatggcgagtgggatgcagcaggaggccgcgaggaggacgcagtggaggagcgacacgcgtggcgtcgcttggagcggcggcgccgccaggcgaggacacgtcgggctgctccactcccacgccgattccatgggtcaatgacgggtgggtccggtcaggcagggcgggtcaacgcccgccacaacggcggcagcggcatctcgaggcttgctctttgtttggaggctgacacgtggggcccacagcacagccacagcggcagaaagaagccccaagcccccaaccgaacaaaaacgctatcgttctcgtcgggagccgcgacggcgcgcatggcggcgacggcggcggcgcttcggtgctgctttcccggctcctccggtgtcggcagtggcttcgtgaaagccaaatcgtccaggcgaggctggtgcgcagcggccgtggcggcgccgtcgcgggaggcggagccggtttcgtcactggggcaccgtacccgcgtcgacttccccatccttcaccaggaattcgatggtgctaaattagtttacttcgacaacggtgcaacatcacagaaaccttatagtgtgatgagaacactagatgagtactaccgatcgtacaattcgaatgttcatcgtggtattcatgcactcagcgcgaaggctactcaagcatatgaggatgcaagaagaaaggttgcaaattttgtcaacgcagctgatagcagagagattattttcactcgaaatgctactgaagctatcaatctggtagcctattcatggggactatctaacttgaaagaaggagatgagattgtccttacagttgcggagcatcatagtgctattgttccatggcaatttgtttcccagaagactggtgccaccttgaagtatgttggattgactaaagaaaatgccccagacattgagcagttaaaaaggcttctgtcgaacaagacaaagatagttgttgttcatcatgtcgcaaatgttctaggttccatgcttcctattgaggagattgtaacatggtcaaacagagttggagctaaagtccttgtagatgcttgccaaagtgttccccacatgccagttgatgttcagaaacttggcgcagactttcttgtcgcatcctctcataagatgtgtggccctacaggcgtcggatttttgcatggtaaatttgagattttgtcatctatggagcctttcttaggtggtggcgaaatgattgcagatgtattccaagacaaatccacatacgctgagcctccctctagatttgaggctggaactcctgcaattggagaagctataggattgggagcggccattgattatttatcatgcattggcatggagcagatccatgaatatgagaaagagttggggacatatctgtatgaaagccttctttctgttccaaatgtccagatatatggtccagcaccttcccaaactgttcaccgtgctccgctgtgttctttcaatattgagaatgttcatcctacagatattgcagaaattcttgatctgcagcacggtgtagcaattcggtcagggcatcattgtgcacagattttgcataggacccttggtatcactgcaagtgctcgtgcaagtcttcacttctacaatacaaaagatgaagtggataccttcatcgatgcgcttaaagccactattgatttcctcacgtctaaatactagtgtggttcgattagtaagttgtccgtttttgtcagtttggtcactctctcatttgagctgctgtacagagaaaaagtatacatatattcggtacaaagaaaacatacagtggacatcttctcaaactgtactgtacttccttatttggcggttcttgttaaattcaacgaggttcaggatgcatagagtagaaacgaccatttttaaccagcatatgagaaatcctaggtcaatgttatgcagtaaaatgctgtgttatatttgtgtcctgcacttgactcgccagcttgccataaactatatcaagctagtgagcactctttct

SEQ ID NO: 178 - DNA, 1068 bp, Sorghum bicolor
cgtgaacgtccccacgaacccatcacacgctccgcccactccccccacccctctccacctccgacgaccaccaccaccatggcggccgcctccctcgcgcgtctctcccgccgcgccaccgcctccgcctccgcggcggcgccgtccctccggcgcctcctctcggccacctccaccgcccccgccgcggcatccgccccgccgccgcccccgagcgcggccgccgccgcggccgtgggcgcggatcgggtgcggtgggactaccgcgggcagcggcagctcgtgccgctgggacagtggatgcccaaggtggccgtggacgcgtacgtcgcccctgaggccgtgctcgccggccaggtcaccgtccacgacggcgcctccgtctggagcggcgccgtcctgcggggggatctcaacaagatcacgctcggcttctgcgccaacgtccaggagcgatgcgtcctccatgccgcatgggcggcgcccacagggcttccagctgagacacttgttgaccggtacgtgacagtgggtgcctactgtctgctgcgctcttgcaccatcgagcccgagtgcatcattggccagcactctatcctcatggaaggttcgctggttgagaccaactcaatccttgaagctggctctgtattgcccccaggaaggcggattccgaccggtgaactctgggctggaagcccggctaggtttgttcggaagctgaccaatgaggagatcatggagattccaaagctcgcaactgccatcaacgatctgatgcaaagccatttctcagagttcctgccttactctaacgcttatttggaggtagagaagttgaagaagtcgttctcgatccccctgtaagagtatgttgccaccctcgtccagctgagtgaatgaggaaataaaggttccccaatactagatgtttttgtattgaatcaaacttctactctgggtttgatcttttatgccgcaatttttttttggggttcattgttgttgtgagcatggggacacatgcaggaatcatgtctgagtatcttttacacaacccaatgaact

SEQ ID NO: 179 - DNA, 1264 bp, Sorghum bicolor
cttcttccctgccaagaaagggggaggagatgcggcgtcccgtgcacggctttaaaacctcccaggtcaccacgccgccgaatcactagaaaccccaaaccaaagcgaatttcaccaccagcgagcaaccccccaccgcaagtaagatcaaggaggaggcgatggctggcggcgggcaggcggcggtgtcgttcctgacgcggatggcggcggcggcggcggggttgggcctggcggcgtccgcggcctccacgtccttctacacggtggacggcggggagcgcgccgtcatcttcgaccgcgtccgcggcgtgctcccgcagacgacgtcggagggcactcatttcctggtccccatcctccagaagcccttcatcttcgacatccgcactcgcccccacagcttctcctccacctccggcaccaaggacctccagatggtcaacctcacgctccgcgtcctgtcgcgccccgacgtcgaacacctcccggacatcttcaactccctcggcctcgagtacgacgagaaggtcctcccatccatcggcaacgaggtgctcaaggccgtcgtcgcgcagttcaacgccgaccagctcctcaccgagcgtccccacgtctccgcgctcgtccgcgaatcgctcacccagcgcgcccgcgagttcaacatcgtcctcgacgacgtcgccatcacccaccttgcctacgggccggagttctcgcaggccgtcgagaagaagcaggtcgcgcagcaggaggccgagcgctccaggttcctcgtcgcgcgcgccgagcaggagaggcgcgccgccatcgtccgcgccgagggggagagcgaggccgcgcgccttatctccgaggccacgaccaccgcgggcaacggcctgatcgagctcaggaggatcgaggcggccaaggagatcgccggcgtgctggcgcgcacgcccaacgtctcctacatccccgccggcaacaatggccagatgctgctcgggcttaacgccgcccggtgaatggatcgtctctttccccgtgattagttagtgcctcagtgtggcctattgaactacttcagtaatttcagatagttatggttttgtggtacgattcgatgatggtgatatgcgttgctcataaagttcggcagactgagaatttatccaacaattgtttcattttattgtcagaatactcgatcgttattgtgatttgtgaatgtgatgtctcttgttcgatgtacttcttgtctgatctatatgtgatttag

SEQ ID NO: 180 - DNA, 1145 bp, Sorghum bicolor
gcccacttctgttccgtggacccacacatcagtaaccaactcagcaggctcccgtcccgaccaccagataagctgcaagctgcttatcttctcccgtcccctgcaactggaaggaaggaacacgtccgcgccagccaagcagagaggggatcccgcatccatggaggtggtgggcggcgtttcgctgaggccgtcgccagcgccggcgcgtatccgacggaccaccctgtcatgcgtcgacgtaggccgacgcctcgttctcaggcccgcaggggcgccgctgggccagctgccggcgaggcgcgcgctggtagtggaggcccgggggaggagctggtcggaacggcagatgcagcagcagcggcgcatgccgcagctgcccaagatcgaggacgacggcaacccgcgattcgtcatcttcatccgcaccgccaatgtctacttctggtacccgctcaacatcatcacgggcgggacgacggcgaagatcatgcttgctgctaaggacaacttcctcggcaagtacatctacaaggacacgctcgccaggaacctcgctgccgtcatttacaaagatgaggatgagattatagacacagcaaaagagcagtaccgtgtgctcaagaccgaaaatgagtttcggtatggctacaaagttgtggagaaagggaacataaggtctgctctgacgacaagcaatgtgattgaacttccaaagaaagacgagctcaaaactgtggttgacaaggtgaaggacttctttggcgatgtaactgctggcgccaaagaatcctttgcgcagataaccgggtctgctgtcagcaaagaggaagaggaagcagaaaacaaagagaagttccgctccaagaggcgaaagaagcagcggaagtcgaaggagggcctcaagacggagaaatgattcagtcactcagcacattgtcagacaagtaaagcatcgatcggctgtagtttcgctatccatgtcccagagctgctctgtaatttgtccagcttctaaatttttgcaaagagacaacgtgtaacttccttgcgactaacatgtgttttgccttctcactaaatttcacaaaatccggtgaaggggttaaggttactttctcattccaattatatgttgttttgtc

SEQ ID NO: 181 - DNA, 1501 bp, Sorghum bicolor
ctccttctcgtggacaagaacacacgcacacacggaagaagctactagctctcggcctcgctcgctcgcagagtcgccctctcgattctctctcagtccagctccagcgtccagccgcagcagcagtccccttccccctcctccatcaggcgttgcctcccgcagatccgaattggaatttgggccttcgtctccacaccaccaatccggaaaggaaaggaaagggaagtgatgggggagtgcgaggacggcaaggagtacaggtgctgggaggagctgttgccggacgcgctgggcctcatcttccgcaacctgccgctgcaggagatgctcaccgtcgtgccgcgggtgtgcaagtcctgggggcgggtggtcgccggcccctactgctggcaggagatcgacatcgaggagtggagccagcagcagagcaagccggaccagatcggccgcatggtcgagctactcatcggccgcagcggcggctcgtgccgccggatcagcgtctccgggctgccctgcgatccgctcttctcgttcatcggagacaacgcacgagcccttcggacgttggagattcccaggagtgagatcagcgactcgatcgtagaaaccgtggcgccgcggctatcaaacgtcactttcctagacatcagcagctgcaccaagatcggagcccgtgccctggaggctttcggcaagcactgcaagtccctggtggggctccggcgggtgatgcacccgatcgacctggtggacaaggtgtgccagcacgacgaggcgcacgccatcgcgtgcagcatgcccaagctccggcacctggagatggggtacatgctgatcgcgacggaggcggtgctggagatcctggggcagtgccgcgacctcaagttcctggacctgcgcggctgctggaccgtggacgacaagttcctgcgggagcgccacccggggctccgcgtcctgggcccgcgcgtcgacgactgctacgagaacagctactgggaggagtgctccgactactcggacgactcctccatctactcgtgggagttcatggacgacgactactacgccgtcggaagcgacgacgaggccatctgggacgacgggcagggactggagaacctcgaggtgaggttctacggcggcggattcagcgagagcttcgccggcttcgactggccaccgtcgccgtgagaccttccgggttgcgttgaccatttgcggttcttggctgcttctaccgtgtgcgtgcgtgcgtgcgtgagcctttgtgtgttgttcccaaagctttgcttgcagatgtgtgtgctgtgctgctgtagtactgtgcctgcgacatcactccatctccctcgagcttgcagatatgtgaagtgaactgctaattgtacaatctagatgtaaactccggtgtttacatgaaggaaatcagcatgctgcaccggtgagatttcaccggtgccatcccccatcctactaatcggctagtcctaga

SEQ ID NO: 182 - DNA, 1238 bp, Sorghum bicolor
gagccgagcttgtcgtcctaatcctgccatccatccagagtccagggggcgttgccgcgttgcgttccgctctcccttttctgctgcgacggctggtcgagcgccggcgccgccacccttcgccagctcttcgcaggcgacgagcaccgaccagacatgggggaaggtggagaagagaagtcattcaatttccttcaagttttgctcgagggcagcatagccggaggaactgctggtgttgtggtggaaacagcactttacccaattgatactataaaaaccaggcttcaggctgctcgaggtggaagccggattgaatggaaaggcttgtattctggattagctggaaatcttgctggtgtccttccggcctctgcaatatttgtcggagtgtatgagccaactaaaagaaaattactggagacacttcctgaaaatctgagtgcagttgcccattttactgcaggggccattggaggtattgctgcttcccttgtccgtgtccctacagaggtggtcaaacaaaggatgcaaactggtcaattcaagtctgcacctgatgctgttcgtctcattgttgctaaagaaggatttaaaggactgtacgccggttatggttcctttctacttcgagatcttccatttgatgccattcaattctgcatttatgagcaaattcgaattggctacaaagctgtggcgagaagggagttgaatgatccagagaatgcacttattggtgcttttgctggtgccatcactggagctataacaactccccttgatgtcatgaagacaagactgatggttcagggacaagggaaccaatacactggaattgtaaactgtgctcagacaatcctcagggaggaaggccctaaggcattcttgaagggcattgagccgcgagtgctgtggattggcatcggcgggtccatcttctttggtgtgctggagaaaaccaagtcgatgctagccgagaggaggaaccgcgagctacgggccgtcaaggacgaatgagtgaagatcatttttttaacgttgaattcctatcatgtgaaactagataaacaaaatacaccagggccttctcgtactccagggcgttcacgttatcacgtacacgtcgaacttgaccaataagcccacggctccatgccgttagcctcagcgccctcaacaaccagcgactactgccgggtccggcgccctctgccggtcgcctgagtcctgacttc

SEQ ID NO: 183 - DNA, 1202 bp, Sorghum bicolor
cgcacgcttgcactagctcatttcccaacgcgcacccaaacatggccgctccgaccgccggcgtcgacaccaccgccccgcctcctcctccctcggcagagcccgcggctgcacccgcaccggatcaaaaggtctctcctcctcctcatgcccctcagcccgatgcgcctgcgcccgcggcagcaccggctcctgcgcccgtgcccgcgccagcgccgaggaagcggaagctcgaggaagcggggttccacacctccgaatactacaagatccgtgccgtcgtcgccgacctgcgtgtccgcttcgtccaggtttaccaagctactgatttccgcaacacggatgctgctcgtgagattttgaaagaaataaatgtggtcatggatctatccaagaaaatgaggctcaagcttggtgctacttctgagcccgtgaaaccattggagaaaccttcagctggatttgtgaaggatgagcttgtgaaaccatcagagaagctttcagctggacctgtgacagaagagcctgtgaagccaacagagaagccttcagctggacctgtgaaggacgagcctgtgaaaccatcggagaagccttctgctgaccctgtgaaaaaggaacccactgagccagttccagctggagaaaacaatcaagctcctggggttagccagactacaattcctccaaatgatgcaggtgttggtgcaccagtagtcaagcatgataactcagaggcgcagaagtgaagatgatagaggaaacccaaagtcccgatccattgagatggcagatcatgcaaatctgctcgacaaaaatgcagagtgattggttgaacccctaggggctcagattttcttgcctcttctggaggtaaaattgattgctttgggctaatcgacgaagagtggtgggcatatcaagatccaaattagatggtgttcagttgttcgcattcattcattctgtactgtgttgctaattgctcatggataatttaatctttaaatagttaccctgtaactggatcattctatacatcacattgccctgttgtacgaagtattagccagtcaatttggggtgtgtggggttggccgcttgagttgggttttgttgactcgactctgtagtacactgtccttttctctctttatatgaaatgacacgcagctctcctgcctcttgagaaaaaaaaaaaa

SEQ ID NO: 184 - DNA, 3120 bp, Sorghum bicolor
atagctgggccccgggtaccagaccacccgagcccacgcgcagcggcagcagatcgagccccagttccagcagagtcccattccgccacgaaaaaactcgctttccaaatctctctctcactctctttcgttttgtccaaaaacacccaaatcgtgtcgcttaaatctgcgcgattcataacgaatcgccatagttaatcgaagcattaaacgagggaaaaaaaggggagaaaaaaaggagagggacagggagagagagggaggcggaggccatcatcccattcgccggctggtcctgatccttgtccgggtctatttgggcggcgccgcacgcagcaggagggagagatcagcgcggggcatttacgatggtggacaagaatgatgggtcagagggtcttaaattcaacacgtcaaacctcattcaaacaaccgaagaggttgcaagagcgtttattgctgcggcttcggctgccactgcacagtctgcacggccatctgtagtgtattcatccaaagatgagagtggcagcccaatgcagaagcttcagcagcaattctcgaaaatcatgaaagggtttacgtcctcaccggacctgtcaggaacttacaatccagaagtgcttacaactcaaaagcggcagtggtcgaggtaccagctgaagtcattgggtgataggtgcatcagagaaccatcacatctgttcgagagcatagtgattgttgggcttccacctaacgcagatatccaggagctggaaaacattgcactagggagaaatgatgaagatggaaagagatcaagaaatttatttagcaatagccaccaccaagttcacgcaatatcaaatttggaaccacaggttctttttgcgtaccctccagagaagcctcttccactcaagtacaaggataccctctctttctgccttcccggaggtgtacaggttcatgctgtcgaacgtactccttcattcagtgagctgaatgaaatcctcctgggacaggaacagcttaaagaaagcaaccaatcatttgtgttccgcctacaggttgctgataactctgcattatatggatgctgtgtgctggttgaagagattgtacagagaccatcaaagttggtatcgatgctaatgaatgacaaacccatctttccacgccggagtcgatacgtggtaactacgccccggtgttattgcatcctgtccaggcttccgttctttgaactgcattttggggtgttgcagagtattcttatggaagaacgtctggagtggctcactgatggtgttagcatgctaacttccttatcgcttgaggaatcctgtgagaacgatatctgtgaaggaactgaagttacagcacagaaacagtatttagatagtaacacaattgatgtggataaatcatctgaatctagcatgggagtttcatcaaaggagctatctgacactgacagcagttttgggtgtagagagaaccagcttgactttgtttctaaagaacaacagcaaaatagttcttgtgataaagagcagagtgatcgtaaaagagaaattatcacttgtgatgcttctgaagtgtctgatcattttgttcctgaagatacatcatctgatcagtctggagctaagcatcatgaacttgattctgcatcaggtatccaggatgaatctggtgcaaagaactgtgatgattctccgaagggaaatgtggatgatgaggagcttgatctcttcattaccgatactattttaccacttatgcgatctcgcctttgtgaagattgtgaatcatctccaagttcacagggttctccttctagaaatttcgacacccaggaatcggattcagaggagccatcttccatcggtgatggggacttagttagacacaacaacatactgcagtgggctaaggcaaaaaaatatggttctttgcaagttgtctgtcaatactaccagttacagtgtcctgctaggggttcatcacttacttttcatcccttggagcatttgcatcctttgagttttcaccggccaggtgaaacagttcttcacattgctggttctactattgagcttaggtcacgcgatacaagcttagaagttgctgagatgcgtaattcactcttcgctgaggaggaatcgactgctttatccacatgggcggtggcatccatttgtggatgcctaaggttggaacatgtaatgacactttttgctgctgcactcctggagaaacagattgttattgtctgttctaatctgggaatgttatcggcttcagttttgtccatcctacctctaatacgaccgtatcggtggcatagtctcctcacgacggtcttgcctaatgacatgatggattttctggatgccccagttccatacatagtgggtgtacaaaacaagacatctgatgtgctcaacaggctaccaaatgccgtggtcattgatgccaacaggaatcagattaaatcttcttcagttccgcaactaccacagcacagagagttgctttctgccttgcgcccgtatcattcaatacttgttggcgaaagttatcttgcaagaaaacgtcctgtttacgaatgcacagatgcccaggtggaagcggccaaaggtttcttggcagtgcttagagactaccttgacacactatgctcgaacttgagatctcatacaattaccaatgtgcaatctaacaatgacaaggtttccttacttttaaaagagagctttatcggttctttcccaatccgggataggccttttatgaagctttttgtggacacgcagttgttctcagtacagacagacctagttctctccttttatcagaaggactaagtgtctgacagacttgaatgtctgtctcatgttgccaagcctttagatgttgagctaaactgtacatatcggcttagaaagaatgagctgccttcgtcattttggcagctgagtgtgttaagagctggggtattgaagaagaatgcctatagctgttgtaagttagtctggtgcggtgatccgccatctaaggttttgtaggctgttgtaggctgatgcttctatggattgttcctgcaatacctgtgctgtaatggaaccatat

SEQ ID NO: 185 - DNA, 1298 bp, Sorghum bicolor
cggccggccagctgtacaaggcatgggtagcttttgcatttgcacgccaccgaccagcggtcgctagctagtagctcttcttcatcctcatccatcctcatccacagtcgctcttcttcatcctcatccacagtcgtgtcctccacagtccacacgtaccggcgccctgcactatagttgctgcaatggcggcggcgcttgctgcatcatcagcagaggcggctcttcttctcctagtattattggtacgactcgccgcggtggcgctgagatgcggcgaggggctgagcctggctttgtatgacgagagctgcccggaggcggaggcggcggtgacggcggccgtgcggcaggccatggcaaacgaccgcaccgtggcggctgggctcctccgaatgcatttccacgactgcttcgtcaggggctgcgacggctccgttctgctggactcgacgggcaccgtgacggcagagaaggacggcccgcccaacgtctcgctgcacgctttctacgtcatcgacaacgccaagcgggccgtggaggcccagtgccccggggtcgtctcgtgcgccgacatcctcgcgctcgccgcaagagacgccgtcgcgctgtccggtggtccgtcgtgggtggtggccttggggcggcgggacgggcgcgtgtcgcgggccaacgagacgacgacgctgccggggccgacggctagctttgagcagctgaagcaggcgttccacggccgcgggctgtccaccaaggacctggtggtgctgtcgggcgcccacacgctgggcttcgcgcactgctcctccttccagaaccgcatccggctccaggaccagggcaccgacgccgacgacccttccctgagcccctccttcgccgccgccctccgccgtgcgtgccccgccaacaacaccgtccgcgccgccgggtccggcctggacgccacctccgcggccttcgacaacacctactaccggatgctgcaggccggccagggcctgctctcctccgacgaggcgctgctcacgcaccccaagacgcgcgccttcgtcgcgctctacgccgcgtcgcaggaggccttcttcagggccttcgccaagtccatgctgcggatggccgcgctcaacggaggcgacgaggtgcgagccaactgcaggcgcgtcaactcatcatgatccggaccatcccatccgatccactgctgtgttccccttttgggccttgtttagttgcgaaaaatttttagatttcgctactgtagcactttcgtttttatttgataaatattgtccaat

SEQ ID NO: 186 - DNA, 1263 bp, Sorghum bicolor
cggcccatcacccaccccatctccctcacgtgcgcgcgagcgtcgcgctccaggccttcctcttccccgtctggcatcgcgaaccgccgcacccgattcggcacgcccacgccccacccccttcaccgtgtctctccgcggcggcgggcgcggttctccggccatcaccgggcgcatccggaaaaactatgaggaggtacagccccccttatcgtagtccccccaggagggcatatggtggcagaggaagaagcccccctcctcctaggagggggtatggaggacgcaacaaagagggtagtggaagccttttggtccgcaatatcccattaagcgtcagagcggaggagcttcgagttccttttgaaaggtttggccctgtccgcgatgtttacattccaaaggactattactctggggagcctcgaggatttgcctttgtggagtttgttgacccttatgatgcctctgaagcccagtatcacatgaatcgccaagttttctttggccgggagatagctgttgttcttgctgctgagtcgcgaaagaggccagaggaaatgcgcagcagagctagagtcagaggttactctggtcatgaaggtcgccgatcttcatattatgggcggtctcggtcccgttcccgctctcctcgctataggggccgtcctcggtcaagatcatactctcctgctccaaggcggcgagatgactactcagcttctcctaggagacaggaagcgcatcgcacatcctctcccaggcgcccgacaaaggagcatgacgaagataagaagcggaggtcctactctcctgccagtagagatgatgctgacaatggttatgagaagaggtcgcccccagcagacagtaatgggtcccctccgcaccgcaggtcccccaaggaggagtactcaggctcacctcccggatcccgctccaggtccgccgacgaatctcctgttcgcagtgactgactgaccggtggatgctacaaaaatgatatgcacatgaccgtgtctctccggcacgagtcagtccaatgcctttgtcaggccgagcttactgttacccccttttgggggtgatgttgtattgctaaagtttcatttgtgcttagtatcggcatatactgctagtctttgctatgtacgtacggtatgcttttaatcttgagtgaagtttgaggaaccagtgatggatgctgatgaacattgttacatgtagtagcatgttacttgcttgctgggccacggcccgttc

SEQ ID NO: 187 - DNA, 1113 bp, Sorghum bicolor
tctgtggtctagcagtagttgtggtgatggtgtgagttttgttgatttggttaaggaatactcctccagagcaagacggttcattgtcgaggatgaagagcttcgtgagcgcatcaagtccgatctgcacattgaatccatcaatggagaggaggatgcacttcgtgaagtggcgtggggtttaaggagtgggctgccttttattatttctgaatttttgtatgatgtcactatcagtcctcagcgccatctcccattatgccaaggatttgaagtcttcatgaagaaatatcaaatcgatattcctacagaagctgttgatgaagactttctaacccgtgctggtacattgcaacgaattgatgaactgattttgtatcgctgcactgagatgcgtgaggtatgttccaagctggttcccggtattagtggaatgatcaaggataactttcgctatgttgaagttatggcaaagattctgaccccttggttggttggtgaagaatgggattcatccaagtggtccactgctggtgagccgtggttcactcctgatgagatgcagaagatagtggctaaagatgctgcagcagatgatgcacgggaaaaggttaagggtgatcataaggtggctgctatgatagaggccaaccttgatgactacaggtgtctcactaaatctcatggtattgttcttcagaaagtcaggtcttgttatgaagcaaaggtcaagagagggcaaaagaggagccacacagagatggctgaagaggaggttgttgaggcggtggctgagtgcaggaagggacaagatggtgctgactccactgaagagaagtggagtccttccaatggcagtagcaagacagagatttctcatttctgataatcagctgttcgtgtatgcttaagctgccagtgtgttgctagtatcttactactatgtttaagctcagttctggaaccaatgtattgtatcatgctacattgtgttatgtgtgctcctatattaattgggatctgtattaacttcatgccacattatgttatgtactatattaattcggatctgaaacctatgtatatcaacttatgtctggaagtctggtctgc

SEQ ID NO: 188 - DNA, 1440 bp, Sorghum bicolor
tacacgacgcgtacgaatccgtgggaaccccgcaccgcatcgcctcgtatgcttcgcgcgtgcacacgcgtcggtggcgcgggcgccggcggccgacgagagcgcctcatggcctccctcatccgcttcctctcttcctccccctcctactccaccactcacctcccgcgccagcaccagccccagccgccgccagccgcagccgcagcggcgcgcccatcacggttccgcctcctgttcgcgcgcgccgcggcgcggcgcgaccccgagccgacgccggtgccggcggtcgaggagaggaggtcgctggccgtcaggacgggggagctgttcctagggctggcggcgctgctgctgcgcggggccggggccggggccggggcggcggtggaggaggtggaggcgagggacggggtggtgtgggagcagcgacccgaggacgtggacgcggagcgggcgcggcgggagctcactagccccggcttcagcttctccgcggcggggctgctcttcccctaccacctcggcgccgcgcagtgcctcatggaccgcggatacatcaccgagaaaactccgttagctggctcatcagcgggtgccataatctgtgcagtgatcgcatctgggaacacaatgcaagatgctctgcaggtgaccaaagttctagctgacaactgccggagtaaaggcactgcgtttcgccttggggctgtactcaaggatgtccttgatgagtttctcccagatgatcttcacattaggtgtaatggaagaattcgtgttgctattactcggctatcctggaggcctaggggcttgctggtggaccaatttgactccaaagaagatgtcattaatgcagtcattacatcctccttcattcctgggtacttagcacccagaccagctactttcttccgtaataggctctgcattgatgggggccttacattgtttatgccgcccacttctgctgcagaaacagtccgaatatgtgcttttccagccagccgcttgggattgcaagatattgggatcagtccagattgcaatccagagaacagagctagtccaagacagctgtttaactgggctctggaacctgctgaagatgaaactctagacaaattatacgagcttgggtacctggacgcagctgtttgggctgagcagaattctgccgagcttatcacgaagaatggtcaatcccttgtcgctgattgaatcaagctctgtttgctcaaaactaattttggtgtcctaagctgagttcatgggagtttgtacatgtaatatattgtaaagataacaccctcactgtcgaaggtggcattgtactgcattggatttgagtgtgtagaaggagcacatgaaatggtgatgccagcattttagctgtgacagtagtgcagaacatgttgttcgtagggtcttaaaagc

SEQ ID NO: 189 - DNA, 2000 bp, Sorghum bicolor
cgttgcgcctctcctcctcctcctcctcctcccccttcttttcttcctcatcaatcactcatcactgctactacttcgttggttccccccattaccggcccactgccgccgagagagattttggtgtgcctactaccgagtctcaatcctataccccaaaaactcgggattctctgctgctgctgctgctgctactactaccagtactattatcctcccgttggccggaacggaatcggttctgtgccggtgagttgccgcggcggatacaacgcgtttccgcgaggattccgcgtggtgaaagaaagaaagatcaggtcttttctgcggatttccgttgttaccgaacagagggagagaaggagagagagatgtcggctctcctcgatctattgatggggatcctccggcagcagaccatcggcggcgccgcgctggagctcgccgcgatagcggcgccgctgtggctcgccgcgctcgtcggcctcctcatcggctgggcgtggcgcccgaggtgggcgggggtcgtcgtcggcgtcggcggcggcggcggcgacaacaacgcacagcaccaggcggcggcgcacctcctccctacgccgccccctcctcctccggcgcgcgccaccgccaccgcggtggtctctcgcaacgaggcgcccgctgtcgtcccgaggactgtggtggctcctgcggcggcggcgcccgaggacgagcagctggcggtcaacaccggcgacttgatgcacctctggcggctcgtcgaggagaaggacggtggtccgtcgtggattcacatgatggatcgcaccttgcccaccatgagataccaagcctggcggagagacccaccgaatggtccgccacagtatcgcagtagcactatctttgaggatgcgtcaccagaggttgtgagagatttcttctgggacgatgagttccggattaagaacagctgggatgacatgcttcttcagcacgagacactggaggaatgcaccaggactggaaccttggttgtccggtgggtcaggaagttcccattcttctgcagcgacagggagtacatcataggtcgcaggatatgggcatctggaaagacgttttactgtgtcaccaagggtgtgcctcgaccctctgttccaagacataacaaacctcgacgtgtggacttatactactctagctggtgcatccgtccagttgaatcaaggaaaggcgatggttcaatgactgcatgtgaggtgctcttattccatcacgaagatatggggattccatgggagattgcaaagcttggtgtccggcaggggatgtggggctgcgtcaaaaggatagagcctggccttcgggcataccaagttgcaaggaccgctggagagcctatttcgaaatgtgctgccatggcacatgtcaccaccaggttcaatgcggatgagctcattacagaagagaacacagagggcagttcatccaacaacacagaggtcgagaagccaaagcactggacaaacaatatacccaaggttctcatgataggcggtgccgtcgccctggcttgcacctttgacggtggattgttgaccaaggccgtcatattcggcacggcgagaaggtttgcagggccaggagggccaggaaggcggtaggtggatggagctggttaccgtagagcaatgccacccttgtcatgtagcaaagctatgcgtggaagtgccccaaacaatctttttgtagcaatacattgcagaggacggaatgccgtgtctagatgttcagtgtagacatcctcatgctgcagataaggtggtgtgctcatattaggtcagttgagaaaatagatcctgcacattccagaaaaggaaatcggcggaaagatccagcgacacagaccggacatacatctgttgctgcagtcgccgcgggttagagccagctggttaggttagaactatagcattattttgaggacaagtgtgaagagttggtaaagagaacag

SEQ ID NO: 190 - DNA, 757 bp, Sorghum bicolor
cacaaaaaaatcccaattccaaaaccctctctctgtcccgtcccatacccccatcgccggcgatctcctccttcgccgccaatggatctctccgccgtccaggccgccctctccgacaagtcctactccgccctcgcccccctctgcgacgagctcctcctccaggtcgcggccaagggagccatcaccgacgaatggccctactccgtccatctcctcgcccacctctacatcaatgacctgaacagcgcgcggttcttttggaagtcgttgccgcaggaggtgaaggacacgcggccagagctcgccgcggtctggaggattggtcagtgcctgtggaacagggattatgctggcgtcaacacggctgcacaggggttcgagtggggccctgacctcgctgatttcatcactgccttcctagagagctacagacagaggatattcaagctgttgacttctgcatattccacaattagcgttgctgatgtggctcatttcatggggatgagtgaggaggatgttacaaactatgctgtgcaaaacagttggagcttggatgcagcgactgggatgcttactgtaaaaaagccaaaggctcagaccaaccagaagcttgactcgagcaagctgcagcgtttgactgagtgtgttttccaccttgagcactgatgctcactgtcaattatgtcgcatccctgttggttctctactccacattttatgaagcatgtttatcaattatcatgtgatagct

SEQ ID NO: 191 - DNA, 1036 bp, Sorghum bicolor
atctccacagtcgtccggtccctcactcactggcactcccctcatcaaaaccccatccaattccaaacccccctcttctcgccatttcaccaccgcttccagccaaccgcttcttccctcgccacccatggccaccgcagcgcgcgccctcgtcgccgcacgcccggcgcggccgctcctcccgtcacggcgcctcccgtcctcctcttccatccgccccccgcggcaacgtggcggcggcgttgggtccgtccgctgcatggcgcggcggccggattcctcatattccccgctgcggtcgggtcagggcggtgaccgtgcgccgacggagatggcgcctctgttccctggctgcgactacgagcactggctcatcgtcatggacaagcccggcggcgagggcgccacgaagcagcaaatgatcgattgctacatccagacccttgcccaggtggtagggagcgaagaggaggcgaagaagaggatatacaatgtgtcctgcgagcgctattttggattcggctgcgaaattgatgaagagacctccaacaaactggaaggccttccaggggttctatttgtgcttcctgactcttatgttgatgctgagaacaaggattatggtgctgagttatttgtgaacggtgaaatcgttcagcgatcgccagaaaggcagagaagggtggagccagtgcctcagagagctcaagatcgaccccggtacagtgaccggacccgctatgtgaagcggagggagaaccagtcttaccagcgatgatgatgctgtttctggagatggaaaatgccacggtttccacaagttgcctaaatgtgatgctggagatgtagcagcaatcccccttccctactacccacatgagaatgacatcccttgtgtttgctccgctttttaagctatacatgcttatgcatttgggcttgtacctctggttgatatgaacgatgtatccttttaacttcgcatgataatttaaagtcgtctttagtcagaaattaatccattattgatgattat

SEQ ID NO: 192 - DNA, 1040 bp, Sorghum bicolor
ctcacctcaaggggcggcgcccccgttcgttgcgtattccgcaagttggtcggcctccctccgccgtgggaggggaaagcggaggaggaagaggagccaagcggttaagccagctcggccgctcgcctcccacccaaatccccccggaactactcgaatccccacccaagcaacaccccggaaaaggcgtgaagcgcccgcggtcgggggccgatggtggtgcggcggctgggcggcgcggggcgcgcgctgctcacgctccccaatatccggaggcgggcgtccaactcctgggccgctgtctgcgacaccttcttctccaccaagcaagtgttcgagaaccaccgcatcgtcttcaccgtcggcacctccatcgcctccgtcctcacggcttgggctggctattcacttcgtcaggttcatcaatcaaggattgaaaggaggcttgagtcaattgaatcatctctgaagggtaaccacaaagttgaacatgaagagataaaaaagattgtcacttccagcaatattagcgctccagcctgtgtagccacggcgatgaccacaatggttgttgggtacacgctaggatggcgaggtggtgcttggtatgctcgaagggccttcagaagagagcaacaaaagctgatgatgggtcacatgaagtcacacaacagatggcactggcggcccttcaaccggctcaggaacaggctcagaaacagcaggttagcctccaagaacaagagcaccaacgcccatccgtcggtgggtcaaagcagcgaggccccctcaacctcaagcagcggggcctctgcggacgttagcagtgctgctcagtcagcagtgggcagtgcatgagctatatatgcatactacatggactaggatgtaaacttgagggcgcgtagtccatatgtcttgctagaacagataatgtgacttgtaggtacttaggtcgatctgtggtggatcatttttgtagcatattaaggtcataatgcacccaactacatgcgtgaaacaactgactgacgacagac

SEQ ID NO: 193 - DNA, 1421 bp, Sorghum bicolor
aaaacaccctatatacataaagaatcacagttctacccttagcatcattcttgttccagcaaaagaccttatctacgctattaccaatcaacttcgaggtctcttctgcacttttttcccacacatacaggaccgagaagtcgagaagctagggaggggggacacgacgccaccgagagggaacgcgaggtcgccatcaccatggggggaggagtcatgcgcaccgccgcgaaggtcggcatcgccggaggcgcggcggcggcggcaaagagcggccggttccgccacgccgcaccggccttcgccacggccgccgccgccgcgggttctgaggcggcgccgcttgtctccgcctccggtggcgaggcggtgccccccgctacggcgcagtgggcggcgtcctgggagctggacgactgggagttcgcggactggagggacgactccgccgcggcggcggtggtggtggcggagagggaggccacggcagcggccgcgaagcccaggctggtcttcgcgccgccgtcgagggaggaggccgaggaggccacgagtgagctcagggacgccatagagagggcctatttcaatgagacaccagttgaggttgttaaggaacaggataaagagtttaataagcaggcaaccgatgccataattccttccatgcctggacatgtggtccaagcttttacattgctgaaatcaagcccggaggctcagagtgttgtagcctcccttgcatcagatagaaatgtctgggaagcagtattgaagaatgagaaggttatggaattttacaagaatcaccagacaactctagttgagacattccctgaagaagcagccacagtagagtcgccggggaattttgaagacgccacctctgaaaatgcatccaacactgaactccccactggctcacctttctctgattttgtggacaatgcgaagaagagagtgatggatgtgatctataatataaccgactttttcaaggacttgttcgactcagcgggagcacaggacggagcaggcccttcagctgagaagggtccttctgcagcagagatggctctcggcggatcgttcatggctctggccataggggtcatcctagttgtcctgctcaagagggcatgatagctcatgagtaccctctgggactcatggtacttcaaatctgtcgaaaattacttgtctatcgtatggtcaagaactctgaatgtattgtacagcttgtgtccttgtccttggaaacagtacaataaaagactatctatgctatagtattttgtgtgtatcttggttttctgaacctctgatgtgcagacaccgtaagagccaaatgttgtgcttgattattacatttgcaaattacagtatagtaacatgacaaaggtcgtcatttgtttgacctg

SEQ ID NO: 194 - DNA, 3658 bp, Sorghum bicolor
tcatcttggaagcgtccgcgactcggcgcaccgaatcccaaccaccgctagtgccgccgagcatatacatcgccctgcctgcctgccgctcgccccgccctcagctgctcagcgacaagcaagctgatcacctcagcaagagcagcaagcagagcggcgctccagccttccaggccgccgtgggggatatgcacacgccgccagggcaggcgtgccaaagaagcgtagcgtagggggccggccgcggccatgtgggcgccgtcgcgggggtcgtcgtcggggagcgggcggcggacgtggcgccgccgcatcgcggactacctcgccgacgaccagaccgacgtgtcggacaatgagtccttcatcacggcgcacagcgacgagtacgtcgccgcctccacgtccatgtccgccgcgggaggcgggggaatgctgccggcgttcctcgcggaccagagcgacctcgtggaggtgatgctggagctggacgaggagtccatggtggtgcgcagcgtcacgcccaccaccgccgcgctgtacgggacccccaccgcgtcgtcgctgcccgggcccggcgcggcggggccgcaggcgcacacgccggacggcccgcggagcctgagccggtgctcgtcgacgtcgtcgcggatccgcaggaagttcgcgtggctgcggtcgccgtctccatcgccgtcgctgcgtcgtcccccgcccgcggccggggccgcggcggcgacggcggcgttgtccgaccagcaggtggtgcgggaggcggcgctggcggcccgcgagcggcggcgcgtccaggcgcgcctcctgaaccggtcgcggtccggggccaggcgcgcgctcaagggcctccggttcatcagccgcaccaccaccgacgccgacggcggcgccgcgctctggcgcgccgtggaggagcgcttcaacgcgctcgccaccgacggcctcctcgcccgcgacgacttcggcgactgcatcgggatggtggactccaaggagttcgcggtgggcatcttcgacgcgctggcgcggcggcggcggcagaacctggagcggatcagcaaggacgagctctacgagttctggctgcaaatctccgaccagagcttcgacgcgcgcctccaaatcttcttcgacatggtggacaccaacgtggacggcaggatcacgagggaggaagtgcaagagctgatcgttctgagcgcgtcggcgaacaagctgtcgaagctcaaggagcaggctgaggagtacgcgtccttgatcatggaggagctcgatccggagaatctcggctacatagagctgtggcagctggaggcgctgctcctgcagcgggacgcgtacatgacctacagccggccgatgagcagcggcagcgcggcgcagtggagccagggcctgagcgccggcgccggcgcgggtgctggtgggcagcagcagcagcagcagcaggcgcagccgcagccgtcgcggtggcagctgcagcggcggaggtggagcccgcgtcgcgcggcggcgcgggcgcgcgtggcggcggcggagcgctggcggcgggcgtgggtggtggcgctgtggtgcgcggccatggcgtcgctgttcgcgtggcggttcgtgcagtaccggcggtcggcggcgttccgggtgatggggtactgcctcccgacggccaagggcgccgccgagacgctcaagctcaacatggcgctcgtgctcctcccggtctgccgcaacacgctgacgtggctccgatccacctgggcgcgattcttcgtccccttcgacgacagcatcgccttccacaagatgatcgcgttggcgatcgcggtggggatctgcctgcacgcggggaaccacctggcgtgcgacttcccgcggctgatcgcgtcggggcccgacgagtaccggctggtggcgcgcttcttcgggcgggacaagcccagctacaggggcctcctcgccggcgccgagggcgtcaccgggatcgtcatggtcacgctcatggccgtctccttcaccctcgccacgcgccccttccggaagcgggaggcggaggtcaagccggccaggtccgcccgccggtggtgctggccgctcgcccacctcgccggcggcttcaacgccttctggtactcgcaccacctgctcatcgtcgtctacctcctgctgctcgtccacggctggttcgtgttcctcgtcgacaagtggtaccagaggacgacatggatgtacatttctgtgccactggtgctctacgtcggggaacggacgctacgggccttccgatccaaggcttacgcagttaagatcctcaaggtgtgccttctaccggggaacgtcttgaccataaccatgtcgaaaccctatggattccgctacagaagtgggcagtacatcttcctgcagtgtccaacaatctccccatttgagtggcatcctttctccatcacttcagctcctggagacgactacatcagcgtccacattcagaccaggggtgactggacacaagagctcaagcgcatcttcgtcgagaactacttcacgccatgcgtgccccgaagagctgccttcggcgagctaggcgcggtggagcacaagagtccgccaaggttgctggttgacggcccctacggcgccccagcgcaggatttcaggaactacgacgtgctgctcctcgtcggccttgggatcggcgcaacccctttcatcagcatcctgagagatcttctgaacaacatcaagctggctgatgagctgatggatctggcaatggagaccagccggtctgaggacagcgccaacagcttgagcgcgtcaacggcgagcagcagcaacaagaggcgggcataccgaacaagctgcgcacacttctactgggtcacaagggagccggggtcattcgagtggttcaagggagtgatgaatgaggtcgctgaaatggacaagaagggtgtcattgagctgcacaactatctgacaagcgtgtatgaggagcgagatgcaaggacgaccctgctgtcgatggtgcaggccctgaaccacgccaagcatggcgtagacatagtgtcaggcacaagggtcaggacacattttgcaagacctaactggaaagaagtatttacaagaatcgcgtccaagcacccaaattctacagtcggggtattttactgtgggagacctacacttgccaaagaactgaagaaactgtcacttgacatgagccacaaaacgggaacccgctttgatttccacaaggagtacttctgatggaaaatagaagtactcctgatttctttagtactagaagatacagatacaaaaaaatcacaaattttgcatagaagcaaactgatcctcttcacagtatgtaattgtacatagtataaagcagagggtagttagaaacaatttttgttaaccaaatgggagggtaaaaatatgtcttgcgctttcagacagacattggttactgcagatatacatgtatagatcatagctattcattgtatgctaagcatacaagagactgaggccaacaatctgaatgcatatcattcaaataactggtcgtgtttactttattactaacagtggcattatgcagaaatcatatatatattcctttttactccggtagtagttactccca

SEQ ID NO: 195 - DNA, 1652 bp, Sorghum bicolor
cccagctataaatagcgtcccctccccgccgcctccttccccacaccatccgacgccgaggaggaggaagaagaagaagcagcaggaaagcacgagcagcatatgtcacagagggccagcgtcccacactcctcctgcatagccttcgcgctccattcccatctcctggtctccagtgagatgtgccccagctcctcttggcagcaatagcttagctattctctcccttccttttctctcttcttcccccaatttggtttcaagcctcgagctaataagcttcgagcttccgtttttagatttcttcctttgctctcctccgatccaatcgtctatccctgactcctcctgacaaaaaagagaggaaaccgaggcgacaagcaagcaatgggtgtcaagggattcgtcgagggcggcatcgcctccatcgtggccggctgctccacccacccgctggacctcatcaaggtccgcatgcagctgcagggtgaagccgccgcggcgccgcagccagcgctgcgcccggcgctcgccttccacgccggtggccacgccgtcacgctcccgcaccacgacatcccggtgccgccgccgaggaagcccgggccgctgaccgtgggcgcgcagatcctgcggtcggagggcgcgcggggcctcttctccggtgtctccgccaccatgctgcgccagacgctctactccaccacgcggatgggtctctacgacatcctcaagaccaagtggacacccccgccggacaacaacggcaacggcggggtcctcccgctgcaccgcaagatcgcggcggggctggtggcgggcggggtcggcgcggccgtgggcaacccggccgacgtggccatggtgcggatgcaggcggacgggcgcctccccctcgcggagcgccggaactacgcgggcgtcggggacgccatcgcgcggatgacgcgcgacgagggcgtccgcagcctgtggcgcgggtcgtcgctcacggtgaaccgcgccatgatcgtcacggcgtcgcagctcgccacgtacgaccaggccaaggaggccatcctggcgcgccggggaccgggagccgacggcctcgccacgcacgtcgccgccagcttcaccgcgggcatcgtggccgccgccgcgtccaaccccgtggatgtggtcaagacgaggatgatgaacatgaaggtggcgcccggcgcgcccccgccgtacgccggcgccgtcgactgcgcgctcaagacggtgaggtcggaagggcccatggcgctgtacaaggggttcatccccaccgtgatgcgccagggacctttcaccgtcgtgctcttcgtcacgctcgagcaggtgcgcaaggtcttcaagggcgtcgacttctgaggaccggcgccgacgaagatgatgatgatgacgacaaccgccgccgccgccgccgctatgctacccgttcgtcaccgcgttcgctgctacgaataacctgctgctgctacctagaggcggcgactattatgccttcgcttgcattgcatcccgtgttagccttgtgttcctctcttgatgcatcctgttgtatctggatggatttgaccaaatgcaaaattgccaagattttaaattattgaaattgaaattgctactgcaatgtctcacaactc

SEQ ID NO: 196 - DNA, 5632 bp, Sorghum bicolor
tcccttccccgcaccgctgtgttatgctggttgaaccttccgtccccccctcctcagatcagatctctccatctccttctcggcaccgcgccgcgcgacgcccgcctccgcgctctccccccccacttccgctccagactagccgggagagatctaggtaccgccgcccgtcgccatggcggcggccaacgcccccatcgccatgcgcgaggcgctcacgctcaccagcctgggcatcgcgccgcagttcgtcaccttcacccacgtcaccatggagtcggagaagtacatctgcgtccgcgagacctccccgcagaacagcgtcgtcatcatcgacatggccatgcccatgcagccgctccgacgccccatcaccgccgactccgcactcatgaaccccaacaccaggatcctcgcactcaaagcccaaatacctggaacaacacaggatcaccttcaaatatttaacattgaggctaagactaagatcaagtctcaccagatgccagagcaggttgtattttggaaatggatcactcccaaattgttgggtttagtgacacaaacatctgtttaccactggtcgattgaaggtgattctgagcccaccaagatgtttgataggacagctaatttggcaaacaatcagatcatcaactatcgatgcgacccagcggaaaagtggcttgtacttattggaattgcacctggagccccagagaggccacaactggtgaagggaaatatgcagcttttttctgttgatcaacaacgtagccaggcccttgaagcccatgcagcatcttttgcaacatttaaggttgttggtaatgagaatccatcaacccttatttgtttcgcctcaaagacaactaatgctggacaaatcacttcaaagctgcatgttattgaactgggtgcacagccagggaaacctggcttttctaagaaacaagccgacctcttcttcccaccagatttccaggatgattttcctgtagctatgcaggtttcacaaaagtatgggcttatctatgtaattacaaagcttggccttttgtttgtatatgacttagaaactgccgcggcagtttacagaaatagaatcagtccagaccctatattcttgacggcagaatcttcttctactggtggattttatgccatcaacagaagagggcaggttttacatgctacagttaatgacgcaactgttgtaccttttgtcagtggccaattaaacaaccttgagcttgctgtgaatctagccaagagagctaaccttcctggtgctgagaacttggttgtgcaaagattccaggaactgtttgcacagacaaaatacaaggaagcagctgagctggctgcggaatctccccagggtctcctgaggacgcctgagaccgtggcaaaatttcagagcgtgcctgtgcaagctgggcaaacacccccactcttgcagtactttggcacattgctaactcgagggaagctcaatgcctttgagtctcttgagctatctcgacttgtcgtcaatcagaacaaaaagaatcttctcgaaaattggctggcagaagacaagctggagtgtagtgaagaactaggagatcttgtcaagactgtggacaatgatcttgcactgaaaatatacataaaggctagggcaacacctaaagttgttgctgcttttgctgaaaggagggagtttgacaagatactgatatactcaaagcaggttgggtacacgccagattatctcttcctcctccagaccatcttgcgcacagatccacagggagctgtgaactttgctctcatgatgtcacaaatggagggaggctgcccagtagattataatacaataactgaccttttccttcagagaaatatgatacgggaggcaacagcttttctgttggatgttctgaaaccaaacttgccagagcatgcttttcttcaaaccaaggttttggagataaacttagtgacttacccgaatgttgctgatgccattcttgctaatggtatgttcagtcattatgaccgccctcgtattgctcagctgtgtgaaaaggctggtttgtacttgcgagccctccagcattactcagagttgcctgatatcaagcgtgtcattgtaaatacccatgccattgagccacaggcacttgttgagttctttggcaccttgtcaagagagtgggctttggagtgcatgaaagacctcctactggttaacctgaggggaaatcttcagattgttgtgcaggctgcaaaagaatactctgaacagctaggggttgacgcttgcattaaattatttgagcaattcaaatcttatgagggcctttactttttcttgggatcctatctgagctccagcgaggacccagatatccatttcaagtacatagaagcagctgcaaggactggacagatcaaagaagttgaacgtgtaaccagagagtcaaacttctatgatgctgagaagacaaagaactttttgatggaagcaaaactacctgatgcccgtccactgattaatgtttgtgaccgctttggttttgtgccagatctcactcactatctgtatacaaacaacatgcttcgatatatcgaaggctatgttcagaaggtgaatcctgggaatgctccattggtagtggggcaactacttgacgatgagtgccctgaagattttatcaagggtttgattctctctgttcgttctctccttcctgttgagccactggttgatgaatgtgagaagaggaaccgcctacgtttgctcactcaattcttggagcacttagtgagtgaaggtagccaagatgtgcatgtccataatgctcttggcaaaatcatcattgacagcaacaacaatcctgagcatttccttactaccaatccattttacgactctcgtgttgtgggtaaatattgtgaaaagcgggatcctacacttgctgttgttgcttacagacgtgggcagtgtgatgatgaacttattaatgtcactaacaaaaactctttattcaagctacaagctaggtatgtggttgagagaatggatggtgatctgtgggataaagttcttcagcctgagaatgaatatagaaggcaactcattgaccaagtggtttcgactgcattgcctgagagcaagagccctgagcaagtttctgcggctgttaaggctttcatgactgctgacctgcctcatgaacttattgagcttcttgaaaagattgttcttcagaattctgctttcagtggaaatttcaatctgcagaacctgctcatcttgactgctatcaaggcagatccatccagagtcatggactatatcaacagacttgataactttgatgggcctgctgttggagaagttgctgttgaagcacagctgtatgaggaggcttttgctatattcaagaagttcaacttaaatgtgcaggctgtcaatgttctcttggacaacatccggagcatagaaagagctgaggaatttgctttccgtgttgaagaagatgctgtgtggagccaggttgccaaagcccagttacgtgaaggtctggtcagtgaagcaattgagtccttcattcgcgcagatgatgctgcacatttccttgatgttatctgtgctgccgaggaagctaatgtgtacgatgatttagtaaagtaccttctgatggtaaggcaaaaggcacgggaacccaaagttgatggagaactcatctttgcatatgctaagattgacaggctcagtgaaattgaggaattcattcttatgccaaatgttgccaaccttcaaaatgttggtgaccgcctgtatgatgaagaactatatgaagctgcaaagatcatctatgctttcatctcaaactgggctaagctggctgttaccctggttaagctgaagcagttccaaggtgctgtggatgctgctcgcaaggctaacagtgccaaaacatggaaggaggtctgctttgcttgtgttgatgccgaggagttccgtcttgcacaaatatgtggtctcaatattattgttcaggttgatgacttggaagaagtcagtgaatactaccagaatagaggatgtttcaatgagcttattgctctcatggagagtggtcttggacttgaacgtgcacacatgggcatcttcacagaattgggagttctatatgctagataccgccctgagaagcttatggagcacatcaaacttttctccacccgtctcaatattcctaagcttatccgggcttgtgatgaacagcagcactggaaagaacttacctacctgtacatacagtatgacgaatttgacaatgctgccaccactattatgaaccactctccagatgcatgggatcatatgcagttcaaggatgtctgcgttaaagttgcaaatgtcgagctgtattacaaggcagttcacttctatttgcaagagcatcctgatctcatcaatgatatgctaaacgtgcttgcacttcggttagatcatacccgagttgtagacataatgcgcaaggctggtcagttgcatctagtgaaaccgtatatggttgcagttcagagtaacaatgtctctgctgtgaatgaagccttgaatgagctttatgttgaagaggaagactatgagagactccgtgaatcagttgacatgcatgacaactttgaccagataggtcttgcccagaagcttgagaagcatgaattgctggagatgcggaggattgccgcctacatttacaagaaggctggcaggtggaagcaatccattgctctatccaagaaagacaacatgtacaaggattgcatggagacatgctcacaatctggtgaccgtgaactgtcagaggacttgcttgtctatttcattgagcagggtaagaaagaatgctttgcttcctgcctcttcatttgctacgacttgatccggccagatgtcgctcttgagcttgcatggatgaacaacatgttggactttgccttcccatacctgttgcagttcatccgtgaatacactagcaaggttgatgatttagtgaaggacaaaattgagtcgcagaaggaagaaagagccaaagagaaggaggagaaagatcttgtggctcagcagaacatgtacgcccaactgcttcctcttgctttgcccgctccgccaatgcctggcatgggcggccctccacctccgatgggtggaatgggcatgcctccaatgggtggaatgggtatgccgccaatgggccctggtccgatgccagcatttgggatgccgccaatgggaagctactgagttgtttttgcagagagcttagatgatctgaattgttccaagtgtaagcaaaagtggaacttctttggagttgtagatgattacagtttggaattaatattctttatggtacctggaaatttttggcggagtgaaatcttagccagagtttgaaatttgcggttaggatggttgagcatgagctgttgaaagctggtaccatttgtatagtgtgatgatctttgtagacacattttggttgtattaatacttgtcagaacagtgaaggacaaacaaatgtatgttacgacctgttcatttcctgttgaaaattgggaggcacta

SEQ ID NO: 197 - DNA, 1679 bp, Sorghum bicolor
gcgagtaccaccaacacgaacactccaccacctctccctttccgtcgcgtcacaggccacggcgagcggcggcggaggggctcttgccggattcgacggccagtggaggtgccccggtttcagccgtccctagattgaccctgctttcctccccaacgaatccaagttgcgcaaatgccgacgccggtgaagtcggtgcttcccgtggtgctcctcggctgcggcggcgtcggccgctacctcctccgccacatcgtctcctgccgccccctccacgccaaccagggcgtggccatccgggtggtgggcgtcgccgatagctcctccctgctcgtcgccgaagatgtccactccaacggcctcgacgacgcgctcctcacccagctctgcgccgccaagtccgccggctctcccctctcctccctgcttgcccaagggcactgtcagctgttcaagaatcctgaggctaggggcaaagtcatagacgccgctaccacacttggaagaacaactggtctggtgctagttgactgttctgcaacttatgacactgttagtctgctgaatgatgctgtgggtcatggatgctgtattgtattggcaaacaagaaacctcttaccggtgcttatgaggattttcagaagttggtctccaacttccgtcggataagattcgaatctactgttggagcaggtttgcctgtgatagcttctgtaacccgtattattgcatctggagatcctgtttctcgtattgttggcagtttgagtggtacacttgggtatgtgatgagtgagcttgaggatggaaagaaatttagtgaagttgtaaaaaatgccaagtctcttggctatacagaaccagatccacgtgatgatcttggtggaatggatgtggctagaaaggcattgatcctggctaggcttctgggccaacagataagcatggagaatatcaatgttgagagtttatatcctagcgaattaggacctgatgcagtgtccacaaaggacttccttgagagtggtttagtgcaacttgacaagagcatggaagaaagagtcaaagcagcagcatcgagaggaaacgttcttcgctacgtagctgagattgaaagcacagggtgccaagtaggccttaaagagctcccaaaggattctgcactgggtagattgaggggaagtgacaatgtggtggagatatacagcagatgttaccagagctcccctctggtgatccagggcgcaggagctggcaatgacaccactgccgccggcgtccttgctgatataattgacctccaagacctgttccagacaacggcatgatcgtagatcggcatccaacaccatcttgattcttgcaaggcaccagggctttttggtactctgatcggtggtgctactgtgtgtccgtcaggcagggactcagcgtgcgcttttgcttgttcacttcagtcgtgtactcctgtgtgcatttggttccttcagccgctccactgagacgcgtctgacattagaataggatttgaattttgagcagccatgtgggggctctttacagttcacatagaggaaaactttgtttcagtgaaataatgtcgcgggtctctacattaagcagtcagactgatgttgctgctagatgatagtgaaagagtaaacttttgatttcgagc

SEQ ID NO: 198 - DNA, 2080 bp, Sorghum bicolor
ccaaagcccaaagccactgccgaccgcgaccacttgaaagcggcttgcgcgtgtgccgtccccggcggccccctccaaagccctccaatcttgtcgctttctacgcgccgtcgcctccccttctcccccaaaaccatccaccgtctccgccgtcccaatcgccttcaaaacccccggcaaaaccctccatttccgccgcatctccctcgctgtcccggcacaccgggtcggtcgggtgttgaggctcgctcgcggctcccctcttcctggggcctggctggaagggaagggggaggatgcaggccgcggccgggagcgtctcttgggtcaccgcgcagccgtccgtcctcggccgctgcggcggcgcgccgtccgcttcgctcaaggggagtgcttgcggcgtcggaggaggagggtgcaggatccggggccgggacgtcgccgtgccgcggtgctgcgcgcgcgcgcaggagaagcgcccgccgcgagtgcgcaaatccaaggaggagaggcgggagatggtggagtccttcatcaacggttaccgactttcaaatgaaggtaaattcccatcagttaaccttacccataaggaagttggagggtcatattatattgttcgtgaaatcgtgagggatatcatccaagagaatagagtccttggtcctggtggcttggatgctatggcgctgagttttgaagatcgtgatgattcttcagagtcatccatgaagcatgaattgggtcaagacaatatagagatcttagatacgtctggtagtgaagtcagtaagggttatgtacctgaaatatccagcactgatgaatcgattccattgcaagacaatgccatcagcactcagacactgctgggttcatcaaatatcttagaggctggtgttctgaatagtgtggtccaaaatgggagtgcggcagatgcaatattgatggaaacaaatcttgagaaacaagatgaagttccatctggaggatccattgagtttgacttgaatagttctgaagagcaagctcgtttgtttgctcaggtttctgattcagatgaagacattgtactaaacagtcaggcagatgcacaggatggaacagccagtagtgctaccgatggagttattcttcccttagagtcttctgctgtttatgaaagcaatgctgcacttttaagagatcatgagacattacctaatgataatcatgatggatcaactgatggtgccgtggatgatgcaaacctccttgcagcgatcaatggtgttcaagcaaagcaagcttctttacatgagcatgatgcatcaactggaagtgtgtcgattgacaatgctcagagctttgatagtcagtatagtactactgtatctactgatcctataaatggttctaaatcggaggctgaagttgcaaccaagacagttgaagcatctaaagtacacaggctgcaagatgagtttgagcaaccattggttgatgctagctgtgacgggcaagaaaactctgacagccctgtttctcatccagcattagatacaaaggggctgttgcacacagaagatcagcacagtgttgtacagatagatgaaagtgaattcaagatctcaacacctgggatcacaaaggaagaggtccaggcagctgatttcaggcatgaacaaggaattaacaccagaacagcgatcagcaggcatgcactttgcctcctaactttgcgttgcatgcttaccgtttataatttccttcacacatcacaaaaggcagcagtatattaggaaaactttgaaagctctgcagaagaaagatgacaacctattctggcttgtccttagggcatttgttgttgctatatcaaaaatctgggcaaaatgaacaatgcagaaaggcttccttacatggaactgaagattgggtgaatccttcctactggaaaatgagaaaccggtccatgaagttccatttctcccatgcgaatatagatatgctactttcgtgctgcagtttaggttattttttggagacatagcgctgctatagttttgtagtcacttcccactgtaggtgtaatgtttag

SEQ ID NO: 199 - DNA, 1605 bp, Sorghum bicolor
ccggaaccgactccgactccgactccaactacccctatccccaccgcgaaccgccggaggaatctctggcgatggcgccgccacccgctacggttgccgccgtccgccaccacagcccgcacctgctcctccgccgcggcggcgggggtctcctcccaccacctccggcccccgccacgctccccttcgccacgcggggtgtggcctccgcgccggcgcgcctgcgcctgccgccgccatggttctcgctctcccctgtcccgaagagcctctccgcctcctcctcctctcacgtccccgtgcgctccctcttcaccggcatcgtcgaggaggttggccgcgtgcgccgcctgggcccgccgctcgcgccgtcgtctggcggcggcggtggcgaggctcccgggcttgacctggaggtcgagaccagggacctcctcaccgggacgcagctcggcgacagcgtggcggtggacggcacctgcctcaccgtggcggcgatcgacccggccgcgtccacgctcaccttcggcgtggcgccggagacgctccgccggacgtccctgggcgggcgggcccccggcgacggcgtcaacctcgagcgcgcgctcacgccgtcgtcacgcatggggggccacttcgtgcagggccacgtcgacgggaccggggagatcgccgcgttccggcccgacggggactcgctctgggtcaccgtgcgcgcgccgccggagatcctccgcctcctcgtgcccaagggcttcgtcgccgtcgatggcactagcctaaccgttgtcagcgtggacgacgagggcgggtggtttgacttcatgctcgtcaggtacacgcaggacaacatcgtgctgcccaccaagaaggtcggagacaaggtgaatctggaggcggatatactggggaagtacgtcgagaagctcctcgccgggagggttgaggccatggctaaggttggctcgtgatcgaccattgctgagatgctggattgctcgtcattctataggggttaagaaaggcttggattcaatgcctatacccggggctcagctagggtccctatgatggagatgtcacttaacgaattttatgcatgagctttttgttatgatgtttggaagtgctcaattgcttgctgcagcctgcagctgcaatatggattcttgaagaatttttgttatgatatttgtagatgttcatttggttgctgcagcctgcaaattcaaaatgctattctggtgcacttaccccctctactgtatgagacctgagatttgtgattggaacaataggaatataaggcttagcaccatggtaacactcctttgttgtagttggctgtgtaaaaccttttccttgagtacacagaataaagtcggtgttgatagtagtcacaactccttttgggataagatggaacttactggcattggattggagatcgctgggtaacatcttgtgtttgggttacttcaaatcttacagtatatggtttttgctgagaactctggtgattgattgatgaatcattagcctaagaagtaacaatatctggattccagagtttggcatagaaaatcacacctgtggttccttttt

SEQ ID NO: 200 - DNA, 1363 bp, Sorghum bicolor
ctacccacacgcaccccgctcgaccaagctcccgcgcccgcggccggcgccctcacgctcccgcggctgggcctggcgcccgcgcccgtggccgtggtcggcgcctccaatctcacagcttggctcgggaccaagaggcgagggatacgccctgcgcgagtgcgcgctcggcagaacgatgccgctgcactgttccctgcccgcgacctgttcggcgttgtgcctgcgagcagcggcgcggcctgacccccgctgtccgagctcccacgcgcgcctcgtcggcctagctctttctcgcccgcgccaccagaggctcgtgcacaccggctgcgcgcgggccgggacgagcgactctaaggccgtgcagctggtgctgggcggccgtgcgcgcagcgacgatgacgacactgactccgagtccagcgatggcgaggactcccaggatcggatgacggacgaagagcggaagacgctgcgccggaagatacgggagatgatggaccgcgtccctgaaacggcggggctgacggacccggaggagcggagggccaagatgcgggagctgctgaccaagtacgagctggtggtagaggaggaggacccggactggcccgaggacgccgaggatgggatgggcttcagcctcggccagttcttcgacaagatcaccatcaaggccgagaagaaggacgacgccgaggaggatgatgactcggggtatcaaagcgacaaggagattgtttgggaggatgacaattacatcaagccggtgagggatgttaggacacaggattgggatgcgtccgtgttcaccgatttcgggccgatgattgtgcttgtgcataacagatataagagaccgcgggagaatgagatggcgagggctgagcttactaaggcaattgagatgttttgggaacacaatctgccgtcaccaaggtgtgtggctgtagatgcctgtgccgagcctgaccttgtggacgcgctgaaagtttctggtttccctgagattctcttcaccaatgcagggaggataatacaccgtgagaaagttgtccggtcggcggaggcatggtcgaggatgatggcgtttttctactacaaagcagcaaggccaccgttcttgtgtgaagcagatgggaagggtcaagaaaaggttcctttgatgtcatgagcacaacgtggaggcttagctttgtagtacaactattttagtgcttcgaagttcgaatcaaatttttagaaaatcaatgcagtttgttagaacttcacatatgtcattaggaagtttatgctgttaggactaagagttgaaacttacaactattatgagaaaaatacattaatcagcctcttttattac

SEQ ID NO: 201 - DNA, 695 bp, Sorghum bicolor
caaaccaaactcacacgccgcacccaaagcgaccaacctcttgcttcccaccgtacctgcctgccacgccgcagcctccggctccgatgtcgtcgcagcgcccgggccgccaccagcgtcgcgcgtcgcagagcgtgttcgtgctcccggagaacctggcctccctcgacgtcgacgcggcgggcgaggtgggcgcgaattcgaaggccggtggcccagacggcgccggcgccgagcagcaggcgaggccgcccgcggggcgtcaccgccgcgccatgtccgtggccgtggcctccactagggacctcgagctgatcaaggaggacctcggcagctacaagctcggcgcttgagagagggggccggctggcacgtcgcgtcatgtgtatatagcctgtgggttagccgtgcccagacctggctttgatcggcgcttaacagtggcttaattacaaggtctctcctccgttgctctttttgttttcgctcaacacacgcatatgtaatactactactagtactatgtagtaacttttttcattacaaagaggaagtatttggacactttaatcgcgtgaaggtcctgctcagtggcagcatatgactacttcttatacttgtacaccgagcttatatatgcaattcacaacaatctatcttttttcgcacaataaaatgattgaaattaagatgct

SEQ ID NO: 202 - DNA, 1781 bp, Sorghum bicolor
atacgacccacaagaccccgctcctcccgcgctcccgaatcactccctctcggtctctccgctccacccgccgccgccgccgccgccgtccgaatcccaatggcgtccgcggccgccgcgccaacctccctctccctcgcggcccgcgcggccaccagggcagccaccgccgccgctgccgccgccgccccgctgcgcaggggaggcctcgccgcggcgtgccagccggcgcggtcgctggcgttcgcggcgggcgacgcgcggctcgcggtccacgtcgcgtcgcggtgccggcaggcgtcctccgcgcgcggcacgcgggccatggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgggccgccgtacccaccatccagtacctcatcagcaagggcgccaaggtcatcctctcaagccacttgggtcgccctaagggttttacacccaagtttagcttaggtcccattgtaggacggttgtctgagcttcttggcattcaggtgcaaaaggccgaggatgttattggccctgaagttgagaagctggtggacgccttgcccattggtggggttttgctcctggagaacgtaagattctacaaggaagaggagaagaatgacccagagtttgcacagaagcttgcctccctagcagatctttatgtcaatgatgcatttggaacagcccacagggcacatgcatcgactgagggagttaccaagtttctgaagccttctgttgcagggttccttttgcagaaggaacttgactaccttgtcggagctgtctcaagccctaaacgcccatttgctgccatcgtgggtggttcaaaggtgtcatccaagattggggttattgaatccctgttggaaaagtgtgatatccttctcttgggtggtggtatgatcttcacattttacaaggcacaaggtctctctgttggtgcttcattggttgaggaagacaaacttgatcttgcaacatctctccttgcaaaggctaaggaaaagggtgtctcccttttgttgccaaccgatgttgtcattgctgataagtttgcccctgatgctaacagccagattgttccagcatctgcaattcctgatggttggatggggctggatattggcccagatgctgttacttcattcaacgcagccctggatacatgccagacggtcatctggaacgggcccatgggtgttttcgaatttgacaagtttgctgtaggaactgaggctgtggcaaagaagttggcagaacttagcgccaagggtgtcacaactatcattggaggtggagactctgttgccgctgttgagaaggtgggagttgctgacgttatgagccacatttccacgggaggtggtgccagcttggaattgttggaaggaaaggagcttccaggagttgttgcattggatgaagccatccctgtggctgtatgaagcaagctttcattttgtttcatctccatcttcacgtgccattgtatacttgctacattcttgcttgctcctcgtcagccgctctaaatgtaagagatcaatgtgtttatagagctactggaaatcgtttgaacaacgaaacaaataatatgtgcttaccgagtcatctttccttggtaacgtaactagtgacataaaaaaccttcaagggtaacctatatagcctattc

SEQ ID NO: 203 - DNA, 1754 bp, Sorghum bicolor
ccacccgccgccgatccagccgctccggcgagcgcagcgcagcccacggcattcgccaacgagagcttgaaaagcccttcccacgctgggccccgcgacgcgagcccacacgtccgcttccgctgcctcagccactcggcagcccatgtgctgagctcacatgcctgccgttcccacgcctcgccaccctcctcccccttccgcctccgctgctccgcctccacctcctcgctagcctaaccgcagggcagccaccgcagaccacaccgccactgcaccaatcatcacgcaccggagcgcacgcgggtggggagtcccgaggcgatcaggcgaagcggcgcgccaactgacgccatgaaggagggcggtggcggcggcggggacggggggttcgtgcgggcggaccagatcgacctcaagagcctggacgagcagctggagcgccacctcagccgcgcctggaccatggagaagcgcaaggaggaggcctccgggggcgccgaccagcgcggcgctggcgccaggccgcactcccggcgcccgcggagggaggactgggagatcgacccggccaagctcgtcgtcaagggcgtcatcgcccgcggcaccttcggcaccgtccaccgcggcatctacgacgcccacgacgttgcagtgaaactacttgattggggagaggatgggcataggtcagaacaagacattcaagcactaagagcagctttttcacaagaggtttctgtttggcataagcttgaccatccaaatgtaactaagtttataggagctataatgggtgcaagggatctgaatattcaaacagaaaatggtcacattggcatgccaactaatatctgctgtgttgttgtggagtaccttcctggtggtgcactaaaatcatttctgataaagaacaggagaaggaagttagcttttaaggtcgttgtccaaattgctcttgaccttgccaggggattaagttatcttcattccaagaagattgtgcaccgtgatgtgaagactgaaaatatgcttcttgacaaaacgagaactgtgaaaattgctgattttggtgttgctcgactcgaagcttctaatcccagtgatatgaccggtgaaactggaacacttggttacatggcacctgaggttctcaatggaaatccatacaacaggaaatgtgatgtttatagcttcgggatctgtttgtgggagatatactgctgtgatatgccgtatcctgatttgagcttctcagaggtcacatctgctgttgttcgtcagaacttgaggccagagataccacgttgctgtccaagctctttagcaaacgtgatgaagcgttgctgggacgcgaaccctgacaagcgacctgagatggctgaggtggtgtccatgttggaggcaatcgacacatcaaagggtggaggcatgatccctgtagatcagcggcccggatgccttgcatgcttccggcagtacagaggtccatgatagatggaaccctgctggagctgcggtctgaagaatggcctctagatcttgtggatgtctattgcatttgttatctggggaagcaaactggttatggagctagtgtgcttatcggcttatgtaaattctgtcccatccattctgtaactctgtttttatcaatcaatgaaagaaccgggcttgctcgtctatgtttcctgggtgatggaaattctttttccaggatatgacagaaaatagcagctaggcagaaaccctca

SEQ ID NO: 204 - DNA, 1279 bp, Sorghum bicolor
ctacaccaaccgtttggtccgccatcggcgattcctcccgcactagtacatagcactagagcgcccgtgtccgagcaagtcacgtaccgatcgacgctaacgacgacgagcgcgacagcgatggcggcggacccggacacggaggtgcaggcggagttcccgccgctggtccgccagtacaagagcggccgcgtcgagcggttctttaacccgtccccgctcccggccggcaccgacccggccacgggcgtcgtgtccaaggacgtcgtcgtcgatccggccaccggcctctgggcgcgcctcttcctcccgcccagcagcagccacggcaagaagcagcagctccccatcgtcgtctactaccacggcggcgcctacgtgatcggctcggcggccgacccgtggacgcacacctacctcaacgggctcgtcgccaaggccggcgtcctcgccgtggcgctcgagtaccgcctcgcgccggagcacccgctcccggccgcctacgaggactcgtgggaggggctcaagtgggtggccacccacgccgccgccaccgccgccgcgggcgggggaccggagccgtggctgaccgagcacggcgacttctcccgcgtgttcctggccggagccagcgcgggcggcaccatcgcgcactacgtcgccgtccgtgccggcgagcagcagggccagggccagggcgacctcctcggggtgcgcgtcagggggctgctgatagtgcacccctacttcagcggcgcggcggacatcggcgacgaggggacgacggggaagcagcgcaaggcgcaggccgacgcgttctggcggttcctgtaccccggctcccccgggctcgacgacccgctttccaacccgttctcggaggccgccggcggcagcgcggcgcgcgtcgccgccgagcgagtgctcgtctgcgtcgccgagaaggatgacctcagggacaggggcgtctggtactacgagagcctcaaggccggcggctaccccggcgaggtggagctgctcgagtccaagggcgagggccacgtcttctactgcatgaacccgagctgcgacagggcgcgggagatggaggagcgcgtcctgagcttcctacgcaagtgagcgactctgagcgcgcgcccgtgcaaagcgctcaactgcgcaagtgagatggaataatttctcgtgtaatttgtttgcttaaaattcatttcaagtttcgaaatgtaccttaccgtcctccaaattgcaaatctgttggacttgttttgttttagct

SEQ ID NO: 205 - DNA, 532 bp, Sorghum bicolor
cagcccacaacacaaacaaaacaccgcggcgccggctcacagcttttgttaccctccagcatccgttttctcttttgctgtcgcgacgaagatcctcatcaaggccctgatggctccccgtgtcgtcgcctccgctctgctcttcgccatggcggccgtcctcgtggcctccgcatcggcgcaggagttcacggcgcctgcgtctgcgccggcgccgggaccggtcgctggagccgcctccgctccggcctccgctgtcgccgtggtgtcgtccgcactgctgtccctgcttgtggccaccctgatgcagtagaagcatatctatgtatatcatctaccgcttatgtatgctactatatacatggtcatggacatgcatggcatggagtagtagtaggttttgtttctagatttgagcgggaatttgatcgatcgatcgagtgtttgctgttcctcattctttttgtatcatatatgtctccgacatgtttatatatatgaataaagttggttgatctattgcatacttttt

SEQ ID NO: 206 - DNA, 869 bp, Sorghum bicolor
cggccgtctcgtctcgtctgcttccttcgtctcttggtcttcccaccaatctctctcccaatccgctaatcgctatttgctgctcccaatccgcttatctctcttgaaagggcagagaagggcgagatgacggtggagaaggtggacgcggcgctggcggacttcgacgcccacttcgaccgcctcttcgcttccccggacgccgcctccgacggcaaggtgaagctgctgctcttcctggccgaccgcgagcctgactcctccctcacctggtgccccgactgcaacgtggcggagccggtgatctacgagcggctggaggcagcactgcagggcaaggacgcggtgctcctgcgcgcctacgtcggggacaagcccacgtggcgcgacccggcgcacccgtggagggtggaccccaggttcgggctcaagggggtgcccacgctgatccggtgggaggatggcgccgccgccgcccgcctcggggacgacgaggcgcacctcaaggacaaggttgacgccctcctctccgttccttccatctgatctgagtaggctgctataacaatctgtgattcagttcatgtatgccgaaccaaaagctgggaaattgagtgaatgaagctaataaatcagttcatgtataaggaaccagaagctgggaaatacgtacggtacgtacgtaataaagccgctaattcgataatagtgaagctagtaattcgatggttctctgtctcattttgcattccaaaaatctggattgtatttcacgttgttgagtgaatcctaagataattcatcgttattcatagcttcatacaacagacattctcactagtagaataacagatcagtccactttggtt

SEQ ID NO: 207 - DNA, 984 bp, Sorghum bicolor
agagcaggcaggcaagtgggtgggtcagagtcagacaggccagcccgccacgccgtcccgacggccatggcccaacccttctcccctcacaccccgtcctcatcctgggtgactcgccgccctcctacctcgacgtcctcaccgtccgcctccaccacgagaacgagcgcctctcctattccggggtgcagaccgcgccgcagggccgtcgcgccggcggcctccctccacctcggccccggggagatcgccgaggtctcgcgcaacaaggttttgattgcggcgacggtggcgagcgcgatcgggcagctgtccaagcccttcacttcaggcaagaatgggggcgccggcgccggccttgacctcaggaccatattccgctctggagggatgccatctacccactccgcgagtgttgttgcagttgctacttcgcttgggctagaaagggggtttgcagactccgtatttggaatgtcagtggtgtttgcagccattgtaatgtatgatgctcagggagttagaagagaagtgggcaaccatgccagggttttgaacaagttttggatcctcaaagagaaggcacctctggagtattctgaagtggacatggcttctgagtttgtttcggttaccgaggaggtgatttcaaatgcaagcccctcgaagcacggttctagtacagaatcaccaagggtgaaggggctccatagttcagaacctgaggtaactgaggtgacagagctgaagcaggcttacatagaggaggattaccggttgagtgaatctgttggccacacagagcttcaggtcacagtcggcgccttgttaggttttgctgtaagcttagcagtatacgcgacactgtaacacagatttttttttatattactttcttaattagttacacgtttacacttttacacaaaaataacagaatcgattgattattcccaccattcaatcagagatgcctaagctcgt

SEQ ID NO: 208 - DNA, 1419 bp, Sorghum bicolor
gtaaaatggcacggcacgtcagcaccgaaccctcccggtcccggcaccgcaaccgctgttcctccccgcggcacgcgcgcgcgccacagccgatgtgccgcggcaggattcctcggcaccgcgaccattcggcttctccccgacccggcacggtcccttccttccctctctccggcggcagatggcctcctcctcctcaccggcgcccaccctggccggggaggctctacgccagaaacgcatcctctccagcaagctctacctcgaggtcccctcctccaaggcgccggtggtgtactcgccggcatacgacatctccttcctcgggcttgagaagctgcacccgtttgattccgccaaatggggccgcatctgcaggtacctcaccagggaagggtacctggacaagaaacggatggtggatccattggaagcctgcaaggaggatttgctagtggtgcacacagaggcgtatctgaacagtctcaaaagcagcttcagagtttccaacattgtagaggtccctcctgtctcgcttgtccctaattggattgtgcacaagaagctattataccccttccggaagcaggtgggtgggtccattttatcagccaaacttgcgcttgagagaggatgggccattaatgttggtggaggatttcaccattgttcggcagatgaagggggtggattttgtgcatatgctgacatctctctctgcatccagtttgcttttgcccgtctaaatatctcaagtgtattgatcatagacctggatgcccaccaaggaaatggacacgaaaaagattttgctaatgatggaagggtttacatttttgacatgtacaatgctggaatttatccctttgatttcactgctaagcaatacattgatcaaaaagtagaattagctagtggaacagaaacagatgaatacttggagcaacttgacaaggctcttgaggtctgcaatagtagatttcagccccagttgattgtttacaatgctggaacagacatcctggatggtgatccgttgggcagattgaaggtaagtcctgagggtgtggttaccagagacgagaaggtatttacgttcgcaaaagatcaaaacattcctctgctgatgctgacatcaggaggctacatgaagtcaagtgctcgagtaatagctgattcgatcatcaatctgtccaacaaaaacttgataggattaggcagcgagctgggttgagcaagaacttggaatatctcatggacgtgtatatgtcctgtgaataaaggtgtttggtacttgtgatttgtgatggataacatgtatgccacaaaaatggtctgtacataacacggggtctttgtgaatctatgggtttgtttggatacctggctcccttctagcctggttaggaatcaagccag

SEQ ID NO: 209 - DNA, 1768 bp, Sorghum bicolor
ctataacacgcgctcccgcttccactcggcgacctccaccggtccaccgcgcatcgaaccccccactagtgccgattcagctgatccctggccgtcgccggccggcgaatccgcaccatggcggtcgtgcgcctccgcggcaacggtgcaaacggcgtcgtccgtccccggccccgcgaccgcggcgcccgcggtggcggcggaagcatggcggggcgcgtggccgtcctcgccttctgtgtcgccgggatctggtccgcctacatctaccagggcgtccttcaggagactctatccacgaagcggttcgggccggaggggcggcggttcgagcacctcgcgttcctcaacttcgcgcagaacgtcctctgcttcgtctggtccttcataatgattaagctgtggtcgggtgggagtagctccaatggccgcgcgccgctatggaagtattggggcgtcagcgtcaccaataccatcgggccgacgatggggatcgaggcgctcaagtacatcagctatccggctcaggtgttggcaaaatcttctaagatgattcctgtaatgttgatgggaacacttctctatggtgtgaagtacacacttccagagtatttttgcacctttcttgttgctggcggtgtgtcctcctttgcgttgttgaagacaagctcgaagacaattaagaagcttgccaaccctaatgcacctcttggctatacattgtgcttcctcaacttagcttttgatgggtatactaactcgacccaagatttaataaaatcaaggtacccaaagacaaacccatgggatataatgcttggcatgaacctctgggggaccatatataatgctgtaattatgtttgctgcgccattactgttcagtaattggccatatgcaaatggttttgaggcattgagattttgccaggagaacccagaggtcgcctgggacattttcctgttctgcctatgtggtgccgtggggcagaacttcatctttttaaccatcagccggtttggctctcttactaacacaacaatcactaccacccgtaaattcatgagcattgtggtttcatcagtcatcagtggcaatccattatctttgaagcaatggggtagtgttgtgatggtcttcttaggcctctctatccaaatatatctcaaatggaagaaaaagaagggcagagaccacaaggagtaagcttgattcttgaacctgttccgatttgtaacttcaattggacagatctgttgtgaggttgaccaggataacgttaatgcagtcgaaattaggagacttttacatggactattatgagcgataactagtgtgaggctgtgagctattggtaacagcttgtagtttctgttctacagggagatgcagcaatttgtgttgcattgaggacaaagttgtatgatgaccaatgtatttttgttctactctctcgaaagtaatctgttgtagaattaaaattgcaacatctaggtttttgttctagttcatgtatacctcttatgttgtgtttggaagagcagtagacttaaatttgaactaagccacaagtaatttagatgaggaaatttggtttcagaacctttataataaggatttggaatggttatcttcccaatcctagcgaatagagatgttataagaacattacttatgttgtaccaagatatacgaatacaatgggtgctctatactccattagcgaaatgtaaatgaaaatttgatattggtggattccatattttcg

SEQ ID NO: 210 - DNA, 1654 bp, Sorghum bicolor
acaaaaagcagcggaggaggcagaccacgccagccagcgcgcccgactcgccgtcgccgcggccacgtctcccctcccatggccaccagctccacagccaccgcctcgctgcacctcctcctcccggcctcccgccgccgccgccacttcgtgcctcgggccgcccactccgagtccaccccgcccggcgccgcctccgtcgaccgccgccgcttcattgcccacactgccgccgcggccgccgtctcgcctctcgtcttgccccgctggactcccgcggcgcgcgcggacggcgcgccggcgctctccgagtgggagcgcgtcttcctgcccattgaccccggcgtcgtcctcctcgacatcgccttcgtccccgacgacccctcccatggttttctccttgggacaaggcagacaatactggagacaaaagacggcggtaacacctggttccctcgctccatcccttccgcagaagacgaagatttcaactacaggttcaactcagtaagcttcaagggcaaagaaggatggattatcggcaagcctgcaattctgctgcacacttcagatgctggcgagagctgggaaagaatacccttgagtgcccaacttcctgggaacatggtttacataaaagctaccggggagcagagcgcagagatggttactgatgagggagcaatctatgttacctctaaccgtggctacaactggaaggctgccgtgcaagagactgtttcagctactctgaacagaacagtttcaagtggcattagcggtgcaagttactacactgggactttcaacacggtgaaccgatcgcctgatggacgctatgtagctgtatccagccgaggaaacttctatttgacctgggagcctgggcagccattttggcaaccccacaacagggcggtggcacggaggattcagaacatggggtggagagcagatggtggactttggctgctggtgcgcggtggtgggctcttcctcagcaaaggaaccgggataagtgaagattttgaggaggtgcaggtgcagagccgagggtttggcatccttgatgtgggctaccgctcacaggaggaggcctgggctgctggtggcagtggcgtgctgctgaagaccacaaacggagggaagaactgggtgcgcgacaaggctgccgacaacatcgccgccaacctgtactccgtcaaattccttgatgacagcaaaggcttcgtgctgggcaatgacggcgtgttgcttcgatatcttggctgaaagagtgctggaagatcggtttcagtgatcgtatgtaacccctttttgtattgtacgtgacgtaacgaaggtatattatggagatacatacaattgttcgatttatacagcatatatatgtgtatgtgtacaacggcatctactgctactcctactgtaaaagactgctgactgtgcttgcattctctcttccggaacgcaaatgagtgtaaagatgtgctgcttgcttggaacttcgaaaccaaccgtgtatatactactactgtatctgtatatgatagccttgttcgtttgttctcgtaataaattagccaacagtactttctgtcatagcttatcagccaaataaacaaggcggatgcctcctgttccgaacaaccct

SEQ ID NO: 211 - DNA, 1219 bp, Sorghum bicolor
gtgagacgctagctaggcaaccaaacacctgtaatcgtgaaagactgactaggggtgtggcgccccaaaacacggaatccacccgcgacaacggataacgctgtcctccttcggctcctcccctctcgttcctctcctctcccctccaatggcgaccgccatttcctctctagtaactcctccagccctccaccgccgctgcctaagccctgcctccgtctccgtctccgcccctatccgtatctccttccgggccgccgcggcgtctcaggcgtggcgccggggcttggcgctgcgggtgtcagcctcctcggcggtgctcgaggcgccagaggtggtggcggcgcggaagctctacgttggaaatgtccccaggaccgtcaccaatgacgagctccgcgacatgttcgccgcgcacggcaccgttgagcgggccgaggttatgtacgacaagtataccaatcgcagccgacggtttgggtttgtcacgatgagcactgtggaagaggccaatgctgcagtagaggctctcaatgggactgaggttggtggtagaaaaattaaagtgaatgtcacagagagcttcttaccgaacattgaccgatcagcacctgaatcggaacctgtatttgtggatagtcagtacaaggtttatgttggtaatcttgcgaagaatgtaacaacggaagttcttaaaaacttcttctctgaaaaggggaagatcctcagtgcaacagtctcccacattccggggacctcgaagtcaaaggggtatggctttgtcacattctcttctgaggaagaagttgaagctgctgttgctactttcaataacgcggaattggaaggacaacccatccgtgtgaatagagcttagattatcagaaatttgcaggagcactgaaggagggggagtatcttggcgaatgcatgtagtacgagggatacttagaggctagattttgataacaaagtgatcaattcgatatgtcaaacaatttttgtaccataacagtgtatgagaaggattttgcttgttcatatgattacatttttcttaacggcacttatatatgataacacaacagcagcatggtttcgtttcagttatataccatgtttgtttacttgaatctaattctacatcttgtacattccagcattaatgttttgtaagttcaatctctgactttctgcttttcaaatttgcctgatgagc

SEQ ID NO: 212 - DNA, 1920 bp, Sorghum bicolor
acgtcccccccactacggcacgggctcggcaccagcttaactccccagtccgcggctgacacctcatccgagcctgccgccgatccccgttccccgtgaccccctctcgctctcactctcgcagcgcaggagtcgtagtccagccgtgagcgagcttgtgccgtgcgtgccgactagggactcctactaccagcgcggcgagcgatccaccgcaggggaatccaatcaaatccaccaggaagggtcgccccgcggctaggccgaccggctctcgccccgccccgcctcgcgccggcgcctctccccgatcccgatctgtgtgcctgcctgcagcctgcgtgggatggagctggaggcggcgccgcggcagcagcagcagctggaggaggaggaggaggaggtggtggggtgcacatgcggcggcggggccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcgactccgtcttcgtccgcgtcgactgcgtcatccccgacgacccgacgccctccgccgccgccgccgcaccgggctccgcgccgcaccaggccccggccacggccgcgcgcgggcgcggcggcgcgctcgcgcacatggcgcgcgtcctgctcggcggcatcgccaggcccatccacgcgctcggccagatcctctcccccgccgcggcggccgtctcccggcgctccgacccaccactgcccgcttccccgcccgcgcccgtcgcggacgtctcccaccactcgccctccgaggtgctccgctccttcagggagctgcggcgcctccacatcgagctgcccacgggcgagctcggcattgacgacggcgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctctggataccagtagggagactgaagagccggggagcctgcctgattctctctacacaaatggagggctcaagcttcgcgttgtctggaccatcagctccctgattgctgcgtcggcgaggcattacttgctgcacccgattatctgtaatcacgaaacgctggagagcttggacctgacagatgccgacggccaaggggtgctcaccatggacaagaggcagctgcaggaactgcgggtgcggcccgtctctccgtcggggagctcgcaccgcacactcatgccggcactcagtatgcgtctgcactatgcaccgctcattgagctgcctgggggaacgctgctgaagggcgcgacactggttgcgatcagaccaagcgaggatgccttgagggagggccaaggggctggggctgcaggtcctgttggtacatgctggatttcagaggcctttgaggagccatatcggactgcggcaaaggtgcttctcaagagaagggcatattgccttgaaatgaactcgttctgagcaccagggattcagttccacatggttctacccttctgacaggatggtgggaagtgggatgcccttcggttaatatagaggaatttatcattcagtccatctgttgtatctgattccagtgaagtggtgacttcgtgtacctgtaattttagggctgtaattacagatacgtgtttgttctggactagtacacgcggaatggaatgcgatttgggccgatttccacagtagtgtaccatgaagagaagccatggaatgtttccgtacttgagcgcttgagcttgagcgtggtgctcctgggccaagcattatacatcata

SEQ ID NO: 213 - DNA, 1164 bp, Sorghum bicolor
cgcccggtccactatagaactgttctactctactccactaccacctgtcattttccttccctcttcatcaacgtctcgacgaagctgccagtgctgcaggtagaccggaccgaacaactgcagctcgggagcggccatttctccgggggcgggagagctctacctcttgcagcggtagaacaagagcagccagagtgaacagaaatggatgcggatggtagctccaagagaagtcgcccagttcgtcgtgctgtgaagaagctcaagttcaaaccgaaggtgcctccacagaagccaaagaaactgagtgcacaaaagccacagcaagaagaccctaagccaattgatcaagacttgatgaagatattgaggactcaccaagtggctgcaaaaagttcactaaataaagaagatgagcgcccaatgcagaataccccctcgacaccaccttctgcagatgttgttaacatgtcaccaacacaattcggattgcagaaacaaaatcaattgccactccaaattcctagatccttccctgttcctgttcattcaggaatgttttacaaagaagatagtgacgacgacgacaacgatgatggtagtgacaatgttgagttgcatgagactcagccaaattcaattgaatgtgaagctttaacacgtccagcagaggagcttgatttgcttcagcaacaaggtagcaaagaaagaatgttcctcttccagctcccaaaatctcttcctttgcccaaaaggacgtccagtaccagtatagttgaaagacaaggaaagcccactggcaaggaggtgaaggaaggatgcaacctgcagcagctgcctcagggttatttgggcaaaatgctggtatacaagagcggcaagatcaaaatgaagttaggagatgtcatgtttgatgtgagcccaggagcagaaactaggatggcacaacatgtagtagctcagaacactcgagacaaacattgttgcttacttggagagattgagaatcggcatgttattgtgactcccgatatggattctttgttgaacgacaagtagagattaggttgtaatctgtagcaactgtagcagctttggcataggtacctttgggtggatccactcgagtgaattcataggccttggtaccattgagctcgaatt

SEQ ID NO: 214 - DNA, 1359 bp, Sorghum bicolor
caagcgtgcggcctgcggcgtgcctgtctgcctgctagtgctaccacagaagcgcgggcccacctgatcactattacgcgcgagccgcgaatcagacccgtcatcccgtccaaatccttggcctcccctcccactaccagtgaccgccgcctccgcctacccccaccaccaccatccccggcggcccgcgtagcgcgcgcagatggcgacggcggccacggcgtccgcgacggcggcgacccgcttcacgctcctagcgggcgcggggctccgcagccgcatcagccgccgccccaccgccgtgcggttccagcgccagcgggggctcaccaccaccgcgctactgaagaccgccgacctcctgcccaaggcgcagggccagcccgagacgctcgactaccgcgtcttcctcgtcgacggcgggggccggaaggtgtcgccgtggcacgacgtcccgctgcgcgcaggggacggggtgttccactttgtcgtcgagatccccaaggagagcagcgccaagatggaggtcgccaccgacgaggccttcacgcccatcaagcaggacaccaagaagggcaaccttcgatactacccgtacaacattaactggaattatggattacttcctcaaacatgggaggacccgacttctgcaaattccgatgttgaaggagcatttggggataatgatcctgttgatgttgttgagataggtgaaagacgtgccaatatcggggatgttcttaaggttaagccattggcagctttagcaatgattgatgaaggggagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacagatttggtctcggcaacaagcccgcaagcaaggaatatgccctgaaggtcattgaagagaccaacgaatcatgggagaaattggtaaagaggaatattcctgctggagagctctcgttagcctaaccttggcccatgggaagccaccacattctttgaactgctttcataagcatgtcgttttgtatgatgtcaccatgcttcttcgtttgcattccaaacctttttacgaactgtttaacaaaaataatcttatcggaagaataatgattctggtgcgagtttatgagaagggcaaggaatgtttgataagtaattgtcatgttttccaaacacagaaacatgtaatttatgaagttggaacactattgaactgagcaaaagcagtttgaggtcgttaagctagtctttccaca

SEQ ID NO: 215 - DNA, 880 bp, Sorghum bicolor
tcctgccaccgtggagctccacaacccaaacccctctctccatcatcgttatcatctccccctctctcctttgctagcttgctgcacaccttcagagctagcttcattaattagctgcagttcaaaggcgccgtccattctagctcggccggtgttcttgccttggcatgcatagccagttggtctgcggcggctgcaagcgtcttctccagtaccgcaggggagccaccggcgtctgctgcccaacctgcaacactttcacagccgccaacccatcaggaccggagatgtctgaactcgtctgtggcggctgcttcaccatgctggtgcactcccgcagcgccaccaacatacgctgccctcactgtagtaggctcaactccacaagatcaggaaaccaaatgggtcacctgtcatgcgggcaatgccggacaactctggcatacccaccgggagcgacgacagtcgggtgcccaacatgccgcaacattaatccagtcagggatgctcggccccagacggttctggtggagaatcctaagacactggatgaaaagggcaaactggtgagcaatgtcgccgttggtgtcacctcatggaaaagatgaccaagaactccttccggaaatcgtcccaggggttgcctatagactaaacccttcgtggacatgtataactactatcatcgtcaacaacaacaacaacagcagctaatgtaaaatcaagtgtgttttgaagcttgatgtcatatatatataagtaaacaagtaactgttgagcagcaaaagatctgaaaaatgtaaatacgctagccagccgtgtgcgtgcgctagcctgctgtgtactttgagagccgaaaaggaatggaaaggagcgaagc

SEQ ID NO: 216 - DNA, 562 bp, Sorghum bicolor
aagcgcgctccgacacatgacagggtggaagcttcgctagcagcagccagatagccagagccacagccaataactgccatgtccgccacggccaaatgcctcgaggcgacggcagggccgccggcggggtcgggcagcagcaggtgcctgctgttcccagggaaggagcacaggaccagcgtcacggcggcggagttcaagaagtggctgaagcagttcgacgccgacggcgacgggcggatcagcaggcgggagctccgggaggccatccgccgccggggcgcgtggttcgccagcgtcaaggcctggtgcgccgtccgccgcgccgacagggaccgcaacggcttcgtggacgactgcgagatggagagcctcgtcgagttcgccgagaacgagctgggcttcctcatttccaaggagccgacgtcgacgcccaatcgacgggcgcaaccaccactgcggtggtgaaccgtctgttcctctgctgttcatcttcatcacttatcagcagcgcctctccgtccaccctccgaataatttgtgtggaaggatcggatcgaat

SEQ ID NO: 217 - DNA, 1120 bp, Glycine max
gtttccttcaattcgtggcctctctcagtagaatcaccactttctgccaccgtcaggtttctgacttggttttagtaaggattcaccttttcttatatcagttggtggaaactataaattgtggctggagttggataggaacggagcagaacagaactatagtatctcatctctcttgatagtagaagtggtgctgactttcttgtgatcagtgatgctggtgaaatctctctcacttcattctcatgccttctcaagttgcagtttttctgcaagtgaaattggaacaaacccaagttgggttcccttaaagtccttaaatagcctctgctgttcctccaagcctagaaatttatgcagatttttgtgtctgagcactcaaaatggtggcttcagagaaaactctggtgaagttggacttggagatgcagtgataattgtggatcatggctcgcgtcgcaaagagtcaaatctcatgcttaatgaatttgtggagatgtttaagcataaaactgggtatgagattgtggaacctgctcatatggaattagcagaaccatcaataagagatgcttttcaatcttgcgttgaacaaggtgctcatcgcattattgttagtcccttttttctctctcctggaaggcattggactcaggatattccttccttaagtgcagaggcagcaaaggaacatccagatgtgtcatacattgtaactgcaccccttggattacatgaactacttgtggatgttgtgaatgatagaatcaaacattgcttaaagcatgtggctggagatgcagatgagtgttcagtttgttctgggactggtaaatgcaggctctattaatttgtgaaactagattgttttggatgctattaaatgaggctggaagtcgaggaatctgtaaattgggttgcaactgttctgaagttgttattacgacgcacttgaactttgcttcatgtttggttcgacgtgacttcttgaggagcttcgtttatgtttcttactccaagttgtatcagtatttaacattaatgttgaggtttcgcttacccatttgcaaatcatcaagaaactacccatctttctctctatttatttgtgatttgtgtc

SEQ ID NO: 218 - DNA, 1913 bp, Glycine max
agaaaaaaaaaagaacattaaaataaaacatgagattctgtagcttccatgatcctatgatgaccccgggtgagtgttgatgagaaaacaaaggatagagggagatctgtttcagtttgaaacttcaacatctcttcgtcacagtcttagttctttctggtttatctcttctgttgttgttagaacgaacccaacacaacattacacatttcacacagatctggtccattttttgtcactgtcaacagaactatcccttctttcaccaccgccagtgatgataacttgaagaaagaatcagacatggagggtgatcttcaaaggtctctatctttgcgcctaaatcgtagaggagatcgaagtaatcaaaatcctgctaaagattttgaggtgggtttcttttcttcggggagggtacctcaagattaccccatgaagatcgtttggaagaaagggtttgttcggttggttcttgtagcagggatcttgtggatgttattaattcttcttgcattgttgttccatatatggtcttgtcaaacttccgtctcctttttatcagctatgtgtaacaaagatagcaaggtttacaacatgttaggcaatatgggactggtatcaaaacctcacagatgtccaattcctctttccaatgaccctgataaaatagttatcccaactagaagaactcccaacgaaattctaaaaaatctgtcgtatgttatggaagatgaggttccacatagtgaagctcagtcatctcctctatttggaggccatccaagttggaaacaaagggaggaaagtttcaaactaaaatcaaatatgaaggtgcattgtggattcattcaaggtggtggtgctgaaatgaatcgtgtagacatcaaatatgtcaagaaatgcaaatttgttgttgcatctggcatttttgatggctatgatttacctcatcaaccatcaaatataagccttcgctcaaaggagcttttttgctttcttatggtggtggatgaggtatctctgaaattcatgagggaaaatggtactgtcaaagaagacggagctggtggaaaatgggtgggaatatggcgacttgttcttcttaagcatcctccttatgatgaaccaagaaggaatgggaaagttcccaaaattttaacccacaggttgttccctcaagcacagtatagtatttggattgatggtaaaatggagctgatagtagatccattgctaatccttgagagatatctgtggcgaggcaggcatacgtttgccattgctcaacacaagcatcaccgtagtatatatgaggaggctgattcaaacaagaggcgaaagcgatatgctcgaccccttattgatctccacattaaaatctattattacgagggaatgaagccatggagttcaaataaaaagaccaatagtgatgtaccagagggagccatcatcattcgggaacatactgccataaataacttatttagctgcttgtggttcaatgaggttcacctcttcactcccagagatcaactgagttttggctatgttgcatacagattgggggacgcgtttaaattctttatgtttcccaactgtgaatacaattcactgtttgtgttgcaccctcacacaagagagcactcttctcccatagaatgggttaaacagttggatgaacttaagaaaggcaatttaagagaaagtaggggaggactaggcttgtttacgccttatcctggggatcttgattctgttgttctgccaaatgtaacaagaacatcaaaagcaggctgacattttgattattgttttaacatattcattttgttatgtattttttttcaagaatttcttgatgtttattttgtttaatcttaatgaaagtaaagataaggcgcctttatatt

SEQ ID NO: 219 - DNA, 1175 bp, Glycine max
atattattattacgcttcatttgtaaatgactaaatggcaatgagctcaattcataccttgtacgctttttctttccgtttgtgtttcccaaattcatctccacaatttaagcctctgaatgccattccactaagaagaacaaaacactacaacaacaacaacaacaacgttaaatttccccgagaaagaacaaggaccagagcaacccttgatgatgttgaaacagaccaactttcctcaatcccacttgttgaaaatgagaaagccaaaaaggatgtagaggaaagtgtgaaagtgttaaaagatgcagctaagacaagaaaggtagcagcagaggagattctttctgcattgtctatcattgagaaagcaaaagttgatccttctgccttttttgaaacccttggtggaaaggaatcccctgggaggacctggatgctaatttttactgctgagaaacaactaaaaggtggtcgatattttcctctcacagctgttcagaggtttgatgctgctgcaaagaggatcgaaaatggaatatatcttggacccattggacagttaacatttgaaggcagactttcatggaaaaagagaatactggcttttgtttttgagaacattcgaataaaagttggacctttgcaacctctagagatcagtctaggaaaaaaggaagacaaagaaccgagtaccaaggatcctttcttcatctggttttatgttgatgaggaaatagctgttgctcgaggcaggagtggaggaactgcattttggtgtcggtgtcgtcgtgccaataactgattgtttttaactttctttccttctctacttctgagttttgatggaaagatacatgtatatatgtaaacatttaagttcagttggtggtaaacatatttgtacttgtttattgtatagttacttgtttgcataaattccaggaactaaaatatgtaattagtttgtgtttcacgataatcctactgtcgtggaggtcatcccgacttttcctattttatcatagtcgtgaaaccctttcttgttaaagaagacagtagcatggatgattggatttattctttctgatgcatagggtctttatgtatataaaaaaaaatgtgtttcggctatcgagcaaagaaacgaggagtaaaagagtttgtaattcatc

SEQ ID NO: 220 - DNA, 2712 bp, Glycine max
aacaaccaagaagtcgctagaagaattaaagaaaataaaaagaaaaaagaaaaagaaaacagagcaacacacaccccaaccgcagagagagggaaacacgaaaaaaaaactaactgaacctctcagtcgagatatgcgattgcggtggcgtcggcggtggtccgggttgttgagtccccgatcgacggccaatgcagcggttcgttgcggcggcgtgcggcgtcgttgatggccctgcagatgacttggcagccgagtctcctgagtcagaaacgcaaaaccggaaccggtcctcccttagggctccgtaacctaggcaactcgtgctacctcaacagcgtcctccagtgcctcacctacactcctcctctcgccaatttctgcctccgtctccaacactcttctctctgtgattcttctgggtcttcgtgtccgttctgcatactggagaagcagattgcacggtcgctgcgattggatctcacgcacgacgcgccgtccaagatccagagctgcatccggatcttcgccgagaacttccgctgcggccgccaggaggacgcgcacgagttcctccgctacgtcatcgacgcctgccacaacacctgcctccgcctcaagaagctccgccgcaaaggcgcagaggccaatggcggcggcgacgaagctggtggcagtacagtggtgaaggagattttcggtggcgccttgcagagccaggtgaagtgtctgtgctgtggatatgagtcgaataaggttgatgagataatggatattagtcttgatgttttccatagtaactcgcttaaagactccatgcaaaagttctttcagcctgaggttttagatggcaacaataagtacaagtgtgatagttgtaagaaattagtggccgctaagaagcagatgtccatacttcaagcacctaacatccttgtgatacagctaaagagatttgagggcatattgggtggcaagattgacaaggctgttgcatttgaagaggttttggtgctttctagcttcatgtgcaaagcaagccaggatccccaaccggaatataagctctttggcactattgtgcattcaggctactcccccgaatctggtcactactatgcttatataaaggatgcaatgggtcggtggtattgctgtgatgattcttgtgtagctgttgcaacccttcaggaagttttgtcagaaaaggtttacattctttttttctcgcgaactaaccaaaggccagtgtcaagtagtaattctcttgcttcaaatggtgtaaagcctcattccaatgggagccaaacatctgaatgcccaaaggttggtgtaccaccaaaagcagtgcatgcaaaatcgaattctgagctatcttcttggaaggatataccaagagtttctaagactgctaaagcaccttccagctcacgagtgaagtttgacattaatggaagctcttcttctaaaagaaattctgctcctgtgagtgtgaatgggaaagttgatgtttgtaggaatcagccttcagcagtaaatgggcatgtgaaagattcagcttctttggagaatggtaaggaagattcttcattacccaccaggaatggcattgacgaaaataaagtttctgttgacaaattgaaaagaaaggagtcaacagtttcaaatggacacactggtaatcagacagttgatattcattctgtaaagtcagatctcaaggaagatactgacagaagcaggataatagcaggtagagtgcctgacaattttaagcaagaaagcaatggcctcaacaacaaacctacaatattggggaataagagaaaactacagggggacccatgcattttacttgcacatgatggtcagtctcaagcaagagttcaagaactgaaggacattcttgggaaagaggcaaagtcagttttgaggtcaattggctggactgataaggtctacgaatttatgcgttcaaagaagttacgtgcacaagaagctggaaatttgacaaatggagatgaaataagaaagttgttaataggagatgcgcagggagctttcatatccaagattcccgagtcattgaaacaggatatgattcaacgactccaatcatttagccaagaaaaaatacaattttcaggaccttgatcagagcatgaatgtcgatctgtcgtgctagcgaggcgtggtgtgaatactctgtattactaattattgtagtgatggtggcacccttgctgggatgctcagtttgggtttgttacatactctaactctttgaggctggcgataatagcaggagaatgaggagacttgttatcattgaagcatggctttgttatgcttctaggtgcttcattcatatttgagatagaagttcagatttcatgtcaggccagttttctttcttcatggaggctataaagttctattgcatcttgaggagagcttgccaggaattctattcattctgtacaatcttatattttagcgatgtactgaagcaaaatcttaattttctataaaattgctcaacaaattttgcagcgaagatgaggctgtgcatgacttgtggatacactacaccctattaacagtgtctgtagttcttaaaaattcattcgctatgtaaacgttttgcccgagaggacaagatcctgaaatttgtgagatttataagtaaattttgatacacatcggcaacta

SEQ ID NO: 221 - DNA, 848 bp, Glycine max
atataatttgggggagatgaattgaattgggaaagaagtaagcggttttccctggcaatatgatacgaaatgcagcgattaaggagttccttaaaaaaaagtatctcaattcacgggctgccattgaagatacttatttttccaccaaggatacttttgagagacatcgcgtggttttcaccgttggaacttccattgcttccgttgccactgcttggttcggttattccttgcgccatttacatgacatcaaagttgatcaaaggcttcaatctatcgaaaattctatgaaaaacaattccaatctccaacattcccaaatcaaagacattgtcgcgggttccgcttccggagcttttagtatccctgcttgtgttgccactgctggaacctccttaatcatcgggtatgccttaggatggagaggtggaatctggtatgcaactaagaagttccgaaaggagcagatgaaaatgctaggacagattacacctaaaagatggcaattgcttgggaagataaagcctagagggtttcaattccagttccttagaaggaaacttacaagattcaaagtgtctgacactgccacaaaaaatctgaaacgagtataaagggtgtttctaccgcacatattgctgtaaaatccgattagtatactactataaatggttctttcaagcaccaatattgatagagatggctgcggatactggattaggctttcaattagacaaacagagtagcaacttagttattatcaattatcatcaaatttttctctgatattttattttggcctgcagttgctcgcccttcataaattcttcatccctcatgggaggagt

SEQ ID NO: 222 - DNA, 1269 bp, Glycine max
attatcactagcaaagactttgatgaaattgcagagagtgggaattgaagagcaatggcttcagtagcttcatcatcatcattttctacaaggcttcttctgcattcacacacacctctagtatgcagaagaagatgcagacccaattttctgaggatggtgactcgctcctgtctcgatgacagctctgctctcctccgagcagcgcaacacactgtggatacatacgtgaaaagtggcatggttgtaggattggggtctggtcatgcttctggtatggccattcagcatttgggtagccagcttcgcactggtaatttgaaggatatagtagggattcccatgtctgtttcaagtgcaagtgaggcagcaaaggctgggattccattggatacctaccaaggaagttctcaaattgattttgcatttgatgatgctgatgttatagaagaaggaacacttgttgctatcattgggcgccggaaattgcaaggtggggaatccataatccaggaaaagtctataataaattctgccaataaatgtgtgttcattatcgaagaaaaccagtacaaaggaggtctggaaggttctattccagttttaattcagtctctcaactggatgacaattgctgaagagattgatgatatgtttctgggtgatgctgaggtctggagaagaccatctatagggcaagcaggtccactaggaggtgacttcccagtagtcaccaaagaaggacataatattcttgatgttatctttacatctccaatagaaaacctcgctgaagtagcaaaaagccttgataaagttgatggtgttgtggaccatggtgttgtttctaaaatcccatgcacagttgtaattgcttctcagactgggctgaacattttggacaaattaactgcagatatagtgggttaggcttcagagcttatagctctgctttgcacatgaatgtgtatttagttttttttttttccctcttatttttctctccattatgctttttgcctgcctgtgcgttttcatcctccctttccaaagaaatgagtaattgtgactgtatcaacgctagcaaaggaagcttagggctatgtgtttttataatgtttgtatacatgaaacttcatttgtctttttttctcttctttcaattcccatatggttctatcatcaccatgaatactggatgggactgggggctggtttgtttaccttaatcacattgcattttatcaaatcatgtagatttacatttac

SEQ ID NO: 223 - DNA, 1302 bp, Glycine max
gcattctctatttctcttcccctctcatcattttaatcacgcgcacatcagcacaacacaattcactaagctaaaatcacttcatcatggcttcctcgtgtgcttcctctgccattgcagctgttgccatctccacaccaagttcccagaagaatggatcactcttgggaagcacaaaagcttcttttcttagtgggaggaaactgaaggtgaacaactttacagcaccagttggagcacgatccagcactacagtttgcgcagttgctgagcctgataggcctctgtggttcccaggcagcacccctcctccatggctagatggcagtttgccaggagattttggctttgatcctctaggtcttgcatctgatcctgagagcctgagatggaatgtccaagcagagcttgtgcactgcagatgggccatgttgggagctgctggcattttcatcccagaattcctcacaaagattggtatcctgaacaccccttcatggtacactgctggagagttggagtacttcacagacaccaccacactcttcatagttgagctctttttcatcggttgggccgagggtagaaggtgggctgacatcatcaagccaggctgtgtcaacactgaccccatctttcccaacaacaagctcacaggaactgatgttgggtacccaggtgggctttggtttgacccacttggctggggaagtggttctcctgagaagatcaaggagttgagaacaaaggagatcaagaatgggaggttggccatgttggctgtgatgggggcatggttccagcacatttacactggcactggtcctattgacaacctctttgctcaccttgcagatcctggccatgctactatttttgctgctttcactcccaagtgagaagtgttggaacaactctatgattgcaagccttggagaaacattggcaaacctttttaactaagttgtaacgcttaaatggttttaggtgggagtgtttatgttggtgaaagcttgtaaaatggctacttctattgtcatgcatagattgaagattcaatgtacaaatacctatttaaggtttagatgcatttaatgtaaattcaggaagtaatcacagtttttgcatggatgatagaactgcaacaatatttgatggtaactagcgcaggggatattagatggtccttgttaacctgctgaatcttcatttcacacttcctcaaaaatcattgcttttaaacgagtatatccatctcataaccttacagaaaatgcacagaaaagtatgttaaaattaagc

SEQ ID NO: 224 - DNA, 974 bp, Glycine max
tttaacaccaagtgaaaagaaaagaaaagaaaaagagacaccacaacacaagactcattcttcctcattccgaaaaatggcgtctttgcagcaccccacagcttccctccaatccaaacacatcctaatcccccgaaataccctctcccagaaacccatcctcaacctctccctccatggtaccaccttcacccccctcaagctcaaattcggcgttaccaccaccaccaccgccgccgccgccacccgccgctccaccggcgccacgggagccagaatgtcagctaccgcagcctccagctacgccgcggccctcgccgacgtggcggccgcgaacaacaccctcgacgcgacaaccgcggacatcgagaaaatcgacgaaatcttctcggacccgcaggtgtcggactacttcgcggaccccaccctggccgtggagaagaagcgccagctgatagacgagattgcggaatcctcggagttccagccccacacgagaaacttcctctacatcctcgtggacgcgcagaggatagacctcatcaacgagatagcaaaagagttcgaactggtttacaattccttgaccgaaacggagctggcggtggtgacgtcggtggtgaagctggagtcgcagcacctggcgcagatcgcgaagcaggttcagaagctcactgggacgaagaacgtgagaattaagacgctccttgaccctagtttggtggcgggtttcactgtcaggtattcgggctctaagttgattgacatgagcgtcaggaagcagcttgaggatattgctgctcagcttgagctgggtgatatctcactcgccgtatgacatttccctcccttccgttgcgttgctgccttccttctgtttgtttttcgtttcgatttcgtttactattatttttggggccaagtataacgtgtattaaatactatgaatgaatgaattccaaaacttaatttac

SEQ ID NO: 225 - DNA, 2291 bp, Glycine max
taacaccacacaccattttctcttataagttctgttctcttcaaaatggagactaataatgcatgtactatgcattctcattgcatagagatgtccatggaagtgcaccaagttgtgccaccacctcacaagagcacccttcagaaactcaagggtaggctcaaggaaactttcttccctgatgatcctctgcgccaattcaagggacaacctcttaagagaaaactgatccttggagctcaatatgtgttccctattctccaatggggtcctaagtataatctcaaactcttcaaatctgaccttgtttctggcctcactattgctagcttggccatcccgcagggaattagttatgctaagcttgcaagtcttcctccaattgttggactttattctagttttgttccaccacttgtctatgctgttcttggaagctcaaaggaccttgcagttggacctgtttctattgcttctcttgtgatgggatccatgttgcatcaggaagtgtctcccacaacagatccaattctgtttcttcagctagctttcacttcaacattatttgccggtctctttcaagctttgcttggaatcctaaggctaggcttcataattgattttctatctaaggccattcttattgggttcatggctggagctgctattattgtctcactgcaacagctcaagagcctgcttggaatcacacatttcactaatcagatgggtctgattcctgttatgacttctgtttttcacaatatacatgagtggtcatggcaaacaatattgatggggatttgcttcttggtactactactattagcaagacacgttagcataaggaaaccaaaactattctgggtctcagctggagctcctcttatgtgtgtcatcatctctaccctcttggtttttgcaattaaggctcaaaatcatggcatcagtgtgattgggaaattgcaagaaggaataaatcctccatcatggaatatgttgctctttcatggaagtcacctggacctagtcatgaaaacagggcttatcactgggattttgtccctcactgaaggtattgcagtaggaaggacatttgcagctctcaaaaactacaaagtggatggaaataaggaaatgatggcaattgggtttatgaatgttgttggctccttcacttcctgctatgttacaacaggtgctttctctcggtcagcagttaacaacaatgcaggcgcaaaaacagctgtgtcaaatgtagtgatgtctgtgacagtcatggtgacactcctttttctcatgccattgtttcaatacacgcctaatgtcgtgctgggcgcaatcatagtcacagcagtaattggcctcatcgatctccccgctgcttgtaacatttggaagatcgacaaattcgattttgttgtgatgatgactgctttcttaggtgttcttttcatctctgtccaaggaggccttgctcttgctgttggattatcaactttgaagatactcttgcaaattacgagaccgaaaacagtgatgttggggaagataccaggaacagacatatatagaaatcttgatcaatacaaggaagctgtgagaatacctggatttcttattttaagcattgaggctcccatcaattttgccaacatcacatatctcaacgagagaacgttaagatggattgaagaagaagaagacaacataaaggaacaattaagccttcgattcttagtattggaaatgtcagctgtgagtgctgttgacacaagtggaatctcacttttcaaggagttgaaagcaacactggaaaagaaaggtgttgagcttgtgttggtcaatcctcttgctgaggtcatagaaaagcttaaaaaagcagatgaagctaatgatttcataagagcagataaccttttcttgacagttggagaggctgtagcttcactttcttcagcaatgaaaggccaatcatcaaccattacagaaggggcacacacaattgtgtcacataattgataaaataagactgcaaaatatataagcaaaagttaaaagaaaaagaaaaaaaaatagaagcagcaacaactacaagactagcatagaatttgcctaatggcaataccaatcattgtaaaatcctacagtttaaacaattgaagtgaaatgtgtacccttgtcatttgtgcttgtgcttactagatttgcctcacaagcatcgtagtcgtaacttgtatgggaactacttgttgcttgttaattcaatcgttgaagttgatttccaagca

SEQ ID NO: 226 - DNA, 1102 bp, Solanum lycopersicum
ataattatggtataatctctcatctcggtaactatttaggagaattcaacaaaatggcaactaatgacactgttccgattgtataattggtcggcgggagagacgacggacggcggcttctctcaacggcgccaccagaggaaattgaccggagataatcagaagccgataaattcctgcaaggcatggctgccaaactgcctttaccgagctgtcccacaatctttaagcatttgagtgtagatcatactagatcaagatttaatggagctgtctgcctttggggaactgcacattcattgggcagaatcatgcatttcgggctatcttttactaatattgtccaaccttattctttcagaattttcaagaggcgggcatggtctataagaagtgctgcagatggcagtggactagattcttctcctacaaccagcggtagcagtggaactcgacttattagggccatagaggctcttctagtcaaactagatgcgagaattaaggtgttgagaaaaaaccttccaatgaagttgctgtttttcttagtgggtttctattgtgcaaccgcatttgccactgtaatagggcagacaggtgattgggatattatttcttctggattggctgtggctgtggttgagggcattggagctctcatgtatagatctattcctttaattgatggggtaagaagcatcatcactatgttcaattactggaaaactggactgactcttggtctattcctcgactctttcaagtattaacgcggagatgaggagagaagtgtacataaatcataatgccattgaaatttcatagtttatgttgtgtgtttttgtaggcaaattcatgttgtcaagagggtaactatagtctgttgtacagtgtctccaatgatacaacatatacgtcacttgtacatgggaggcacccctagtttggtttcacattaataaaatgtatacagaaatatggtttgatctttcagttttatactatcttgtttaatcaacaccatgctcctggatgttaatagagttgataagaaaagtttcaaatttaaatattggtgaagccagaaattcaaaaaagaaaa

SEQ ID NO: 227 - DNA, 2049 bp, Solanum lycopersicum
attctatttatatcaccttctcttcttcctttttataccaatctctctctgttttctttctcttaaactcataaaattttcttctttctcataaccggaaatggtgagtgtagctactgttgatgcccaaaaagcagaggtattatcttctgtgatttctacgaatcaaaatcaatcttcggaagagctacatgtatttagatcgaaattaccagatatatcaatttccaataacataccgctccatgtttacttgttcgaaaggctatcggagtttgaggagaggacatgtattatcgcgggaagtagtggagaaacattcacgtttggcgaaacgtatctcatctgccagaaaattgctgctggtttgacaatggtagggatcgaaaagggagatgttatcatgacttttctacagaactgttcggaatttgtgtttaccattctagcatcgtctatgattggagctgttatcactacggctaatccgttctatacgaaatcggaagcgtttaagcagttgaaagcttcgaatgcgaaattgatagtaactcaatcgcagtatgtggataaattccgtgatcccgcggaaaatgatccgaaaattggggaggatttttcagtcgttacaattgatgatccgccggagaattgcttgcatttttctgtactatcggaagctaaagcagaggatatgccaaaaggagttgttatccaccctgacgaccccgtggctctgccgttttcgtcagggaccacggggttgccaaaaggtgtgatactgactcataaaagtttgataacaggggtggctcaattagtagatggcgacaacccgaatttttacttgaagcacgacgacgtggtgctgtgtgtgcttcctctgtttcatatattcgcgctgaattcagtgcttttagtctcgttaagagctggggctagtgttctgttgatgcaaaaattcgaaattagtgcgctgttggagctgatacaaaaacaccgtgtctcagtcgctgctgtagttccgccactggttcttgcattggcgaaaaatccaatggtggattcgttcgatttgagctccatacggctcgtgctgtccggggctgcgccgctggggaaggagctggaggaagcactccatagaagagtaccgcaagccatatttggacagggatatggtatgacagaagcaggaccagtagtgacaatgtgtccagcatttgcaaagcaaccattttcaactaaatccggttcatgtggctctgtggttcgaaatgcggacctcaaggtggttgacccggaaaccggtggctcacttcaccgtaaccaacccggtgaaatttgcatccgcggttctcaaatcatgaaaggttatctcaatgacgatgaagccactgcacggaccattgatgtcgatggatggctccacaccggcgatataggatatgttgatgacgatgatgaaatatatatcgtcgatagagtcaaagagctcataaagtttaaaggtttccaggtgccaccagctgagcttgagtctcttttaataagccatccagatattgcagatgctgctgttgtgccacaaaaggatgatgctgcaggggaagttccagttgcatttgtagtccgttcagcccaaggttttgatcttactgaagaagctataaaggaatttattgccaaacaggtggtattctataaaaaattgcacaaggtgtattttattcacgcgattccaaagtctccatctggaaagatactaaggaaagatttgagagccaaattgatcgcgacaccacaattataatgcactattcaaaagaccgtcttcacgaaaaaaagtatgtaattgtatcgaagatcacttatacttaaaagtctttaacagtatggtatcaagtcttatagatccaatgactagttctgtgaatgttgatttactttttaaaaaaaaaaattattttcttcactttttgtgtgaagtttctggattctttgaaaggaaaactttcagttttataaattcatgcaccattatttatt

SEQ ID NO: 228 - DNA, 1137 bp, Triticum aestivum
acaatacacgagcaaaaaaatatcatttataaattataaagaggcgcggggacgccacgctcccgcattgtctccactcgctccgtccgccggggaaagaaaccagcagcagcgccggcgagagaggagcaggggagaggggcagagggccggaggcgatggggctgggcgtgagggcggcgccgttcacgtacgtggcgcacgcgctggccgtggtggccgccgccatggtgctgtactggtgcatccacttccgcggcggcctcgccttcgaagccgccaacaagaacctcatcttcaacgttcatcccgttcttatgttgattggctttattattcttggcagtgaagctataatggtatacaaggtactacctacggtgaaccatgatacaactaaattgatccatctaatactccatgcgattgcgctcgtgctcggtgcggtcgggatatactgtgctttcaagaatcacaatgaaactggaattgctaacctttacagtctgcattcttggcttggaataggaacaatttctctatatggtattcagtggatatttggattcttggccttcttcttccccaaggctgcgccaaatgtgaggaagagtgctcttccttggcacgcactacttgggatcttcgtttacattttagccctggcaacggcagaacttgggtttctggagaagctcaccttcctccaaagctcaggcatcgataaatatggaccagagtcatttctggtgaacttcacggcattggttgttgtgctatttggtgcctctgttgttgtagctgctgttgctccagctcgccttgaagagccacagggttacgctcccatcccagaaaactagtatgtgtgaagtgtactgcatacacagaaattcacaaagtttgctctcaccatagtgcttcgataccaggatctctccgatttgaaaataaatgatctgataagaaaatgttgtgcatcttctgtgtatatgtaaatacatacagccatacaggtacatattgttcttccatgtatcatgtataactgaaacatctatgtaagcagctattttacaaattacatatttttcgtatctgatgagttttattgtattcaacttactatatttttgt

SEQ ID NO: 229 - DNA, 1240 bp, Triticum aestivum
accgaaagaggagagagccatcagccatgggaggaggcgtcatgcgcaccgccgcgaaggtcggcctcgccgggggcgccgcggcggcggcgggccgcttccgcaacgtcgccccgtccttcgccacggcccccgcggccgaggccgccgcggcggcgccgctgctgtccgcggccggggagatcccgccggtggcgccggccgggtcgcagtgggcgtcctgggaggtggacgactgggagttcgcggactggaggtccgagtcggcgtccgaggccgacgtggccgtggtcggggggcccaggctggtcttcgccccgccctcgcgggaggaggccgaggaggccaccgccgagctccgggaggctattgacagggtttattttaaagagactccagtagaagttgttaaggaacatgatcaagagcttagcaagctgggagccgatgcattaattcctgctatgccgggacatgtagtgcaggcttttacattgttaaaatcaagcccagaggcacagagcgttgttgcctcgcttgcatcagataaaaatgtgtgggacgcggtgttgaagaacgagagggttatggaattttacaagagtcaccagcaaactctggtcaatacttttcctgagggcaccgactctagtgactcagtagagtcaccggagaaatttgaagaggcatccccagaatatgcacttcccactgcctcgcctttgtcggactttgtggacaatgcgaagaagacgatgatggagatggttgacaacataaccaacttcttccaagacctgttccacaacccggcagaagctgaggccggaccgggctcatcctctaaaaagccttcgttcgcggagatggcggctggcggatctttcgtggctcttgccatggcggtcatcctagttgttctgttcaagagggcatgaacatatactacaagttcaaacgcccttgatgcctattgggacttaaatctgtcgaaaataactcgtgttatgaagaactatggatgtattgtacagcgtgtgtctcctgccgtactgtgtcagttaaaacttccgagtgttgagaccagtttaataaagacatgttatgctcctggttaattggtaatgctacgctgtagcatggatattttatctgtgtttagaggtgtgataattttttttcttttgaaaaggccataggccatatattaagtagtataaccccttaaaggctttctttt

SEQ ID NO: 230 - DNA, 1096 bp, Triticum aestivum
ggagcgctcgcctccaaaggccccaatcctgccgctcacgccccacgaacccatcaaaccctagcgtcaccacccccctcgagatggacggccgggacgccacggcggacctgcaggagtgggagctcctcctcgcctcccccaccgccgccgcggcgcccgggccgtacgccgccggcggggaggcggtggtggaggacgacgccgccggggccatcaagtacgactacttcgacctcggctccgacgccaagtacgccaggagggcgtccctgtcggcgggggccgaggaggaggccggcgaggcgagctgggtggagccgcaccccggcgccctcgccttccccgcccgcgaccgcgccgcgctctggtccgactcgtcgtcggacggggagcggcgcgaggacgccgaggccaccgagccgctggtggagacgccccgggaggcggcgggggtggacgagggggcggtggcggagggagggcccgcggcggcggcggcgcggtggtggaggctgcccgtggaggtgctgcggctgtgggcggcgcgcgcggcgaggagcgcctggtcggtgcccgtcgccgtcgcgctgctcgggatcgccgtgctcggccgccggctgtaccggatgcggcggcagagcaaggccgtggcgcgcgtgcggctcgtccttgacgataagaaggcatctcaattcaaggcccagccgatgttacggcgagctccgatgataaagcctatgcttcccggcaatggagtgaccccatggcctgtgctggggcacctgtgagtctgtgagatgtgagatcgacatagagctagaaatacagttggcttgtgagcatactatgcagtcccctgcagatttatcataccctacttgaagtgcgtacttgtgaaagacaaaatgatgcttaagtgactcatctagtacatcttttctgcttgatgcttgtaatgcacctgtgtgtatatttttcttctgtagccctgttttacctatgtgcctgaacaatgtggctgtgtatattatgacacaaagtatctgaatatggttgtagaatggcagtttgaaactgcggcgagcttacttgc

SEQ ID NO: 231 - DNA, 3491 bp, Triticum aestivum
tcggcggcgacgagagggagaagggggggctcgagctggttgttctccggggaggtagagggagagggaagcgaggcctggccagctgccgcggcttggggccgaggagggtgaggagacggaggaggccgggctcgtgctggcgctggtgctcgcctagggtttggaagcttcggctggctcggaggcgtcaagtgtaatggccacacagagtgctgttcggttaattggaggggcaggggctggtggctggactaaggatttcggagcattcgactctccactgggaaatcttccaggagaagggctggggtttgtggagaatggcagtgggatttatgggggctggggggaatctgtcccaaatcgaagtggaagcgcacctcctagcatggagggatctctggctgctcttggtaatcttataggtcagcggagtggaaactttgacaccagtttaggtaacttggacaatgtgactggcagttccacggctgaggagcagttacgtgctgatcctgcatactttgactattatggttccaaggtgaatttgaacccaaggcttcctcctccactaatctcaagggagagccgccgcttcatgaaccgtgttggcaaggttaaagaatggagagtggtctcccaagatgacagcaataaaggctccttatttatacctcgatctactctatcaactcacaaggaagaacctgaagatgataagtctccaaggttggattcgagttctgcagatgatgaacagatgaatcttgtggattttgtgcaggagagcttccagcagaaccccgattcgttgtatgataactcttcacatctatcaagtagcagtattggtgatggtgtagctgtccattctaatattgactcatcaatgaatttgccacatgatgttgtcaagccgtcagggttgaattcgtggacacctgtacctttggccagtgtactgagaagtacacttagcaacaatctttcatctacatctgttcccagttcatcatgttctgataataaccctagtgtacaaatttctgagggacagcaagaaaagcagagcatagacatgaagcctggaaatgatgtgcctgtcagtggggcagttgttactgaacttgatgttgtggactctagcatgaagaatttgaagttaagtttggatagccagactacgtcacaagttaagcagcagtggcagggcaatttcttgcagcagtatggcttctcacctctagtccaaggcgaccatatggcaatgactcctcatggagcacatctgccccatgttccttttgttgacaacatgtctcatactcagctaaaactacccactggtgacatgcagcaacttttacctcaacttggtatgccaacacccttttatacaccgaattcttttggaagcccatattatcagaatttgcatccagccagtgtattggcaaatccttatgtgacctctgggtatgctttgggtggttcaagtttcccacccgttatgactagttattctccccagagttctgctgcgacacctctcgacagtcctatgactccaagctttagtggtaggccatctggttttccttcagcagggaatcttactgtaggaaccgagtttgttcagccatataaaatgtatgggcaacttggggttcccatgcagccacccattcccgacccgaacttttttcagttctttcagcatccctcttttccacagtatgctagtggaaatcaatacaatacattggctccaaggggtagtgtttttggaaatgttgctgataattttgatccacgtaaattatttcctcaagctcaatatccgtctgatcagaggcttcaacttccaaaaactggaatttttagttctcctacaaccctaagaggaggaactgttccaaattatcatggcattccaccctatgttggagcgccattgacttatccaacaagcccagtgtttcaggggcaacctttctctggaatttccccctttggtagaaatgattctgcgaggtttcagtccgcctcaagaagtatgactgctgtttctgggtttcaagggcagcgagaaagggagaaatttgataacccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagccgtgtttgcagaagttcttcctcatgcttcatctttaatgactgatgtgttcgggaattatgtgatccaaaagttttttgaacatggaactcctgagcaaagaagggatcttgccgccaagcttgctggtcatgttgtacctttgagccttcagatgtatggatgccgagtaattcaaaaggctctggaagttatggaacttgaccagaaaatagatctggtccgcgagcttgatggaaatattatgcgatgtgttcgtgaccaaaatgggaatcatgttatacagaagtgcatagagtgtgtccccacggaacatattggttttgtagtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgagatcttctaatcagagagattgtggagcagactgacggaaatgataccttgctggcaatgatgaaggatcagtatgctaattatgttgttcagaagatacttgaaacatgcaacgatgagcagcgggaacttctggtcagccgtgtaaagggtcacttgcaagcactgaggaagtacacctatggcaaacatatcgcgagccgagtcgagcagctttgcggtgaaggagatgccgagtgcgactcataagcgacgggagtgcctcaacgcccggcaaattcatcagcaaggaagaaaccataacttggaaccgcggtgcttcaaagtgctaacaagacttggaactccagcaaaggaagattgtacatatgtgactttgtttaggcagtgtagggaggtgctaggcacaaggtttattctgtgcgcaccagtgtatctatgttgatatgttagggtgtgcttatccacactgcactagttggtagccgtgtgcaaaatatgtatagtaccagtggtttggcttgtatgtgtgatacatgtgtgtatcttgactgcttggtaatgtaat

SEQ ID NO: 232 - DNA, 1005 bp, Triticum aestivum
ctactcccctcctcctccccctcctcttccagaacccagacccccgcccgcctccgacctcttccccccgtccctccaccgctcgcacgatcgaccacgcacgcaccgcgcatcgcattcctccgcagagtcaaccccaccggcgcggcggccaaccatggaggccgcggcggccacggggctccgcccctttgccgcgccgctcggggccgcgacgagggcgggcgcgggcgcgggctggcggtgcgcgccgggccagcggcggcttgggaggggcgcgcgcgtggcggcgaggctggacgggggcgtcgggaagggggtgcccaccaccaactacgtcgtgccgctcgacaaggccaccgggatgacccgcccgctcgtcgagatcctcagggacctcaacaagcgcgtccccgacaagatcatcgaccccgacaccaacaccgtcccctggtaccatgccaacagaatgctgagcttctatgcaccaggttggtgtggtgaagttcgtgatgttatttattccaacagtggaactgtgaccgtggtctatcgagtgattctgaaaggaacagatggagaggctttcagagacgccacaggcacggcaaaggtgcacgagggacgcaacgatgacgctgtcgcggctgcggaggaggcagcattcagcaaggcctgcgcacggtttggtttcggcctgtacctgtaccaccaggatgagatcctgtaggggggacgtcacagctttgagattcattctgcaatggaagctggtcgtaacgtgggtaggcacgcccgtggagagttggaaatgcttcgctggtgcttaatgcttgtgcaagaagcttgtaaattgttccttctgttacgtttttgttgttgttgttgtcggtgtaggctcgcaagattcatccagctagagaaaggaaaaagaacatatggaataatgtgctgttacttctctggtgcattttctgccttatgtaatttttagagatttttttt

SEQ ID NO: 233 - DNA, 806 bp, Triticum aestivum
gacgcagccaacagcgccccctctgaaaaaaagagaacagcaacgggaataatctcctttcctcctcgtccgcgtgcgatcgacgcggaggcgccgcccgtccccctcccctccgctccgacccgacccgacccgaccccatggccttcatgcgcacctcctccaatgcatcctctggcatgggagttgctcctgatatcagggagacattcctggagcttcagatgaagaaggcatttcgctatgttatcttcaaaatcgaagaaaagcaaaaacaggttgttgtggagaagacaggggctacaactgagagttatgatgatttcctggcttgtctcccagaaaaagactgcagatatgccctttatgattttgactttgttactggggagaatgtgcagaaaagcaagattttcttcattgcctggtcccctgacacatcccgcatccgcgccaagatgctgtactccacctccaaggaccgcatcaagcaggagctcgacgggttccactacgagatccaggcaactgacccgaccgaggtggagctcggcgtcctccgtgaccgggcgcactagggcggatcgatgatcacccgtgggcttcagtcggatgcaaattcatgctgtccgtggtaatgctgttgccgcagtgttgttaataagacagatatatccaggtttcctgtaaaacgtaagagtatcattcagctgttatgcatggctctagctgatgaagtgttgtccgaggtctctctactcgtatgatgtcggagcctgtaaacgcaagaaacctccctgaaaaac

SEQ ID NO: 234 - DNA, 601 bp, Triticum aestivum
cgtcttttcagatcaggaaaaaaaaggagagatgaaggaggcgacggcgtcggggggcggcgcgacggcgacggcgaacgacccgaggcagccggcgacggcgaggccgtacgcgccgcccaagctgtcgtcgcaggacctgcccgtcgactacgcgggcttcctcgccgtcgtcttcggcgtcgtcggcgtcatgctccactacaaggtttgctcgtggatcgccatcatcttctgcgcgcagtcgctggcaaacatgaagaacttcgagaatgacctcaagcagctctccatggctttcatgtttgctgtcatgggtttggtgacgaactatttcgggcctcgcccaggcggcacaaagcgctgatctgcataccatgcgccgtatgaagtttcctgttcaatttttggtgcctcggagccactggcatggtggtgcccacccacatttctgaatccttgagtcaggcaggtgtcaaatgtaccacctcatttgtagggaccaagacatgtatcatgatgctcagtaatctatttgcacggtacctgctcttccagttttgttataaagatagttgaagggcctttgcctacatcacca

SEQ ID NO: 235 - DNA, 1150 bp, Triticum aestivum
ggatatttcgcccctgctttctgttctgcctgcctcccaacaatggctctccccctcgttcgcctcctcctcccgtcgctccacgcgtgccagccgccgctccgccaccctgagtactccgccccacctcgccacagccacgtttccttcgctgtccccgctgccgcccgctcctccggcaaccgcttggcgtttgctgtctgcgctgctagcgcctcggtcgccccggcgcctgcggaaactcaggcggatgcggaggatgagcagcccgtggggccgaagacgcggcttatcgcgatgaacatcccgtgggatttcacgcccgacgacattcgcgttcttttcgagaagcaaggcaccgtcgtcgacgtggagctttcgatgcacagttccaaaaaaaacagaggattggcatttgtaaccatgggttcagaagatgaggctctttcagcactcaagaatctcaatttgtctactttgaacgatagaacgattaaggtggactttgcaaaacctaaaaagaagcaacctgctgtgccgtcagctcctgtggagaaaaatgttgtgtttgtcgggaatttaacgtggagagtgagatcccgtcatcttcgggagttatttgcctcaaccccaggtgtccaatcagttgaagttatctttcataccaccacaccaaggcgatctgctggctatgcatttgtttccttttcctcgaaagaggaggcagaggctgctatttctaccttcaatggcaaggaattgatgggacgatccattaacgtgatgttcaaagaggacactgtcaaaaagaacaagtcttctgattcagaggaagagaagttggaggaggcagaatcttctgaggagagtgatagctaagaatggattattgtgagaaccacagaaagaagttcaatgagttgatctgcaggactataatgctcttttgctaggttaccaagctcctggttgatttcactcatcccataactcttgaattgtcaaacactgttctgtaagttctcctcttgatatggatcacatttggaggttagcttgatactagagtacatgaaatctgtgagctgttaaaatctgagttaatttattgtagaatataagtgttaatgatgaatttgagtgcaatcgg

SEQ ID NO: 236 - DNA, 2330 bp, Triticum aestivum
gcggccgcctgcaggaaaagtcttgcttgggggccgtccctccccgcaagcggagatcctcgccgggaggggatcccgcgtcgtccgccccggcgcggcggcctctcctgtccgcgtcctccacgcgttttcctggttccggcgagggagcggaggagaggagggagcgcgcctggatgagctgcttctcctgcttcggcccggccctggaggcggagggccgcaagccggtgcccgacgccaaggacccccgcaccaaggacggcgcggtctcggatcgcgccggatcagataaattgaggctgcagggtggatcagaccctaagaataatcatctaaccatccctcgcgatgggagcagccaaaacattgccgcacagattttcactttccgtgagcttgctgctgccactaagaacttcagacaagattgcatgttgggtgagggaggtttcggacgtgtatataaaggtcgcctagagagtgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccgaagctgtctgactttggccttgcaaaactcggtccagttggtgacaacactcatgtttcaacacgtgtgatgggaacttatggctactgtgccccagaatatgctatgactgggcagctcacagtgaaatcagatgtctatagctttggcgttgttttccttgaactgattacagggcgcaaagcaatcgacaacaccaaaccccagggggagcaaaacctggtggcatgggctcgcccactcttcaaggatcgcaggaagtttcctaagatggctgacccaatgcttcaaggccggttccctatgaggggtctgtatcaggctttagctgttgctgccatgtgtttgcaagagcaagccacaacccgtcctcatataggagatgttgtcactgctctctcatatctagcttctcagacatatgatccaaatgccccaactcaacatactcggagcaattcatcgacccctagggccagaaatgttggtgggcggaacagcgaacagcgcaacggacgctcaccaaatcatcattctcccaggacatcaaagcacggaggggaggtcagccggactagttctactggtggtgattctggccgtaggtcaggattggatgaaatggacatggcaggatcacaggcaggcagtccagctcagacaggaaggaagagagaaaccccaaggactgctgacaggcagcgcgccattgcggatgctaaaatgtggggggagaactccagagagcggaagcgaccgaacggcagctttgatagtacaaatgagtaaactggacagttctctttcacgacgtcactctagcagggggtcgacgagtttgctcatcagcaccagacgggccaggtttaggaacacggtctttgttccagctctgtcccgttgtctgtgaataaaggcttttcttgccatcagcactgcctcacggttgctttatctgtaagttgttgcagttgacatgccttctccgggcggcgtccattccttgcgaatgtgattgtgtcatgtactcgtctcctttagagctcaggagcctacaagatgcagctggaaatgtaggaaagggaactgcaagaccgtcgaagccgcagagctgcgtctgtcaggcccttcctttcattcttctgcagttacacgatgtcgacgagtacgcaccgctgcacctgtgttctggaactgattgcgcaaccgtgccaggcagtttcttctgatggatgagatttcaggtttggttgggggataggatagagattacccatgtttcgtacagccgctattgtttttgtgtcgagtcgcgggatcggtcatttatttgtattagcttcgacgtacttctgcttgtatcttagtgcgaacatggtttagcatgcagcaaaagtatcaggttattcagaatttcagtgcccatatgttattgttctccttttgttcctggaaaccatgttgttcatgtatatactgctatttttg

SEQ ID NO: 237 - DNA, 1233 bp, Triticum aestivum
gcggccgcctgcaggaaactccgtgctgacctgacgacccgtgggctctcccacctgcagcatctcttcttcatcttcggctcctctcccccgatctctcgcccgcgacctgctccgataccctgcgaagtacggactccggcgagcttacggggctcgcgcggcgagctcgcggccgcgatggacgaggcgggcacctcgtcgtccgcaggctccgccccgcgcggagggcgcccggcgagatcgggagtattctataagttcagccagcaggatcttccagcttggaaaccggcaatgacaccaggatacgtgatagccattttcttgataattgggattatttttgtaccgcttggactaatttgtcttcaagcttcaaacagagttgcagaaatcgttcaccgttatgatattgattgtgtacctaatgcttacagaagcaataagcaggcctatatcaaagacagctcgatttcgaaggaatgcattcagaaagtgaaggtacaataccacatgaaagctccaatttatgtgtattatgaactcgacaacttctaccagaatcatcgtaggtatatcaaaagtagaagcgacaagcaactacgctatgggctgaaatacactgatagctcatgcagtccaatagaaaagagcgacggccttccaattgttccctgtggattgattgcctggagcttgttcaatgatacttatgattttacccgtggatccatgggaatagtggttgatcggaaaaatatttcatggagaagtgatcgggagcataagtatggcaaggatgtctatcctttcaactttcagaatggatctttgattggaggaggaaaacttgaccctgatataccactaagcaatcaggaagatcttatcgtgtggatgcgcgcagctgctcttccccagtttcgaaagctgtatggtgtcatcgaagaggatatacaagctgatgaaatcattaccatgcacataacaaacaattacaatacctacagctttggtggaaagaaaagcctggttcttacaacatcaacctggctaggtggcaagaatgactttcttggatatgcataccttatcactggttcctcgagcattttcttgtcgattctctttgctctgatccatgtgaaaatcccaaggccacatggtgatgctgcttacctatcttggagcaggaaaaacggcaataactaagcttctgtgcatagtttt

SEQ ID NO: 238 - DNA, 2073 bp, Triticum aestivum
cgacacgagacgcggaccaacgcccagcacacgacacgccccccgccccgccgcggaccagcagcggcttccagagaaacccgccggagcgcgcggcttaatggcgctcgcgctatccacgctccccttcgccccctccaccccggcgcccgcctcgttccgcccccgcggggcccacttcgccccctcccccgccggcaggagcgtcggagtcggcctccccctcgcgtgcgcggcgccgcggaagaaccgcgggcggaggcggcgcggcgggggcctggtggtgttcgcggccgccgactactacgcgacgctcggcgtgcagcgctccgcgaccatcaaggacatcaaggccgcctaccggaagctcgcgcgccagtatcatcctgatgttaataaggaacctggagcaaccgacaagttcaaagagataagctcagcctatgaggttctgtcagatgataagaagagggcattgtatgaccaatatggtgaagccggggttaagagcgcggttgggggcaacgctggagcttatacatcgaatccatttgatctgtttgagacattcttcggagcaagcatgggtggtggtggtggcttttctggtatggaccagagcgcatttaggacacgcagaaggagcactgctgctcagggtgaagacatcagatatgatgtgattctagggttctcagaggcaatatttggaacagaaaaagatatcatattatcccatttggagacttgtgatgcttgtagcggttctggttcaaaggttggctcaaaggcaaaaatatgctccacatgtggtgggcgagggcaagtaatgcgaacggagcagacaccatttggtctcttttcccaggtttctatttgccccacttgtgtaggagagggtgaggtcatttcagagtattgcaggaaatgctctggagaggggcgtgttcgtgtcagaaaagagatcaaagtaaaaatccctccaggagttagtaaaggtagcactcttcgtgtacgtggtgaaggtgatgcaggaccgaaaggagggcctcctggagatctttttgtctgccttgatgtagaggagccatccgatattaaaagggatggtatcaacttgtattcaactgtgtcgataagctacattgaagctattttgggtacagttcaaaaggtcagaactgttgagggaagtagtgaacttcgaatacctccaggcacccaacctggtgatgtattggtcctagcgaagcaaggtgttccatcgttgaataggccatctatacgcggtgatcatctattcactgttaaggtctctatacccaaacgtataagtgggcgcgaaaaggagttgcttgaggaacttgcatcgttgaaaaatggtggttttgcccgtgcaccggtgaagccaaaacctgtacataaagagaatggaagccgcgctgctccagaagtatcagatcaacctgatgatggggagggtgactggttgaagaaactttctgattttgctggatccattgtcaatggggcatccaagtggctgaaagacaacctgtagcctgcaaatatttattgcacgacgcattctcttcaacaccagccatggtgttatccaatctgcaattcttcaattcatcgggattcgacgagctgttgcatgcatgtgttctgttgaagaggctcatcttttacggcctgtgggctgtgaagtggcaacgcagaggtttagtgtcaactaattttattgacgccgtttttatttgttttgagagggatatccttgtaaagcatgaattttgctgtagtcgcactcgtatttcctagagcatgtaacacggccgcagatattgaaatagatgaagctacatcctctgtaaatacatatatatctttttctggtagatcatctcagtacaacatcaggctgtgcaagtgaatattcttgttgcttcaaattcagaacaaacgggcacccgtgtcctcatccctcaagtgcaattttttgcaatagaacatgagatttcttgacagaatacaaattttcttttgcatattctgttcttgttcgtc

SEQ ID NO: 239 - DNA, 2125 bp, Triticum aestivum
ttgttcccatcgcatctcggcggcttcctaccccctcctcgccccgatctaactcgccggcggccatgtcgcagccggctgccgccgccgttgcggcgcagccgcaggggcaggccgcggctgggcggcagggaggcggcctgggccagagcctcgccggcatcgtgcggatggcggtgttctggtacttcgcgtccaagttcttcggccccaagcgcgcccccacggagccgggcttgctcatgtccaacctctttcagaagggagagccaatggatatgtggatgtatttatcggagaatgataaatttagcgactttggtaatgaggatgcactcatctggcatgaaacaaacataccatatgcagtctggacacctaccagtaccagaacacacacactgacatactatccaacggaggctctcaagcacaatggctctttgtatgctcatgtttatttttcccgttcgggttaccctgtggaccctaccgatcctgaatatgagcaaaaatctgcatttggaaggacacatcctattgtggcatacttgcggaaatcaaaagctggtcataagaagagcttgcttggagattcggatgagtccgaggaaaagctaccccctaaggagaacaaagagtccgaagacaaagaggagggcccagttgaatatatttcttattggaaaccaaatgtgacaataaatcttgttgatgacttcacacggtatccccaaaacaacattcctccaaatgttgctccatatttgaatgtggatccaactacaaacagctactatccaactgtattcttcaatgaattttggctgttgagggacaaattgacagcactcaacgagactgtgaaggaactgaccttgaaccttgaagttagtcctatcagcatgaccaagtggcaattatttctacagattgagcagtctttccaagttcatcgtagttacggaagtatgcttgaaggcgaggctgatgagctcaagagggttttccttgaaggaaatccatatctactgggattgaccatgattgtatctctgttccactctctgttcgatttcctggctttcaagaatgatatccagttctggaataaaaacaagtccatggaaggtctttcagcgaaatctgttgttctgaacttcatttgtcagctgattatatttctgtacctgcttgacaatgatacatcatggatgattcttgctagctctggagttggtgtgtgcattgaattctggaagataggaaaagcgatgcatgttgagattgacagaagtggaaagattcccatgttgagattccgggatcgtgagtcatatgcacagaataagaccaaggagtatgatgcgcttgcgatgaagtatcttacgtatgtccttctagtccttatggctggttttgctatctattcactcaagtatgataaacacaagagctggtactcgtggatactctcttccctcacaagttgtgtttacatgtttggtttcattatgatgtgcccacaattatttatcaactacaagctgaagtccgttgctcacatgccatggagacaaatgacctacaagttcctcaacactataattgatgatctgtttgcatttgtgattaagatgccgtggttgcatcgtctctcggttttcagagatgatgttatcttcttgatatacctctaccagaggtgggtatacccagttgacaagaagcgtgtcaacgagtttggctttggaggggaagacgaacccgcagcaccccaaactttggaaggagcagcggctgcccaacagatcgaggccaaggctgagacgagcacggaggacaagaagacaaagtgagcctccgcaagcttcaatcgacacagacacatctcggcagcactggccgttttggccaccgggcacaaattttctgtgtgccaaattcgacgctgaactcatcttcacgcgttgctgaccattaaaagaaggatatgtaacaggttcagattgggcgcgtggacacaatacacatagtcttgttgccattaccgtttatttgattttggtttgtttttttatgcttagcgacagcaatttctagatggatcttcaggattcttgtt

SEQ ID NO: 240 - DNA, 2152 bp, Triticum aestivum
ggagcggggtacacacgaggcgtcctcttgtggttgcgggggtttggtgggggtttgggggtctcgcctttcctggcggcgcatccacgcaccgatttcccctcctccctcctcctgcgattgcgggtccagattgatcgatccccggccggatttgctccgtcacatcactcgggatctcctcccctaacccctcctcatcgggcaggatttttttcctttctctctagggggctccgccccgcatctccccgctccgatcgatggcgtcgtcctgcatcccgacgggcatccggctgccggacctggacatggtcaaggcggcggcggtcggggcgtcgtcggcgccgggcgcgggggcggcgccgctgcggccggcgcactcctcggcgtcctcggcgctctccgacgcctccaactcctcctcggcctcctcgctctcgctcaagcgggcgcgcacgccgcggaagcgccccaaccagacctacaacgaggcggccgcgctgctcgcctccatgtacccctccgtcttccccgccggggacagggcgccgccgtcgccgaggctcctcggcctcgcctccgcgctcgccgacgacccctcccgcgcggacctgctcccgcccttccccgtcctcggcaacgccgcctgcctcctccgcgacgccgccgcgccgccgaccacgccgcggagccccgtcctcgccagggcctgcccgtcgccggcggccgtcagcagcgccttcaccgagttccgcgactccgcgccgtcccccgggacccctgacggcgccgccggcgcggacgggcccggggagctcgactatgaggatgatgacgacagctttgacgcagactctttcctcctcggcggcctcgacgagggcgccgccgccgaggggatcgatggcatcatgggcaaactcagtatggaaagcggcagcgatgcctcttccattaaccgtgtcctctccagctccggcatagacccctacatcagaaacctcatggtgctcggactcgggttccggcgctcccggtccaacatcaagcaggcgctcaagcggcatgacgatgacagcgaatggtggatgtgccctgccattccattgaaggacattatgccggcgcctcccccatcgatggaaccaccgccgccggtggagaagaagaagaagaagactaagaagaaggcgttgaaggacattgccgctgggccgtgcattacatgtgttaaggaggaaattcctgaccctgcttatggggatgatggaatttttggaccgaaggcgcccaagacaggattgggcctgagcctcaacactgaggaggtgctgaaggcgtggtatgacagaggctccgtgttcgctgacggcaacatacctgatgcatcatccactgatgggctggctaaactttcagacattgaactgtttctagagaatggtgctgctggtgctatcagggaaggcagcatacagaaattgaagcacaagcagaagcagtgcactcccctcctctcaaataagactcggtaccaagcacggaaggtgcacgccgagtctcgtcctcgggtcaaggggaggtttgtcagccaggcggctcttctgcagaaagccgcggagaaagagacctaggggaggacgttcttgctcccatgaacattctgtcttgggatttcatttcattccccctagaagtgaagcagatgagggcttcttttcttttctgcacttatgtgatcatgtagagagggtagagattgcctgtagagtggcttctttgtcaggggatagctgctggttagtttcccagctcagatgctgccggggcaaagaaggccgtaagccaaaaacatcgtaacaatggtacagtgctgtggcaatgaccaaagtgcttctgttactttgcttccgtcttatgctctgaaccctctgaaggaactgcaccgggtgctagttttgtacaaaactgaacctgcaaaatttgttaaacttcagggagcatttgattcgcaagaattctaaagcatgtgaatagaaagaaagaaaaagtaggattagaatgtcatgtatgaatcccttggtcctgcaatactcggaggaaaaagcaaggcaagatgtttgagaagtaggcattggcaatgttatgt

SEQ ID NO: 241 - DNA, 833 bp, Triticum aestivum
atcaaaccggcgccaagaaaaccagacaccatccggcgacgccatgaagcacctcctcctcccatccccgctccctctcctcctccacggccccgcctccaagccgctcctcctccacgtccggcagcgccaccgccacgccctgagcgccgcacccgacggcaactccggcgacacctccacggccgcgtccgagccgcctcccacgaacacccagcccagcccgccaccctccgcacctccgtccaccaactccggcaccaccagcgtcaagacccgcctccgttcaaggaaccaggcccgccgcgtccaggagccgtacctgcccccggtggaggtgaagatgatgcggggcaagggcaaggcgaacgcttccgcggcgccgaggagggagaaggagaagcggaagaagacgtgggacgagatgagcctcggcgagaaggcctacgagctgtacgtcggggagaagggggccctcttctggctcaacaagttcgcctacgcctccatcttcatcatagccggcgcctggatcctgttccgcttcgtcgggcccgccaccgggctgtaccagctcgacgcgccgccgctggcgcccacggacgtcctgcgcggctcctagtgagagcacgtacctaggtttctagatagatagcgcggcgggaaagataagggatggatggccggaaagaagattgatgaataattgctgcttacaatggcttcgatggtatgcttgtatgtgattattacgaaattatcgtagatggatgaatgtatgtccgtgtgtaatttgggaactaaagttttcaccctgaattcctgaacaattt

SEQ ID NO: 242 - DNA, 2046 bp, Triticum aestivum
agacccatccctgtcttctcccctgctctgctctgctgcggtgaggcgacaagaagcaggatgaggagcctgctgggggaggagcgcagcttcatcatcgagagcgacgacgacgacgaggaggatcccgctcacaggggcgacggcgttggccatggggatgatgggtcgtcgtcggactcgtcgtcgtgcgccaccccgcgcggcggcggcggcggcggcggggacagccagcccaactcctacaccaaccaatggccgcagagctacaggcaatcgatcgacattctgagcaacgtgcagtcgccgagcctggggttcctggggaccccgacgctgagccggctgtccaactccttcctcaacagctccttcctcaacaactcgttccgaggcaaaacccccgagatcgtctccaacctcgtcaagccgctcatacgccccacgacaagcgacgagcaacagcaacagcaacagcagcatgaggatatccggaagagctcgcagtacctcctgccgtcgaggaagccgtcgctgcagcagatccccgaggatcagaagccgctggtggttggtcatgaggtttctccctaccagcagtgctcttacacccagggagctatgaacggaataaatgttctgtgtggtgtcggaatcctgtcgacgccttatgccatcaagcaaggggggtggctgggactcgtgatactagatgtatttgctctgctcgcatggtacaccggtgtgctgctgcgccgttgcctagacagcaaggagggccttcagacgtacccggatatcggccatgctgcctttggaaccacgggtcgcatagccatctcgataattctgtatgtggaactgtatgcctgctgcatcgagtatttgatactggaaagcgacaatttatccaagttgtttcccaatgtacacctgagcattgggggcttgacgataaactcgcatgtgttcttcgcaatcttgacgacgcttgttgtcatgccgaccacctggctccgtgacctcacctgtctgagctatatttcagctggaggtgtggttgcatcaatccttgtggtcatctgcttatgctggattggggttgtcgatcatgtcggctttgagaacaaagggacggcgttaaacctcccgggaattcctatcgcgattggactgtacggttactgctactcgggacatggggtgttcccaaacatatactcttctctgaagaatcgcaaccagtttccttccattcttttcacctgcattgggttctctaccattttgtttactgccgccgcggtgatgggatacaaaatgttcggcgaagccaccgagtctcagttcaccctcaacttaccagagaatttggttgtttccaagattgccgtctgggctacggtggcaaatccaataaccaaatatgcattgaccataaccccactggccatgagtctggaagagttgctgccgcgaagccagcagaagtactccaacataattttgcttagatcagccctggtggtgtcaaccctcatcattgctctgtcagttcccttctttgcgcttgtgatggctctgattggttctttattcgcgatgcttgtgacctacattcttccttgcgcctgctttctggccatcctcaaggcaaaagcgacttggtatcagactgcgacatgctcattcatcatcgccgtaggggttacctgcgcctgcgtggggacatactcatccctctccgggattgtccagaactacgcaacctgattctccctacatacataattgagaagattgctcgttcaaccgcgttattatacatataattaagcatatgtatgagcgagagtggaggattcaaattttgccgaacaatgaattatgtccatcgatatataaatgttgtatgattaaatttgtattgctgttaaatttgtggcaaccccgataactttgcattattattgttaaatttgtgtgttgatggatctttatcagtataaagtcccagttcggctagctaattaccgactacttgaa

SEQ ID NO: 243 - DNA, 813 bp, Triticum aestivum
attggagtcggagaggagaggaaagcaggaggaggcgacagacaggtgcccgcccgcccgccggagatggcgatgaccgtggaagtgctcgctggacttgcgtgtatgttctccacgagtgttcttttgcaaatcctggcatgtgctttgtacaacaactggtggcctatgttagcagcactcatgtatatcattgtgccaatgccatgcctgttctttggcgacggatccacacggttcttgagtagcggagagggtggagcgtggatgaaagcagccaagttcctgaccggcatgtctgccatgggaagcctcgcaatcccggcgatcctgaggcacgctggcctgatcgagacgggggccatgttcatcgagttcacctccttcttcatcctcgtgtgcacggtactgtgcttccacagggccaccctggacgaggagtggtaaaggctcgcgcaggaccacaaggagtgcctgagagaagaatgcctgttaggatgtcgaaaagaaatcccttggtgggagggagctaacgtggaactgtgtgtacaaagaagcgtgcttcaagcgcttgactactgtatttacgtatacgcgtacccgagattcggtaatctagttggtaatccgtgctgaacaggtcgtgtaaagcatatgtgattcggcggcgttgatggacgcgaagcagtcttgctgtggttggtttgccacttgtgcatccagaatctgcacttggagcatggtacaaactattggatggaatgaagtgacaagattttgtttagatgttgcacctgaagccaaagttgctca

SEQ ID NO: 244 - DNA, 2733 bp, Triticum aestivum
gcggccgcctgcaggaaaacgaaccaacggaggcggcaaccggcaaggcatctccaccgccggcgtaatccgcggcgagaaatccagctagggtttccgcccccgttgacccgatgggcccgggcgcgccgtcgccggaggacgcggcgggcggggggccggaggcgtggtacgggagcatccagtacctcgtcaacatctcggcggtgggcgccgcctcctgcgtgctcctcttcctcctcgtcaagctccgcttcgaccaccgccgcatcccggggccctcagcgctcgccgccaagctgctcgccgtctaccacgccacggcgccgcagatcgcgctccactgcggcgccgacgccgcccagttcctcctcttcgagcgcgcctccttcctcgtcctcgccgccgtctccgccgccgccttcgcggccgccctcccgctcaacctgctcgccggggacgccgccatcgccgaccagttcgccgccaccaccatctcccacatccccagggcccccccgctgctctggctccacctcctcctcaccgccgccgtcgtcgccatcgcgcacctcggcatctcccgcatggaggacgccctccgcatcacccgcttccgcgacggcaacggcaaccccagcgaccccaactccagctccgtcaccgtcttcaccatcatgatccagggcatccccagggcgctcgccgccgacagggccccgctcaaggagtacttcgagcacaagtaccccggcaaggtgtaccgcgtcattgtgcccttcgacctctgcacgctcgagtacctcgccgacgagtgggggaaggtccggaacaagatctcctggctggaggcgaagatggacgcccgcagcctgtttgacgagtttgtgcaggatgaatcagggcagttggaagcccactggcttgtcaggagatgcaaagagctgtgggcaatggccgcgcagaggttcgggtttactgatgatgagaggctaaggaagctgcagacaaggaaactcgtgattgggagcaggctgtcggattacaaggaagggcgtgcgcctggtgctggcatagctttcattgtgttcaaggatgtgtacacggcaaacaaggctgtgagggatttccgaatggaaaggaagaagacacccattggcaggttcttcccagtgatggagctccagcttgagaggagccgatggagagtggagagggcgccaccagcatcagatatctactggaatcatcttgggatgaacaagacctcgctagccttgcggcggattgcggtcaacacctgcctcattgtaatgctcctgttcttcagttcgcccttgtcaatactcagtggaatgcaaaacgcagcacggatcatcaatgtggaggctatggataatgccaaatcatggattgtttggcttcaaggctcaagctggttctggacaataatctttcagtttctacccaatgtcctcatcttcgtgagcatgtatattatcatcccatcagtactgtcatacttctccaagtttgagttccatctgacagtgtcgggggagcagagagctgcattgctgaagatggtttgcttcttccttgttaatctcatcttgttgcgtgcgctggtggaatcgtcgcttgaaagttggattcttagcatgggacggtgctacttagatagtgctgattgcaagcagattgaacattacctgagcccatcattcttgtcgagatcttcactttcttccctggcgttcttaatcacatgcacctttctgggaatatcttttgatctgctggctccaatcccttggataaagcatatactgaagaaattcagaaagaatgatatggtccagttggtccctgaagaaaatgaggaatacagatctatgaacaatgacgaagaaacaaatggtctggtatcgcctctaatgtctgagagagaagacagtgacattctgaatggtttcgaggggcatgatctttccatgtacccaataaaccggagcttccacatgccaaagcagaaattcgactttgcacaatactatgcatttgacatcacaatattcgcgctcacgatgatctactcactgtttgctccgcttgtggttcctgtcggtgcagtatactttggctaccgttaccttgtggacaagtacaatttcctgttcgtgtacagagtcagaggatttcctgcaggcaatgatgggaagctgatggatagggtgctgtgcatcatgcaattctgtgtcatcttctttcttgctgctatgttgctcttcttcgcagtccagggtgattccatgaagctacaggctatatgtactcttgggctgttagtgttctataagttgctgccgtctggaagtgatcgcttccagccgtccttgttagaagggatgcagacagttaatagctttgtagatggtccaacggattatgaagttttttcacaacctgacctggattggaatctgtatcaatcctgaagaaaactcaagccatccttgttcatagagacgcagacagttaaatagctttgtagacagtccaacagattatggagttttttcacaacctgacctggattggaatctgtatcaatcctgaaggaaaaactcaaggtcattttaaagtcgcctagtatcactggagcttcacattgtacagctctcattcttttgtactgttatgtattaactctttttttttctaaaaaaaaaa

SEQ ID NO: 245 - DNA, 1086 bp, Oryza sativa
cacacacgtgagtctcctaccctccttcctcctccggtcgtagcggcggcgcccagcggccgcgccaccgcgtcgtccccccgccagctgcggcgcctcgcctggtccaccggcggaggggccgtgcggcgccccgcctctttcgcccgcggagaccggggaaagcgcagttccgttgctatcagcggccttcgcctctgccctgagtaggcggcggaaagcgcggtggctaaggactccaactgcagcggcgtgttccagaagtatcgcggaaactgacgccttcttccgggagcaactgagcaaagggttcttattaataccatggatcagaaacctaaggatgattttgatttccttgaaccatcagtactcttagatgagacacactatcaaacgggtttcaagaatggttatagtgagggcttggtgtctggaaaagaagagggaaggcaggttggtttaaagaatggttttcaggtaggtgaagaactaggtttttatcagggatgtctggatgtttggacgtcgttggtttcaattgatcaagatgcattctcagctcgggtcaggaaaaacattgagcaactagctgcactgttgagaagctatccgttgtcgaacccagaagacgagcaagttcaagatataatggagaagataagactgaaattcagggttatcacagcaagtttaggtacaaaactggagtatcaaggtcgccctacatcatccaagcaggatgttgaggatctgtaactagtttagctttcattgtcaaattaccatgttgaaatgatatatgagacccaaacatgtttatgtaggtttcggttaacgaatacttgttcgagtgaatgctgctatattactctgtttctaaacatcttatgaaggccaccgggatcacagtggagacctgaaagcctgtatctgagtatctatgtacactcaagttaatttgaggcagttctggactcatcttgtttttgatccttagtcctgctttacttaccacatatgagtacctccgtgacatttatcataattgaggtgtaatataatgtcttcacaaagaacttatca

SEQ ID NO: 246 - DNA, 1180 bp, Sorghum bicolor
agacaccgccgcatcatacctcgcagcgccgacgctctgctcgcgacggaggggaagtcccaggctcggcggcggcgtcagcggcttccccctcccgcctctcgccagtcgcctcgcgccctcgcctccgtcctccgcacaccggccggcgaccctgcgtacgcacctccctctcccctcccgccagctgcccagggtggccgggccttggctctgctggtggaactgggagcaggggccaagaagctgcaggctttctggaatcacgtttcttgagaactgtctgttgcatgcctaaactaggctcttgttcatattatggatcagcaacctaagattgaggttgattttcttgacccaacattactcttagatgagacacattaccaggagggatataaaaatggctataatgatggtttggcatctggaaaggaagagggaaggcaggttggtttaaagatgggtttccaagtcggtgaagaactgggtttctttcagggctgtctggatgtgtggacgtccgcaattctcattgatcagaacgccttctcagctcggctcaggaagaatattgagcagctagctgcactggtgagcagctatccgctgtctgatccggagaatgaacagattcaagacgtgatggagaagataaggctgaaattcagggccatcactgcaagcttaggcgtgaagttagagtatgaaggtcaccccacatcatcaaagcaggatgttgaggatctgtgagcgcgatggacattacattttagtttctctgtctttgctttcttaagctctccaaatcttgtcttcaacttattgggatcatgaggagctaccctgagacaacaacggtcagattcagatcataaatcacttgtatagttttaacgatgtcttaagttttgtcttattacctgctgcctgaggtctccatgtattgcccatgatcagtcattagggtttcaccagagatccactagtatacttgtgtaataattcccgtttagaacgcgaaagcattattatgaatggtattccttatcatttgtttgaagtactcgttgacttattgtatcctacatgttgggagcatatttatctccttgtaaaaacacacatcccatatattgcaaatctgcatagatctacttctcgtaagtatgtccatccc

SEQ ID NO: 247 - DNA, 2880 bp, Zea mays
gaaagaaatacctcttctccactccacctccgcgtccccaccttcagcgtcacgcacctcgacgcgcagcgcatggcgactcggctctcgtccacgggcccctgatctaggcagccggaccccgatcggttgcccgtgcagcgcgacccccacgaccaggatccagggagtcgggccacggtcctcggcaaggcatctcatcggcgaacgttttttcgaggccgggctcctgctcccccggaatctagggttcgcctcgccccgcgtcgccctcgatgggcccggccgcgcagccgccggacgccggcggcggtggggacccggaggcgtggtacggcagcatccagtacctcatcaacatctccgccgtgggggccgcctcctgcgtcctgctgttcctcctcgttaagctccggttcgaccaccgccgcatcccggggccctccgcgctcgccgccaagcttctcgccgtctaccacgccaccgcggcgcagatcgctctccactgcggcgccgacgccgctcagttcctcctcttcgagcgcgcctccttcctcatcctcgccgccgtcgccgctgccgccgtcgccgcggcgctcccgctcaacctcctcgcgggggacgccgccgtcgtcgaccagttcgcttccacgaccatctcgcacatccccaagtcgtccccgctcctctggctccacctcctcctcaccgccgccgtcgttgccatcgcgcacctcggcatctctcgcatggaggacgcgctacgcatcacgcgcttccgcgacggcaacggcaaccccagcgaccccaactccagctccgtcgccgtcttcaccataatgatccagggcatccccaagacgctggccgcggacaagaccccgctcaaggactacttcgaccacaagtaccctggcaaggtttaccgtgtcatcgtgccatttgatctatgcacgctggagcatctcgtcgagcaattggggaaggtccgtaacaagatctcttggctggaggcaaggttgggcgcccgcgacctgtttgatgacattgtgcacgataacgacgacacagtgcagtcagaagagcattggtttgtgcgaaggtgcagagggctgtgggcaatggcaggggagaggctagggttcactgacgaggagagattgaggaagttgcagactaagaaacttgtgctcgcaagcaggctatctgattataaggaagggtgcgcccctggcgctggtgtagcttttgtggtgtttaaagatgtctacaccgcaaacaaggcggtaaaggatttcaagatggagaggaagaagacaccgattggtaggtttttcccagtgatggagctccagctcgagagaagtcgatggaaagtggagagagcaccaccggcatcagatatctactggaatcatctaggtcttagcaagatatcttcacggctgaggaggattgcagtcaacacctgcctaattttgatgctcctgttcttcagttcacccttggcaatcatcagtgggatgcaaaacgcggcacgaatcatcaatgtggaggctatggatcatgccaaatcatggcttgcctggcttgaaggttcaagctggttctggaccataatctttcagtttcttcccaatgtgctcatctttgtgagcatgtatatcatcatcccgtcggtgttgtcgtacttctccaagtttgagtgtcatctgacagtgtcaggggagcagagggctgcattgctgaagatggtttgcttcttccttgtcaatctcatcctattgcgtgctcttgtggaatcatcacttgaaagttggatacttagcatggggcggtgctacttggatggtccagactgcaagcagattgaacgctatttaagcccatcctttttatcaagatcatcgctttcttccctggcattcctgatcacatgtacctttctgggaatatcttttgatctgttggcaccaatcccttggataaagcatataatgaagaaatttaggaagaatgatatggtccagttggtccctgaagagaatgaagactacctacccatgcagaatggtgaagaaactaataatttgacagcacctctaatgcctgagagagaagacggtggccttttggataatatcgaggggcatgatctttccctgtacccactaaacaggagcttccatatgccaaagcagaaatttgacttcgcacagtactatgcttttgacattactatatttgccctcacactgatctactccctgtttgctccgctcgtggttcctgtgggtgcgacatactttggctaccgttatctcgtggacaagtacaacttcttgttcgtttacagagttagagggtttcctgccggcaatgatgggaagctgatggacagagtgttgtgcatcatgcaattctgtgtgatcttcttccttgctgcaatgctgctcttctttgctgttcagggtgactcgatgaagctacaggctatatgtactcttgggatgttagtgttctataagttgcttccctctagaagcgatcgcttccagccatctttgttagaagggatgcagacagtgaatagctttgtagatggtcccacggattatgaagttttttcacaacctgacctggattggagtctgtatcaatcctgaagatcaatacacacttttgttcattacaatgacatctttcacgacttcgaacctggtgtatcaaagtcatttattcttcttgtacagctatgtagattaactcttgtcttcttagatatgtatttgttttgtcagatatgacaggcacatgcagttttggtgatgaacatggcctgtcaaaaaattactttaaatgatacatagtcattttctt

SEQ ID NO: 248 - DNA, 1851 bp, Zea mays
cctgccacgccacgggcagctcagctcagccagccgcacaagccccaaacagaaagagactcacccaccgcgccacgcaacagcccatctccgctctgctctctcgcccaccccgattcccccccatggctatggcgacgacggaggccaccacgctgacggcgctgctcaaggaggcggcggccgccttcccgacccgccgcgcagttgccgtaccgggcaggctggagctcacgcacgccgccctcgacgctctcgtcgacgcggcggccgcacgactcgccgccgacgccggagttctcccgggccacgtcgtcgcgctttccttccccaacaccgtcgagctggtgatcatgttcctggcggtaatccgcgcgcgcggcgtggcggcgccgctcaacccggcctacacgcaggaggagttcgagttctacctctccgactcggaggcgcgcctcctcgtcaccaacgcggagggcaacgcggcggcgcaggcggccgctgccaagctcggcctcgcccacgccgccgccagcctccacgacgcggccggccctgtccacctcgccggcctcccggcccatgctccggagaacgggtcccacggcggcggcgcggcgggctctctctcccccaacgacccgtcggacgtggccctgttcctgcacacctccggcacgacgagccggcccaagggcgtgccgctgaagcagcgcaacctggcggcgtcggtgcggaacatccggtccgtgtaccgcctcgccgagacggacgccacggtggtggtgctgccgctgttccacgtgcacgggctcctctgcgccctgctgagctcgctggcttcgggcgcgtccgtggcgctgccggcggcggggcggttctcggcgtccacgttctgggccgacatgcgggcgtcgggcgccacctggtacacggcggtgccgacgatccaccagatcatcctggaccggcacgcgtcgcggccggaggcgtacccggcgctccgattcatccgcagctgcagcgcgtcgctggcgccggcgatcctggagcggctggaggcggcgttcagcgcgccggtgctggaggcgtacgcgatgacggaggcgtcgcacctgatgacgtcaaacccgctgccggaggacgggccacggaagcccgggtcagtggggcgcgcggtggggcaggagctggcggtgctggacgaggaggggcggctcgtggcggcggggagccccggggaggtgtgcgtccgcggggacaacgtgacggcgggttacaaggggaacccagaggcgaacgaggcggcgttccggttcgggtggttccacacgggggacatcggcgtggtggatgaccaagggtacgtccggctggtggggcgcatcaaggagctcatcaaccgcggcggggagaagatctccccgatcgaggtggacgccgtgctgctaggcctccccggtgtggcgcaggcggtgtcgttcggggtgcctgacgacaagtacggggaggagatcaactgtgcggtgatcccgcgggacgggtcggcgctgcgggaggaggaggtgctggcgcactgccggcggaacctggcgtcgttcaaggtgcccaagaaggtgttcatcacggacgacctgcccaagacggccaccggaaagatccagcgccgcatcgtggcgcagcacttcgtgcagccgaccagtgcctgatcgttgatcctggtgcttgccaagtcatgggtcgacggattggaatttcgctacactagctagcattttgccgttgttcccgcattgcgaggtggacatggcctgactgaacctgaataaacaaacacatgcatcgtctctc

SEQ ID NO: 249 - DNA, 3385 bp, Zea mays
atttccaccacctcgcaccaggctccactcctctccttcccttccctccccctttcgctcccctcctcgctcgcctcgcttctcgccgagccacccgaccaattcccccgccccccgcgcgcccagatcgccgccattcccttccccgccctgccgcgacgatcccgctgccaccgcaccttctccctcccgtcgtcctcccctccccgcagctggcggtcggtcggtcggacggaggaagccacagccggcggccagagagcgccgcagcgtgcccgcggatgggctggtaggaggcggcggcggcggtgactgtgttagcggcggcggcggcagccatgtatttcgccaaactcgatgactcgcccatgttccggacgcagatacaatcacttgaggagagtgctgaattgctgagagagagatgtttgaagttccataaaggttgccgtaagtatactgaaggactaggggaagcatacgatggagatattgcatttgccagctcacttgaaacatttggaggaggccacaatgatccaatgagtgtcgcttttggtgggcctgtaatgaccaaatttacaattgccttaagagaaattggaacatacaaggaagtcctgcgctcccaggttgagcacatgttaaatgacagattactgaattttgttgacattgatttgcatgatgtgaaggatgctcataagcgctttgacaaggctagcctctcatatgaccagattcgtgaaaagtacctatcattgaagaaaggtacccgaccggacataacaacagcaattgaagatgagcttcacagtgctagatcttcatttgagcaagctcgtttcaacctggtcacttcactttcccatgtcgaggcaaagaagagatttgaatttttggaggctgttagtgcgacaatggattcacatcttcgttattttaaacaaggatatgaactattgcatcaaatggagccatatattaatcagattcttgcttatgcacagcaatcacgagaaagagcaaacaaggaacaagcttctctcgtagagaggatgcatgagtacaaaaggcagatagaccgggaaagtcggtcttctataaatggtttgaatgattcttataatggtgatcgaatgcagacaattggcagaagttcacataaacagatcgaggcagttatgcagtcaacttcaaaaggcaaggtagagaccatccgtcaaggttatctttcgaaaagatcttcaaacttgagagccgactggaaaagaaggttcttcgtacttgatagtcgaggaatgctgtactactatcgaaaacaaattactcggccacctgctggttgttccatgcaaagaaacgttaacccccctgaacatggttctgggttgttgagcagattgttctcttctcattaccatatacatgatgaaaagtctgtcgcacgtcatactgtaaatttgttgacatcgaccattaaagttgatgctgagcaatcagatttgaggttctgtttcagaattatttcacccacaaagatctacacattgcaggcagagagtgcagtagatcagatggactggattgaaaagataactggtgttattgcctctttactgagctcacaatcgccagaacagtgttttatgtcaagccctaagggcagtggtcatgataggagtaccagtgatggaagctcctttacaagttcagtggaatttgaaccttccgtaatcgatgatttagtactggagaagtactctggaaatgggcagcatgatgtaataagaggcacacatcatcacagaaccagcatgaaacctgaaaaaccaattgacttgcttaggaaagttgatggcaataatatgtgtgctgactgtggtgctttggaacctgattgggcatcattaaaccttggcgcacttctatgcatagagtgttctggggtgcaccgaaatcttggagtgcatatatcaaaggttagatctctgacacttgatgtcagagtttgggagccatcagtaatcaatctctttcagtcattaggcaacatgtttgtcaacaatatttgggaagacatgttgccagatgataattcaagtgctgatggatcagacacatcacagtacctctctgttagcaagcctaaacacaaagatgtattctctgccaaggagaagtttattcatgccaagtatgtagacaaagagtttatacggaagcgtagcatggatgagaatcaattagctgagcagatgtggaatagtgtagctgcaaatgacaagaaaacagcatacagtctcattgtgagatcacgtgccaatgtaaatttagtttacggagagatgccttctagcccatttttgactcttggaaaggcacttcagcaagagcaaccggtttcaccgcctgatggaagtcctaaatttttcgattgcaattcacatgacaagatttctcctcgggagcccctttcccctgctagcacgagttcacgcacagatgacatggaggacggttgcgaaggtctttccttgctccatcttgcatgccgtgttgcagacgttgggatggttgaattacttttgcagtatggtgctagtgtaaatatgaatgattctaggggtcggacaccccttcatcactgcattttgaaaggaagacatcggcatgcaaagcttctcctctccagaggggctgattcacaagccatggatcgagatggtaggacagcattgcagtatgcaatcgatggtggaacaagcgacgaagacattcttgcattgttagaggatcatagtagatgatcttgcaaccacaccttcagtaaattgaggttctcttggtgtggtcaactcaactaagaccttgttcggttagctctcaatccatgtggattgagtgtgattgggtgggttcaaatcccaaacaagtcaaagttcttctaatttttttccaatcctatccaatccatgtataatgggaataaccgaacaagacctaacagggatccagccccgctcggtcctagcttgtcgtgcagacaatccgaattcatggcatgaaagcaacctatgtacatgtcgttctagggcttcagtatcatgatgcgcatgttgtttctttccccgccgtttgcttgtttagcatcagtggtccttatttagtcatctggcaaacggtttggttttgtttgctgcaggtgatgcatagtaagcttgtaaatggagttgcttctcttaattttctagtcatcttttatcatgaagtagatgtggcattctaatgaaagatggttgtacatattgagatgtgctgttgtggcatatatgaaatattggcatggtgtggatggtatatacgaaagttgtgcttgcttaat

SEQ ID NO: 250 - DNA, 2210 bp, Setaria italica
gtattcattgcccgcccgccggcttgaatcgctgcccgttccggtgcgacctgcgactgctatatagcctcgcccgccctcacgtcgcagaccctcctgcactaccccctgcggtccatgtgacctcacttacttcacctgtcagcccccagcagccgcttcgcttagcttacctgctgctgccagctggatcggatcagcgtcggcccggcgatggaggcgggggcgtgggcggtggtcgcggcggccgtggccgtgtacctggcctggttctggcggatgtcgcgcgggctcagcgggccgcgggtgtggccgctggtcggctccctcccggggctcgtgcggcacgcggaggacatgcacgagtggatcgccgccaacctgcgccgcgccgggggcacgtaccagacctgcatcttcgccgtgcccggggtggcgcgcaggggcggcctcgtcaccgtcacctgcgatccccggaacctggagcacgtcctcaaggcccgcttcgacaactaccccaagggccccttctggcacggcgtgttccgggacctgctgggcgacggcatcttcaactccgacggggagacgtgggtggcgcagcgcaagacggccgcgctcgagttcaccacgcggacgctgcgcaccgccatgtcgcgctgggtgtcgcgatccatccacggccggctcctgcccatcctgggggacgccaccgcggacggcaggagcgtcgacctccaggacctcctgctccgcctcacgttcgacaacatctgcggcctcgcgttcgggaaggatcccgagacgctcgcgaggggcctgccggagaacgacttcgcctcggccttcgaccgcgccacggaggccacgctcaaccgcttcatcttcccggaatgcgtgtggaggtgcaagaagtggctgggcctcggcatggagaccacgctggcgcgcagcgtccaccacgtcgaccgctacctgtccgccgtcatcaaggcgcgcaagctcgagctcaccggcggcaagaagggcggagacgcccccgccccggccgccacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctcgtctccacgcaccccgccgtggagcgcaagatcgtgcgcgagctctgcgccgtcctggccgcatcccgcggcgccgacgacccggcgctgtggctcgccgcgcccttcgacttcgaggagctcgaccgtctcgtctacctcaaggccgcgctctcggagacgctccgcctgtacccgtccgtgcccgaggactccaagcacgtcgtcgccgacgacgtcctccccgacggcacgttcgtgccggcgggttcgtcgatcacctactccatctactcggcggggcgcatgaagacggtgtggggcgaggactgcctcgagttccgcccggagcggtggctgtcggccgacggcgccaggttcgagccgcacgattcgtacaggttcgtggcgttcaacgccggcccgcggatatgcctgggcaaggacctcgcgtacctgcagatgaagaacatcgccggcagcgtgctcctccgccaccgcctcgccgtggcgccgggccaccgcgtggagcagaagatgtcgctcaccctgttcatgaagcacgggctccggatggaggtgcgcccgcgcgacctcggccccgtcgtcgacgagctccgcgccgccggggagtacgacgcggcggccagggccaccgcggcctgcgcgtagaatgatcgatcgatgcatcaccccgccggcgaatgcatgctccgagaggatcgtgtcagactgggatggaaggaaggaacagttggaaaaagcgcaaatgaaaagttatgtagatagacagtaagtaattaaaggggttggtgagttacattactccatttcgaacaaaaaaatgcatgtgtaaaaagtccatatcgttttgatttggatttgaagaagaaacaaaaagagccggagagcaataatctctgatgtaacctgacgcggcggtggcgccaaaattcgtttgggcggcttgtgttaatgggccgccaaaactgttgttgctttgtaaaacaaacaggagcatggcatcaatcaatcgatca

SEQ ID NO: 251 - DNA, 2039 bp, Zea mays
aggaacaaaacgactggctgtccgaacggggacgcctggttcctctcattccccttccacctctctctttctttccactactcgccctctctctcttgcgcgcgcgtgacaacatccctccacgggcgcgcggcgcgggagcacccaccgacttatcgccggtggggcggggcgggggcgatctgatgccggcgcggcggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaacttctcctggccatcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaagccatcctcggtgtcttcgttcatgctgcctcccctcccctcccctcccattcttgacgagtaattaaatgcaacaacatctgagaatccgaagctgtacaggtcttttgcctcatctttgagctttacataccggagcttgcttcaacatgtattgcatccaggcatgaaaaagttcttgccggttcgggatgctcatttgcccccataaaaacgggaacaaacctaccttatttaaacatatgtatgaaactcactcacctctggacattcaaacccattcgagtaatggtcccggtgttgtagtttatagagctgtgtttcagtggacaaacctttgcgaaactgactggggatgcgcaagcatagcctcctttattaattattatctcgtttttttcctagcatctctcttttcataagggcaacccaaagtgttggaataatagattgccaccataatgctctgtattacccaccatatttaaacctggttacttgtgag

SEQ ID NO: 252 - DNA, 1018 bp, Zea mays
atttgcctatttccggtgcaggcagtctggcagagcaggcaggcaactgggccagagtcagacaggcctgcccgccacgccgtcccgacggccatggcccgacccttctcttccccacacatcccgtcttcatcctgggtgactcgccgccctcctccctggacctcctcaccgtccgtctccaccacgagaactagcgcctcgtctattaccgcgtgcagaccgcgccgcagggcagtcgcgccggcggcctccctccacctcggcccgggggagatcgccgagctcgcgcgcaacaaggttttgattgcggcgacagtggcgagcgcgatcgggcagctgtccaagcccttcacctcggtcaagaatgggggcgtcggcgccggccttgacctcagaaccgtcttccgctccggagggatgccctccacccactccgcgagcgttgttgcagttgctacttcgcttgggctagaaagggggtttgcagactccatatttggaatgtcagtggtgtttgcagcaattgtaatgtatgatgctcagggagtaagaagagaagtgggcaaccacgccaaggtcttgaacaggttttggatcctcaaagagaaggcacctctggagtattctgaagtggacatggcagctcctgagtttgtttcggtctccgaggaagcgagctccaatgcgagcccctccttgaagcgcggttgtagcaccgaatcaccaagggtgaatgggctccgtgggtctgagctgactgagctgaagcaggcttacgtagaggaggattaccggttgagtgaatctgttggccacacggagcttcaggtcacagtcggcgccctgttgggttttgctgtaagcttagcagtgtatgcaacactgtaagagcaattttcatatcacgtcccttgattggttacacatttacacctttttttttacacagaaacaatacatgcggtttattgttcccaccgtttaaatcagaaatgcctatgctagctcgtttcac

SEQ ID NO: 253 - DNA, 880 bp, Zea mays
aaaaatacaaatgccctagagctagcttcggagattggccaaagtccatcataatccactgccggatcgagaggagacccgagacccctagaaagaagaccagcaagcaggtcgcgcgagcccaatagaccaccaagggagatgtgcgcgcggccggctactagtgagatgtgcctccatcatagcacaccatgtgatgcgggaggagcctgctgttccgcctctcatccccctacttcttccaagatgcaatcatgctgccccaagctcctcgggccctcggccgccatgattgcctcaccgcctctcaagagtcgcctccacctacttccaagaggaagaggccggagaagctatagtccgtgaagaaatcaagcggaggggcggcggtgtaggaggggccggcggaggagagagagggccgggggaggtgacagaaagctagagagagagatgcatgatggagcatgatgatggcgtggttgatctcttcgatctagcacttctatcattcgagtcaagaagccatcatcagatcggtgcagtcctccctcctcctcctcctcctcctccttccagctcctctttatcagcttctctgtaacgctgcgccgccatggctttgggggaatcaagcgccttggtccgaagaaatccgtcttcttttcctagctaggatctacgtacttgtgcaagagtatgtcatgcatgctacgctatatgttattcctacatgttcttggtcgatctgtcgctacatatggtttgtgcagacatcaatactcgtctgtctttgattgatttgttttgacaccactctttgatccggagtttggttcatgtaatactatttcattagatatgtggatttcttctttga

SEQ ID NO: 254 - DNA, 140 bp, Zea mays
ggctggttgcttggacatgtctatctggcttcttccctttcttttttaccacataaagactcgttcggttagctctcaatccatatagattaagtgagattgagtatgtttaaattccaaacaagtcaaacttcttctta

SEQ ID NO: 255 - DNA, 661 bp, Zea mays
ctctttccatgcctagccgcgcgccattcatcgctaccgcggggtctctagtcctcgccgcgtggtataccttccccgcgcgcagattgaggtgggggcatccgccaccgccgagctctggagccccagctcgagctcttcatcgccatgccgcgctgggcacggccatgaatttgccggggcggagccgtgctcgacgaacgctgatggctgggggttgccgccgtgggtgtcgcgtgtgcacatcatcgcgggattcgctgtgcgtagtccagggccgctctggagcgcatatgaccggaggatggctccaaatcttcgttggggtcatcgggggaatccggaatcgctcgacatggcaaagtccgccgcccccgtccactttcaaacatggctagacacattcaacgtcttcaccatcgcgcgaggacacgtgtcatctgaaaagcaagttggtacctggaatctcaagtgccaggagatgatcaggtggttcaggaggagccgcctaacactgaggagttcgatctgatctaggtggcgtgtctcggtcgacattggcgccgacgatccttagttcgttttatatttatctcttattttgtaataagtcttccgctatgtaataaatactctgatgatttatgacatttatctctaa

SEQ ID NO: 256 - DNA, 1398 bp, Sorghum bicolor
ggatgcagtggagtgtgctgcggtgcggagatgagcgggcgcgcgggcactcgcccccaaatcccagcctcctctgagtctccttcccatccctctcgcccatggcggtgggcggccatgttgcggctctttctctgcaccgcgaccttgccgtgctctgggcgccctgtccgtgccagcagcttcataaggccggtgccaggaggtgcgcggcggcggggccgcggccacctcatggtggtgtaggctggcgggccacctagcaccaaccagctaatcctcgccttcatgctcccactccccctcttcatcggcacgctcgtcatcgccgcccgcgttaccgccgacatcgaggaccgattcctaagggagttatgaagatgggcaggagaggatgaacctggggttgccgatggacctaaggactggtaccgttgggtgagtctacttgctcagatcttgcggcacctgcaccagcgttcttttgtacaacagatcaaggtggaactatgtaaagcagatgcagtcgcaggctctacaaggacttctctggcatgtcgacacccaccacgaatcgttgttgatccgacacccactagtgaattgttgttgatccagtgagtcgggcggcgctttggctacaattgatcgatgaagatagaatcaggtgtggaactgtggaagaacccattgaaaaaaaaaaacctaaaaagaggagagaatatggatctcaccagagttcttagcgtggaggggatggctagactggtcagtttttgctatttcctgaccgtcaggcgccagtagaagctgttggtggccgtgtgatgatcgaagaccagacggcgcaggtcctgctcgggctggggaggtggcttggaaccgatgcgaaacttgtttagtatttcctcgcagagcaagaggagaggaggcagcatgaatttctgttgatcgtgatctggtgacgctgtgaagagggatcatggcgctgagcgatccagctccctgggaaacaaagtggagccacacggacgcagcccaacatggtcagtagctagggttgcaaagcagcggcgagggtcgagagacctgaggtggccgaaggaggcactggtagcgagaggcgcgacggctgcgtgaacgtgattcctatcaatcacgatatgttgcttgatttgttggaccaggtctggcgagggcgtcgggcgagggcgaggccgactccaggacgacgcacgagattgtgttttgtttccttattatctgtgaccataatttttgctacgtaggattggaaagtgttacggtgatgaaattttatatcaggaatcctttatttttctttatttcatttcgtacccttccacaatatattattccctatcgtaaatttacatc

SEQ ID NO: 257 - DNA, 1700 bp, Sorghum bicolor
atgaagagttaattaatgcttgttttttggtggaggcactccagatggatgattctatgtgcctccatttttatttttatgcgctccgggccatggcactcatgaggcggtccagtgtatgacacaatccaccagctacacatgcgaggtgataatattttcttgttgttgtttgatgaactgatatgtgctgcttacttgtttctaggtaagttcctgcgttcttctctgtagatcccaatttcaaaccaatttccattccttttctattctgactattccactctaggagaattaattaatcattgcttgaactggagcagcaagaataagaggaagaagagagacacctggatgcatagaaattaaaatcttattttaggatgcataaaaattaaaatgttaattttttatgaatagaaatagacttctttttcatgtaagcttgaggctttcttctatgcttaaccttgatacagtatgaacaaaattggaaaattattttttgggtgtatagaaattgaattctacttggatgcatagaaacttttcggatgtatttaaaatgttcagatctagtcttgactctatgaaatttgattgcttgtatttttttagacttggaacacagggcttggcccacctcattggctccgacatgatgcctctgtgatgacttctgtgactagttctatatttttttattttttacttggttactatggtttcatgcctaattgtgtatgcatgatgaaattgtgttttcatacctgataaaaaactagtatcatgtttctacgcactactcagtgatttattggaagcattctagcattgctggctgcagagggtgctcaacatttccacttctgtgatttattttttatattttttctatacatgttgtatgattatcctcagtctttctatgcgtatactcaaaactttctctgatttgttactactatttttatacattgtttggagcacattttatacattttgttgttggttgggtgttaagatttttgcatgctgatccaaaggaaagataatagttcttatatttgcatgtatagattttgatgcatggtgaaactgtgattatgcttagttgtatttgtttccaccctaattgatttcaaattctaaattttgaagaagtctttatacattgtggagcagtcttctatgcactgttagaacaattcgacatatattgtttgaataattatctctatgtacctacgtagccttggatttttagttcacatgcattgtggagcacttttctatgcattgttagaataattatctgcgcacaattcttctatgcttagttgtatgggttttatctgatttttggttgcagccttggatgaataggtggtttgcatgaaatgaaaagctatcaacgcaaaaccattctggtggcaagtccatgcatgatgcaatctatggccgcggtgctggtagttcacggtggcggcgctaatgcgaatcagcggtggtggtcggttggatggaagatagcaaaggagcagcgcgacacgaccaaggatttttgcattttgtttgttgaatttggtgttcttatgcttgtgtgcataagtttctatacacacaatagagcacttctatgcacttttgtatttttaatgcttgtgagcataagtttctatacattgttggagtaggtc

SEQ ID NO: 258 - DNA, 5340 bp, Sorghum bicolor
tcgcgctctggttttcctctcttcgcgtcggtgttcaaccaagcgcctcgcctatcccgtcccatctggccgccttcgtcgcatcgccgcgtttgcgttttccatctcttcgttttcttctatgcttttcgattcgatttcgatttcgaaccggatcgtttcttctccggttgattgatttgtttcgctgctactgcgcttccgtgctctcgcagattccctggggcgtttcgctttcgtgcgacgcggggagcgaacctgagtttgatttggcggggttgttcggttaatcggtttgcggattattctttcctgcgattccgtctagctttcgtgtcgatcctgtttcgtcctctccttctcagcgtgtgggttgcaggattggattgggtccgattggggtcatatggcgtcgtgtgtggcgaggagatggaggcaggtcagtcttctgtcagatccggcgattcactatttttgtcacttggacatggattcagtggtttcaggctcaaaaattgtctgccggtgtggtaccatcagatagtggcggcgtcgtagcctggacacgaggtggattcgaaacctttggtccattcttattttaacggctgatctcggttgtggccttttgggtgtttgtcctccatttactttagagaagatgcagataaggaagtgtccttgctggttatggagagatcagttgatgggtggaggtttgcttatggttcagtcctcgttttttatttggtatatggctgttttgttgtcatcatggtggtgtgaagattgccaccggactaattagattagaagcttgattggaaaaatgttgttagctggatctgcagaggcaacagaggtgatgttttggaggtagattgaggcgttgactggactggatttcctagcatcgggagaagatcgtttggatatatctacctattgttcttctattgattcatcatcatactcttaaatttgtgtccgttgcaattcttttcttatattggggctggtggttttgtccagcagtttgaggaggcgagtcagcaactcgattatatggaaggatgggttggaggcgagttcgatcctgcttctgcttgtgcagtcagaagttcggaactgtccagggttccctgtgtttgttcaccaaccgtcctctcacccttgccaatgttctttgaaaattgaccttcctcataggctgcctttgaccttcattagtaaatctgcagttttggaaaacagtttgtcctcctagatgcaaaaggaaaggtccttgctggttatggagagattagttgaagggtggaggtttgcttatgttcgttgttttttattttgttatacatatatggctattttgatgtcaatcatatggtggtgtgaagattgccaccagactaattagaagcttcattgtccataattggaaaaactctgttagctggatttgcagaggcaactaaggtggtggtttggaggtagattgaagatctgactggactcagagttcatagcatctggagaagatctgtttggatatatctacctctcactttctattgatactcttaaattccttgtttcttatccatttgggctggtggttttctcctggatgatatggatggattggagcctgagtttgattctgcttctgcatgagcaataggaagttctgaactgtccagattccctgtgtttgttcaataacagtcctctcctgtcgatgttctttgaaaactgaattttctcgtaggctacctttgatgcttcgatactaaaactgcagttttgggaggcatcgccacagagataggaattgcatctgaaattgtcggcgattgatcaggctatcctatccccacattatttgatgaatgttcatgctgttttagtgttctcatctcactatcaaatagatactcacgagagggggtggtctcgctgattgcagatctctaggtgatgcttgcacgggcacaaaaggaaccagtctcttcatatactcaaacctacaaccttgaactctcaactctcattgtgtttgttcagtgtcttctacctcaaagtagataatgatcggggtcgttgttgcaagtcttctgatattttttgcatgggcttgtcacgtggaatatgtgttgggagtacttctaaccttatcaaatttacaaaatgctatgaatcatgatacttctattgagttaaaatccggatacttctaattccatctgcagtggtagaaggtactgggcatgtttgggacttgggagattcaagcagagatgggtagaactacagcactacagctttcatttaatcaaacttgtttctgctttatcatgctatgctttgaccgaaactttaattcttgtgctgctggcatttctgtgtttcacagatcaattagctgaagtagtaattggtagtccaacagtcaaaatgtttggtttgggatttctatctgtggatgctttgtctggctttatatgtttttgtgctcgcttttacatgtggttgcaggatgagtttggcaattggaaattcctgtagcaaagaactgaaatttgaaactgggggcaggtcagagtctagagcacgatcattccggttttgttagtttcgtcacttgttctcagtgatttcagatctaaatggttggataacattctggctctccatggatatcactgatagtaaaacaaggtttgagaccctggatttattcggtactgtatatagctcaaattggttgtggtgtgtgttcgtgtcctttagagatgcaggaggacattggaggtggactttcctcaattggagataacaaattgggaaaaaaattgtgacacttgacctttcacttctcacttttgtttatttggtctgcaattgtgttcatctgttttgattatatttccagccacttaaactttaaaaggatggtaggatgcctaggaattccttttgtgctgcaacaatctaaattacaaggaggcttctaattcttcatttctatcaacagtcctatccagttacttccttcaaccagtaactctttcaagtttctgcagatgtgacacacagaagctgagatagaatttccaaccatagttgctgtctccaaagcccatccctgttccactggccatttgttccgccttggatttgaaagtttttgaagcctatccctgaaccaaaatagacaggaatcgtagatgggctctttggtaaatgtagattctgcacttacaaatttgcaagttcaatctgatcctgatcgtaatatgtgcctgtccttcgaactctgctaccttcacttctgcactgaccagggaacttccggactgacctgctgtttggatgctctgcgctagttagatgattcacatgatcacaaccaagacaatgctctgcccagagtttgcgccaactactattatgattattgactgcacatcactttccagttcacttgtttgatttggattggtggttttcttggtttccagttctttgagagcgttaatgcttggaatcttggatgttaggagtgatggggcacaccttacaatattcttccatctaaccagagttgacacctaatactctttgctcatactggtcctttattttggatccagttgtctgatttaagttgatggatgtttggttggattcccgcagttggagctaaggtgtggatgggatggttaggccttctgagttctagacgtttccacctatggagtcttccttccagtgataaataatcctttgcataaactttattttgaagctgcccttaacccacatgcctcaactgatggtgcaggtccactatttgtgttgatttccaatccaatctgctgtttgtgacattggtcctccctttttttgaacttcgttctgcaatttcctcactttgggcttccatctggtgcatctgctgtggatcaaaaccgagaaaggatgttgctccttttgttcctcccaaagaaaatctgtctgaacaaacttgtttggttgctcatgactatgccagcttatatgcccatcttggtgacgcagtgcaagcttctctgtactttggatggaactggagtcttctgtttgcttgctgtttggccatttctgtcatggactagcagcttacatacatggattttcaatttcacattcggtttcacaagtttgggttgaagttgagtcatcctggttcagattattcaggctgttgcattgatatgcagtgtttgaagtggaagatctttaggattggagtgtagcaacaaaaactcggtggaagcttcagtgcttgcctaaattcattacgactgggtttcttgaccttaaatgattagtgaactggttggttccatttgtcacctgtacatgttggtgtttggtcaacttgaatgcaagctaggctggaattggttctgtttgtgtagaatctccaaattagtatggttcatcttgttatgtggtggtttagtagttagtttaacttcgcactaggattggtttgatttggttaggttggaaacccaactgcctgccttgcaaagtggtacaagcaacataggccatggcaatagtatcgtaacatctaatgtaccatgtttgtgtagtatctgcatttattggagctgacagctgagaaatggggatgctaaaatgaagaatatcagtttaatcaaattattagccaaagaaaccatattttttacttggatttctggttatcaaataataatatatggaatttgggagaaaacttggtacttctactagtgaacttgagctggcacctgtgtttccctatcagcggtcggatatctcaactgtaagattgcacgcgtgctggctgtttttttggttgtgcactttgactttattggacaagattaactggaagcatgtgatgttttacaattggcacacgttgaatgttcggagtcctgagactaaataaactactagatgcaaactccacatatttgaactaggtttatttacttgttgattgttgatttttgacttattgattgttcccactaaatgttttgttggtttttttcaaagggtcttccttccttgtttgttgttttgcacgattaacttgtcataacacatgtgctcaatgctcattcataagctatgccttgtttatatgctgaaagaatagctactttgtttggcgcacaaaccggtggcatgatttgtttaaattttttcaaataatgtctgaaaacatgattttttttcctggctattatttgtgtttccttgattgttttgtttgtttgtttgtttgcggtttaacac

SEQ ID NO: 259 - DNA, 812 bp, Sorghum bicolor
aaatttcgtttttcctcagtcttcactccccagcctaactcaggaacgcgccgctgctggcctgccgctcccccatcgaccctaccgtcgtaccgccatggccacggtgccctgttccacccacagagacatctccatgccactcctctcgtgtgtcctagttgtgctacaggcactgctgccgtcgcgggaagcgagccccgccgtcgtcgcgcagctgtctgcaggcgccgccaccgcgccgtcgcagggcgccgccggcaacgggggagatagtgcagccgcttcctgctgcttttccatgcgagcgagttgagggcagccgcacgcaccgacgcacaggctcgtgaagtcccgatccgttctgaacacatgtatctgaaggagaaagaagacggcgcccaacgcctctgctccaaagcaggcaccacagaagcagaattgtcctgctggctgtgatccgaaatgccagtttgaagtgttctagagccagatccactggtacgcacggttcacctccctgttccctgtttcacccaccgatctggaacatttggtgatacattgtgttgctgaaacttgacatattctgctgctgcaacttgatgaactatgctactgcaacttcatatatggatgctgctgctgcaacttcatgcaattttgggaacctgtaatttgttggtggcttatgtgccatggtgcattgcacgatgtggtgctttatgtaactttgtatctcatcttatgagaataaacttgagatcttatggtgctggattgagttcttatataaataaaattgaattgtt

SEQ ID NO: 260 - DNA, 2634 bp, Sorghum bicolor
agggaagcactcactcgtttgttcggcggcggcggcactccaggccttggtcgctcactcctcaactcccgtccctagcccctatgcctgtggtgatcaagttggggctggtggccctggtcccctcgccgcatctgctcgcccctccctgcatcctatcgcggcgcggcggatccgatgcgatgtcccaaggaaggacggccaagttgagctctcgcgttcggttgtgaaggagacatatcgtcgctggtaggatggaggggagcctccttgcgcgactccatctgggcgcctcgccgtaggtggcgtccctgaggacgacgaaggcgttctcgccgtccgctgaggcagccggagccagatcctcctgttgccgttgcatcgtttgaggagcagatgatatctgtcagccaacaagagagctactatttgaagagtcacactggcacagaagttcattccagtatacatgggaagtgcattcagaaataagttggacacattgaagagggaatatctgtccaagaagtatgattgtttgtggcccatctttatttttggtggaagtgggaatatctgtcaaagaacctgtccaagaagcatggttgtttgtggttcatctttgtttttggtggctggacacatcgaagcgtgaatatctgtaaaagaaccatgggttctctaaggcgattgaatatttggtttgtgctctacgcttgaactttttgttttctgttttcagttgcctctatgtcaccttcattgccgacatcttgacctccagtgtgtacatcttgatggaaggggacgtggcagcgacgctggcttactggcctgcgcgtggcagtgataaagacgctagctctctggccggctggcctgcctggccggggacgtggcggcgaggctggctcgctagctggtgctggcttatctcgcagggaacgtggcggcgagactggctcgccgcgacgctggctcgctggctggcgctgggacgtggcggcgaggctggctctctagccggcgctggcctgtctcgcagggaacgtggcggcgagactggctcgctagccggcgctggccctagctcgcgtcgcaagaggcggactcgcagcgtcgcaagaggtttttttatgttttttttactttgatctctctagggctgtttatataaaatatttgtagaccaatttggatttggacatctatatattatattatatagcagattggcagtcctatttgggtttggacatctatattatagctattgtaaaatgtaacgtaacctatacggatgtaacgtaacctatacgtgtagaccaatttggattagcagattggcagtcctatttggatttggaaaatgaaacgtaacctatacggatgtaacgtaacatatacggactgcagactggagattgtggctatttaacctatacggatgtaacgtaaggactgcagactggagattgtggctattacgtggagtacagactggagattgtggctattatggactgtagattggcagaaaaaaaaagggcagactgaaattttggctctttattagtaggtatagatatgttgtacaactccctgacgtgtttttatttttttgctattcaggagcctagagtctttgtcttcaagttgtacctacatccagcatgtattttcactagctactatcaactgatgaaaaacatttatgataatttgaagaaagatgaagaactagttaatggaaaactagtcacaccaaagtctggggtcttcttagttcagttagtgccagagaaggaagatgaattgccactcacttttccttttggatgtagtgatttgtacatggagggctaccattacaacaggctacaagagctcagatcgggacctttggcaacacctacagttggaatctcagaagctttgcgcttcaatgttcaacagagattggtaaagcatgcactctattctggtaagaaaatctatatcactgaaaaaatcttcaattatttcaatgtgtgggggactttgtctattgcaatgtatactgaagtggtcccaaaagagtgtcttcttagcttgacacagattagcaataaattatgggtgataaagcgccacctttaatttgcaagaaggtaattagtcctcctctctctttgtgtcgtctttgttttgcttaatattagcacttatatgtctttataattaaatgcataatttccctttcagtcatagaaaatggaaaagaaaatgaaaaactagtcgcatccttaatcgaatggcagaaaaaagccgagaagagaattgtcgaagctgtttgcaatgttggtgatacaagtaacacaatggagtatgttgttttattttcagatttagttacacccacggccacggcgacacggcgttgtagctctatgaactgatctactctccaccctgtgttttcccgccctggtatatcaagagtttattttgttttatgcttttagctcgctctgctttcgaaaaaatgataagttttcgaacacataaagagatactcctagcaaaaatattctactcttttatgagctgctattagtagaccaatcacaagtttgtttagtttctcccaaaaag

SEQ ID NO: 261 - DNA, 2209 bp, Sorghum bicolor
acgaagacaaaggcagtcccgttcgcccgcctgccatccgccattcctcccaatgaaccccgaagcgcctttcgattcgctcgctgacggccccttcgccatgcccatagatgccaatttatttaattggctcgccgacgaccccttccccatgcattaacgtgccgcatgacttggtgtggactgaggtcgctcggaagatggcagcgcgtggcttcaaccgcagcaaggaagactgcaagaaaagaacgtaaaggagattaccaaggaaaaactgttcagaattagagttaactctctttatcaggttgtgccgcacatcacagagggcagcaagatatgaacaacaatttcatatggcggagggagatggattaggagaaggagcaaaccaatttggtgatggagacaattttttcatataaaagtcagcctgccagatcattggggagagttaaattgctgcttcgtcatcattctattgtgattcttagattctcaattgaatccgtacaatgcctgcttttccatgatgctcattgggttatatatgatgcttatcggatatcgctaaggatagacagaaatgagcaagtgggcgttcttgatagacttgcacaccgaaaccacacactggtccaagtagagtgcattgcctacaaacaagatatacgttttacctcctcttacatgttcactgatgtcaagtgctatcttttttttttcacgtaaaatgtcaattgctatattcccatgtaatctattaataagtagacttggtttccgttgcaagttattggactccagatggaaaattcatggctaaagtttcatagggctatacttgatgttttggttgggtacagctgctgagctttttaagaattaatattcttgcaactcatttttgccatttgcttcgctaaacaggtgaggtccgactataagataactgtttactcagaattatagcatgtgatgaagatttcttgcacatcaaaaaaattatattctacatctacctgacctgaaaatgatcacctgcgctcgcgcgcagatgcgcgcggcttatactagtctttcaccatttttctgcaggagttagacatctggcccatctttcaccacttgattatgaattctgaactgccttaggtatggcaatgctagctacgttgatgaaaggcaccaccacagatacgagttgaatcctgatgtggtcccagaatttgaaaaggcagggctttctttcgttggcagggatgaaagcggtaaacgcatggagattatcgaactacccaactataggttttccgtcgatgtacaatttcaccctgaattcaagtcaaggcctcaagccatctccacttttcttagcattggtagcagtgtcatcaggacagcttgatcaatgtggcgttatcagtaagacaggcagacacatcagcaataccggaggagcaccgaagcttaccagaagccgaatgtccgtgtgtcccaggggatacgtatccccccaaccagaaatcgttcgttccactttgagattcgtgctcttacgccctagatgccgctgccgccatatggattgcttaatctgttagtttggaggcatcatcttggcgcacctgagagacatgaggggtcagggcaagaggatgaagaaaggagatccagacacaggcggatcagcatccatcggcgatttggagtaaggcggaggcaagtccatgggacacatgagcttagggctgcagctgatagctgttatcatcgggatggtgagctgcagatagctgttatcatcaggatggtgagctgcagttagaaggcgacagattgacaatgctcttccttgcaatccgggagatttcagatgctatcacccatcttcttagtcataagagttgatgatatgtctttacacgaactctactccaagatatatatgtacactgctcgtgccaaggtcccaaggattggttttacttgttagtaaattaaaaacagagtgtgtgttctcaacattggctgttctagtagtatgtctaaaccttccattttcatttgctaaaagtatctatatctcatcatttttctttttaaaattgcagttcagatatatggctgctgactggcactgtttttatatgatttgtatcctctaaaaaagaacatatggtctttctatcctgattttaataacttc

SEQ ID NO: 262 - DNA, 1440 bp, Hordeum vulgare
taggaagtggcgatgataccccagtggagcaaccgaagaaactttacataagccccccaaatgctaaaagatttcaacttcctgatggaaggcatctggcttacgaagaaaaaggaatttcagctggaagggcaagattttcactggttgccccccattcttttctttcatcaaggctagctggaattcctggaatcagctcatctcttctagaggaatttggggcacgacttgtgacctatgatcttcctggttttggtgaaagtgatcctcatccaggccgaaatctgaattcttctgcattagacatgcttcatttggccgatgcccttgggattgtggacaagttctgggttgtaggctattctggaggtggcatgcatgcttggagtgctctgcgctacattcctgaccgggtggcaggtgcagcaatgttcgcccctatggtaaatccatatgactccaagatgaccaaggatgagaaacgtaaaatatgggacagatggtcaactaaacggaaactaatgcacattttagctcggaggtttccatcactattgcgcctcttctatcaccgaagcttcctttctggaaagcaaggacagcctgagagttggttatcattgtcaacgggaaagagggacaaaactttactggaagctcctatgttcagcgcattctgggaaaaggatgttgcagagtctgtgcggcagggagatgcgcaaccatttgtagaggaagctgtgctgcaagtatctgattggggtttcagcttgtcagacattcaaatgcagaagaaagaggatcagggggtgtttgaatttatcaagtctctgttcagtcaggctgagcgagagtgggtgggatttctaggcccaatccacatttggcagggaatggacgatcgggtggtgcccccgtcggcgaccgaatttgcccggaggatggttccaggagccaccgtccacaagcttctcgacgaaggccacttctcgtacttctgtttctgcgatgagtgccaccggcagatattctccaccctgtttggcaccccgcagggccctctaaaccctgtaccggaacccagtgaagtggcccgggaaccgacggaagaaacaagccctgcatacgaagaagaagaagaagaagtcgcagaacaggagcaggaaacatcaggcctggcctgatatcatgttcagcatcaggatcatgagtatagatacaagagtacaagacgacgttactaggaacctcaacacagaccgacctcacagaaaagataggcttttccttccttgccgccggtggacaaatgctgaccgatagttggtggactgagcagagcgtcgagtataaaaggaagctctgggtctctggggtctggatggggggctgctgcaccgattgtgcgggttcagtataatgtacagaagtcttgaa

SEQ ID NO: 263 - DNA, 703 bp, Brachypodium distachyon
cttctccctcgtccatcaccatggcgacccacgttcccggatccctattctcgttcctcgtcgttctcctcttctcctgcgccctgaccgccggcgctctgcggttcgacctgtactcgggccacacaaagtgcatctccgacgacatcaaggtcggcgccatggccgtcggcaagtaccacatcgtgcagcccgaggactcctctcagctcccggacccccaacgcatctcgctgcgggtcacctcgccctacggcaacagcctgcactactcggagaacgtgcagtcgggcaatttcgccttcacggcgtccgaggccggggactacctcgcctgcttctgggcgcccgacttccgcccgccctccaccgtcgccttcgagttcgactggcgcggcggcgtcgccgccaaggactggagcaccgtcgccaagaagggccaggtcgatataatggaacttgagctcaagaaacttgaggataccatcaaatctatccatgaagaaatgttctatcttcgtgaaagggaggaggagatgcaggaactgaactggagaaccaactcacggatggcttggcttagtttcctctcacttggtatctgcttaccagtggcagcgttgcagttgtggcatctgaagaacttctttgagagaaagaagctgctatgatttctctacgactaagaacattttggcacaaa

SEQ ID NO: 264 - DNA, 2134 bp, Brachypodium distachyon
atggccatggcctccacctcctcctgctcctcgcggccgccgctcctccacccggcctccagaaccccgaacccctcccgcctcccgccgctcgtctccagggcctcctcctctccccgcccgctcctcctctccttcgctccgcccgcgcgcgggcggttccgcgccgccgctgtgcagcaatccgacttcgaagacggggaggaggaatgggatggggaggtggaagaggagtattacagagaggaggaggaggtggaggaaggggaggagatggacgtggaggcgatggaggaggaggcgcgggccgccgccgccgacctcgccgcgcgcctcgaccgcgagctccgcgtcgatggtgatgttcgggagaaaagaagaaccatgagggataagacatcgacatctaaacatatcccagacaataatcttccgaaggtggcaattattggcaggccaaatgttggtaaatctgcactgttcaatcgtcttgtcgggagcaacagggctatcgttgtcgatgaacctggtgtgaccagagatcgtttgtatggacgatcttactggggtgatcaagagtttatggttattgatactgggggtgtgattactctttcaaagtctcaagcaggtgtaatggaagagcttgccatcacaactactgttggtatggatgggattcctctggcctctagagaagctgctattgccaggatgccatcaatgattgaaaaacaagctgttgctgctgttgaagaagcaactgtacttctattccttgtggatggtcaggctggtcttgtggcagctgacatagaaattgctgattggttacgtcggaacttctcacacaagtgcatcatacttgctgtaaacaagtgtgaatccccaaagaaagggcaaatgcaagcattagaattttggtcactagggtttacacctgtatcaatatctgctattactggcactggaactggagagctccttgacatggtctgttcagaactgaaaaatttcgagggactagaagggttggatgatgttgaagaagacgaaaaccgtgttcctgcaatttccatcgttggaagaccaaatgttgggaaaagtagtattctaaatgctttggttggagaagatagaactattgtaagcccagttagtgggaccacccgtgatgccattgacactgagttcaccacagaggatgggcagaaattcaaactcattgataccgcaggcatccggcgaagagcagcagttgcttctgctggcagcacaactgaaacgctttcagtaaaacgtgcatttagtgccattcgtcggtctgatgtggttgcccttgttgttgaagcgatggcctgcgttacagagcaggattataaaatcgcagaaaggatcgagaaagagggaaaggcgtgtgtcattgttgtgaacaaatgggatacaattccaaacaagaacaatgagagcactacgcattatgaactagatgtaagagagaagctccgagtacttgactgggcacctattgtttattgctcggcaatcaatgggaacagcgttgaaaagattatttcggccgcttctttggtcgaaaaggaaaggtccagaagacttggcacctctattcttaatcaagtggtaagagaagccgtagcattcaaagcaccgccgcggacaagaggcggcaaaagaggccgtgtctactacacaacacaggccgctgtccggccgccgacgttcgtgctcttcgtgaacgacgcgaagctcttcccggagccgtaccggcggtacatgcacaagcagctccggtctgacgccgggttcccgggcacgcccatccggctgctgtggcgcagcaggaagcgggcggacaagcagcggcggaagtccaacaacacggaggctcgtggctcgctcgtaggagccagttcgtagcacgtgaaaaggaatgccagaaaaggaatgcatgcctctatgtcgcgaaagaaaaagagaagaaatgtactagcgagttattaggaccgtcacaaggctatagagctttgaagctttgaactttggtttcaaccagattttccggtctagagatcatattcatatctcatagtaatataagtcaatactaacacca

SEQ ID NO: 265 - DNA, 3628 bp, Brachypodium distachyon
gccattcccctcctctcctccccccaatggaggcctccgcctcctctacgcctcaagctctcaccctcctcacctcctcccctcgctttctctctctccacccttctgctcgccagcgcggccgcggcagcggaggagggctcctgctgcggcctccgcctcaccggaggttagagctgggataccgtgccaaccgcccgctggggtgctccgtcagcggctcgacggacgtatcagtggacgttctgggcggcccggttgccgccgcggccgctctcctcgctgccttgcagctgttgtggctcaggtggcgcggcgcgagggatggggaatctccggaggttttatgtacacaggacaaaagcattgtaaataaggaacttaggacaacaacacggtcggtatatgatagtaattatgcaccttgtgcaactcatgaaaatggattttcagagctatctgtttctggaggaatgactcctgaagtggagtgccaggctgaaaaaacaagttccactgaaaatattatgaacgttcttgcgatgccacactctctgtcacaaggacaacatacaaagtatatctctaacagaatgggctggcaaggtggactctctcgccattttttatccctttcagaacaaaaggaacatgctcaaattgacaaaggtcctagtgatagcaaaacagacagtgagaatgctcatttgcttcaatgccagcagagtgaccaagaggaaaatcttgatttgacatctctttcatcctttaaaagaacagtggaatgccctcttaattttgttccccaagccagaactggaaatttgttcaaatcaagaaaagctattgagtttacagatccatatgaagggggctcttatttgacaccagggaaattagttccggttgcatgcttaagggaaggtcctgcgagtaaacaaaagaaagcagtgaaagatcatgacgctgcaaaaactattggctggactatttccgaaatactgagcaaggagaacctagagaacttcattccggcaaagacacttggattaaacggcacagtggacacatcagattacataaggagatacaatagttcattaatggatggaaggttgaaagactgcgtagatttgttggaaaacatggagcagaagggattgcttgatatgaagaagatccaccatgccagctttttgattgcctgtaagaagcaaagggctgttatggaagctgttcgcttctgcagattgattgcaaatccgaaaatgagcaccttcaacatgcttttatccgtttgtgctcattcacaagattttgatggggccctccaagttatgatgctcctaaaggaggctgggctaaaacctgattgtaaactttacacaacactgatatcaacttgtgcgaagtgtggaaaagttgatgcaatgtttgaggtcttccatgagatggtcagtgctggaatagaaccaaatgttaacacatacggtgcactaattgatggctgtgctaaagctggacaagtggcaaaagcatttggtgcttatgggatcatgagttcaaagaaggtgaagccagatcgagttgtcttcaatgctttgatcagtgcatgcggtgaatctggagctgttgctcgagcttttgatgttttatcagaaatgacggcagaaccctccgaatctaaaggatggaagccaattcttcctgatcatgtcacagttggagcacttatgaagacatgtattcaggccggccaggctgatcgagctcgtgaagtttacaaaatgcttcaggagtacaatataaagggtaccccagaagtttacacaattgcattgagaagctgtagcttgactggtgatctaggtttcgcactgaagatctatgaagatatgaacaagattggagtaataccggatgagatgtttctgagtgctctagttgatgtagctggccatgctaggagggctgatgctgcctttgaaataatcaaagatgtaagagcaaagggatttcatgttggaatcatggcatacagttcctttatgggcgcttgttgcaatgccaaggactggaaaaaggcactacagctatttgaggagattaagatcagcagattaactccaacagttccaatgatgaatgctctgatcacttccctatgtgatggcgatcaagttcaaaagtctattgaggtccttaacgagctaaaggaatttggtgtccgtccaaatgagataacctattctgtcttatgtgtggcttgcgaaaggaatggtgaagcagaactaggtattgatctatttgaacaattaaaagtagatggtattggccttaatcccaccattgttggttgtgttactggtttgtgtctacaaaagttttccaatgatctttcccttggcaatatcattgtcagattcaacctggggaaaccacagattgataataaatggaccacctcagcaattatggtcttccgtcaggcaattaccgctggtctgttaccctcaagtgatgttttatctcaagtgttgggatgtttgaggtttcctcacgacagttcattgaaaagtactttcattgataacatgggaataagttgtgatatgccacatcaccctaatacatattcactattggaaggattcggtgaatatgatgttcgtgctttctcaatactggaggaagctgctttgttaggagcagtggcaagtgcttccacaaaacatagccaaattgtcattgatgcaagaaagtcaaagatgtacacagccgaggtttctcttttgatgacatttaagtccctgaagcatcgactagctgcaggtgcaaggttaccgaatgttacgattttgttacccacagaaaagaaacaagttgatcttgatgaaagagagaaaacacttaaacttgctggaagagttggtcaagcagtcggctcccttctgagaagattgggaattaaatatcaaggcgaggagtctcacggcaggatgaggatcaacggcctcacactaagaaggtggtttaatccaaaattcacgagcacaccctccactggaacaccagcagaattgcttccactaccctcgagattagcaaaagggatcgctgatcagcagcgcgatatcagaagcctttctttatagcacaggtttaaccttttccatggcccaaattttggataccaagaaggcaatttaccgtacagcatcagcagacctcagaaactagctagtcaaaaagatcaggatgatgaaatattttgagagcttattgggtggaaagaaaaatgcaacacagcacacagttctgtgcatcaagttgcataataaatgtattcatttcaggatttaggatatgaagcctctttttctctttcttacattacatgacctcaggctgtctggcatttctcaagagatgatgccttctgtagcacagtcgcataaaaaagattgcgagatgtttccactaatgtactactggtattcgaagtgtaatttatttgttttacttgttgcataactatatattcgaggtcaactctgctcatcagaaaacacgtgtaataatctaattagcgactatatcaaggcaatgttcccccgtttcctttggt

SEQ ID NO: 266 - DNA, 1489 bp, Brachypodium distachyon
atggcgtcgtcctacaactaccccaccaccaccagccctgctactactactaaccctagcttccccgccccctcggccccgccgctgtacccgacgctgaccatggccgacctcgcccccgtcgagatcccgaccaccccggacggcgcgccgccgccctcggaggacgtgctcctccgcctccccggcgcgcagctccacctcatcgaccgccgccgcagccacccgctcgccgcgggcgacctctccctgcgccgcatccgcgccggcgatgcctctctcgccgccaccgcgctgctcggccccatccagtggccgctggcccgcgacgtcgccgccgtcaagctcgacccgcgccactactccttctccctcgccgtccccgcatcccacgacgaccccagccccgacccgctccactacggcctcacgctctccgcccccgacccgcgcctcgacgccgtgctcggcgcctacaccagcttctccgtccattccgtcgctggcagcgaggcgctcgccggtggcgcccgcggcgaggtggaggcggccgcgtactggaccgctgtcgcgcccaatgtggaggagtacggcggcgccgtggccaaggcgattgcgaggggtgctgagaacgtggccaaggggataatatggtgtggcgtgatgacggtggataggctccggtgggggaatgaagtcctcaggaagaggatccagccaggtgatactgacgccgaggtcagcccggagatgctgagaaggatccaaagggttaagaaggtgacaaaaatgtctgagaaagtggcatctggaatattgtctggagtcgtgaaggttactggctatcttacaagctcgttggctaattcaaaagctggcaagaagttttttagtatgttgcctggagagattcttcttgcttcgcttgatggatttggcaaaatctctgacgcagtagaggtggctgggaaagatgtgctatccacatcctcgaccgtgacaactggtcttgtatcccacaagtacggagagaaagccgctgctgcgacgaacgaagggatggacgctgccgggcacgccattgggactgcatgggccgtgttcaagatccgtcaggcccttaacccgaagagcgccctgaagcccacgtcactcgccaagtccaccatcaaggccggagccgccgatctccgggcgaagagcagcaagagcaagtagagcctgaagccgtccttcctcgtcgcaaccggctgtgttggatccttgtcctgaccagaagaacctttgcccccagaagtcccagctgatgtgctgcttgtagatattatgtgctggagctggcaaccagcagcagcttccctactgtgtcctcccctctgctgttgtgaacgttttctgttgtgtttctgagtggagtatcgttgttttcgtttgtgcagtgttagttcaacgcagaaaactacgaaagaaacaaagttcggtgttcttt

SEQ ID NO: 267 - DNA, 1064 bp, Brachypodium distachyon
cgcttctcgagatgcccgccgcggcggcgcgctgcggctgcccgctcctgctccggcagcaaccggcggccggcctccgccgttccttctcctcatactccggcatgcggcgtgtctgcgcagccgcagggggtgggagcgggagcgaggggcggccgccggcgtacggcgggctgctgctcgacgccggcggcacgctgctgcagctggcgcggccggtcgcccagacgtacgccgccctcggacgtccatacggtgtgacaaagcgtgaagagtacatcaagcagggattcaagcgggccttctctgcgccatggccgaagacgctcaggtaccagggtgatgggcggccattctggaagattgtcgtggcagaagcgacagactgcactaacaatgattatttcgaagaagtatatcagtactacgctcgtggagatgcttggcgtctgccggatggagcttacagaacactgcatgatctgaaagatgcgggagttaagctagctgtcgtatccaactttgacacacggctaaggaaattgcttaaggagctcaatgtctcggatctgtttgatgccattatagtatcatcggaggttggatatgagaaacctgctccagagatcttcagaatagcgttagatcaaattggtgtggaagccagcaaagcagtacatatcggggatgatgagactgctgacaaggcgggtgctaacgctataggactcgagtgctggttgtggggagaagatgtcaagacattttctgagatacaggaccgaattctagcaaggaacccgcaatgagtgcggatttggtgttggacatcgttggacctctctgctggtgatctgcacgaattgttcatttgtttcaaacttctgttttcatgaccaggaagtcccgagggcttttgtttatctgttttatcgcacgatgttcttgcaataaaccagtgcaccgccatgtacaaatacaagtgatgcataaactggaccaattttatgcagatttggaatgaaatggaatataaagtaccacacagcttcaaggcacaacat

SEQ ID NO: 268 - DNA, 2086 bp, Setaria italica
cgcgacacccaccccgcctcggcgcctcctccctcctccgcccatcgaccgatcgattcttcgcggcctctccccccgagtcagatcctactcaatccccggcccaaaccctactcggccctcgcgaagcagccatgatggcagccgagccctcgccgttgtcggccgcggctggcgacctcgaaaccctcgccctcgactcctcgtcgtccgccgcctcggcctccaccgaccccctcctccgcccgccttcctcccagaccgccgccgccgcgaaccacgacgccttcgtcatcgacgacttcctcgacgaggaggacgacttctcccccgccccggcgcccagcatcgcccgccatcccgcgccgcgccccgacgcggcgccccccgtgttcgccagaatcaccgtgtccgatccgaagaagcacgcggagcccagcggcgggggtgccgccgccggcgtgatcccgggctccgggagctacttcacctacctcatcaccacccgcctcgcgggcggcggcggcggcggggaggtctgcgtgcggcggcgcttccgcgacgtggtagccctcgcggaccgcctcgccgcggcccaccggggcctgttcgtcccggcccggcccgacaagagcgtcctcgagggacaggtcatgcagcgccacgacttcgtgagccagcggtgcgccgcgctccagcgctacctctgccgcctcgccgcgcaccctgccgtcggacacagccccgacctccgtacgttcctcaccgagcctggtgccatccccgccttccagggcgaggcgccacggtactggactaccacggtgaatgctgctgctccgctagtgcaggccaaagctgggagggacttatttgggatgttcaagggtctgaagcagactgtggtgaacgggctggtcgcaaccaagcctccacctgtggagcaggagacagacacagaattcctggcgcacaaggccaggtttgaggatttacagcagcagctcaccacaacatcacagcaggctgaaacacttgtcaaagcccaagatgatcttagagaaactacaggtcacttgggaatgacactgattaagctggcaaaatttgaaagagagcaggccacatgtaattccctaagaagaagagccggtgaaatccataattttgcaaatcatgttttgaagatgagcagatcacagataaaattaaactctgaaattgtgaaacacctgggtagcatccatgaatacttggaggccatgatatctgtcaatcatgcatttacagatcgctccaatgctttacatcacgtgcaaagtttgtcagcagatttattttctttgcacacaagggcaggaagacttgaatcttcatcagcaagagatatggggcatgagtggtcgacatatcagaaggtggagggattgaaagaaacaataagatcagcagaagcagccaaaagtgacgcacttagagaatatgaaagcattaaggaaaacaacaagattgaaataaaaagatttgacaaggaaagacgccgcgatttcattgagatgctgaaaggttttgttgtaaatcaggtatcatattcagacaattttgctaacatgtggacgaaggtagcagaggaaacagaagtatatgcaaacaggggcaactgatgtacaagcctgtatagggagtatagagtagtggattttgatatatttaatttgctccgacgtccagcgacacaaccattcttgattcctccccagttttgccaccttgggttggttgtaatgccacatgagttacgtgcagtcacgagctcatgatattgggttgcggcagatagcttctcggctcggtgagaactggcatgtatgagagccacacgcacaatttttcttggtgataactgacaggtcaatgagctccgattatcctgtattggtactgctgtgttcctatcttcctatgcactaatactcgagtatcttgaaattgtgccatggatgatactcactgtggatatgacgaaactcgaagcctcttttcactttttcaggttttagtgtctcacacgttgctggatgctgac

SEQ ID NO: 269 - DNA, 2278 bp, Setaria italica
atggggttcgaagggctggtggtggtttccgacccatacctgcagcgccgcttcacgcaggccgatctccgcgcgctccaggccaagcttcgagctctcctccgcgtctacgccgagatgcagcttcgcctcaaggcggcaggcgccagcgccggcgggaagaaggcgggcggcggcatcgcccgctcctcgtcctcctccgccgtcgccttcctcacggcggccaccaccacgctgctgcacaccatcagcgagtccgagaaggcatcctacgtcggccacatcaacgcatacctcgctgaggatccgttcctcaagagcgcgctccccatcgatccggccaccgatcacatcttccacatcaccaaggatggcgtcctcctatgcaagctcattaacttggccgtaccgggcaccattgacgagcgcgccatcaacaccaagagggtgctcaatctgtgggagaagaatgagaatcatacactttgcctcaactccgccaaggcgatcggctgcaccgtcgtcaacatcggcacacaggaccttgccgaagggaggatacaactgttggcggatgttaacctgaaaagcacacctcagttggttgaattggtcgaggacagcaaggagatggaggagcttatgagcttgtctcctgaaaagattctattaaggtggatgaactttcaactgaagaaaggaggtttccagagaacagtaacaaacttttcatcagatataaaagacagtgaagcgtatgcttgtctattgaatgtcctggcacctgaatgcagtgcaaaaccatcggcaatgtcagtaaaagacttgcttcatagagcaagattagtccttgagcatgcagataggatgggctgcaaaagatacctgactccaaaagacatagttgatggcttaccaaatctaaatcttgcctttgtagctcatatttttcagaaaagaaatgggttgtccaaacaaatgaaacaagtttcttttgtggatggactctctgatgatgctcaagtttccagggaagaaaggtcattccggctgtggattaatagccttggaatttccacttacatcaacaacgtgtttgaagaccttagaaatggatgggttctccttgaggtgcttgacaaggttgctcctggctcagttaattggaagatggcaaatcgtccgccaataaaactaccattcaagaaagttgaaaattgcaatcaagttttgaagatcggaaaagaactaaagttttccttggtgaatattgctggaaatgatattgtgcaagggaataagaaactgatattagcttttctatggcaattgatgcggtacaatattcttcaactgctgaagaatcttagatttcactcaaatggaaaagagatcacagataatgacatattggcatgggccaataaaaaagtaaaagattctggaaagcaccattctcgtatggaaagtttcaaggatagaagcctttccagcggcacctttttccttgatttactaagtgctgtggagcctcgagttgtgaattggagccttgtgactaaaggagaaaaagatgaagagaagcaaatgaatgcttcatacatcatttccgtggctaggaagcttggttgctccattttcttgttgccagaagatatattggaggtgaaccagaagatgatgctaactctgacagcaagcatcatgtactggtatttgaaaagaccaacatcacattcattggactctgaaaacgggagttcatgtgagacaagctcgaccacaacttcagacgattctgcatctgaatcatcgttcgatgacaatgcagctagatagaagtgcagggatcatgaagagaaatgatctgacctggaatactcttcatcccagcgcgacattggttttgttcttgattctttgctgtaattttaagaacaaatgcattcaacgcatagggaagcgataaagagctcagagtgttcatttgtgaggttttgtagtgtgaaaaattgattgggtgaaagatgtgtaacatcctgtaaatattgacgcaggtagcctatatttgtaaaatcatagtgacagtggattgtccaaaatccacatagtttggttttttcttgggcatttttgctttgcaacatgacaagataccggttccagtttagagcgagaacaagttgggttgtagcttgcgataaatctgtcctaattaggaatttaggatgttaaacatttaggcacgtgtttattagaaggaaagaaaagaaactta

SEQ ID NO: 270 - DNA, 1811 bp, Setaria italica
gccggaacccacacatcactcgctagtcgctagctagcgtgcagctgcagcgcaccgggcacaaggacgacgaccacgaccccaagccaaaggccagcatgagctcgccacctctgctcggcaaggagggcctcaaggccgcgtactgccgcgtcgtcgtgacggtgccgctcgccgcagccgccctcgtcgccgtggcgcggctcgggcccgaggagctcgccggccgggtccgggacgcgcggccggtgcacctcttcctggcagcgttcctcccggccgcggcggcgaccgtgtacctgatgctccgcccgcgcgcggtgtacctggtcgactacgcctgcttccggacggcgtccaactgccgcgtgcccttctccaccttcctggagcacgccaagcaggtgccggtgctcaacgagcgcagcatccggttcatgaccaagctgctggagcggtcggggctcggggaggagacgtgcctgccgccggcgcaccactacatcccgccctacaagtactgcaccctcgacgcggcgcgcggcgaggtggacctcgtcgtgttcggggcgctcgacgacctgttcgccaagacgggggtcagccccggcgacatcgacatcctcgtcgtgaactgcagcctcttctgcccgaccccgtccttcgtcgacatgatcatcaacaggtacaagctgcgcagcgacatccggagcacgcacctctccgggatggggtgcagcgcggggctcgtctccgtggggctcgcccggaacctcctccaggtggctcccagaggcgcgcacgcgctggtggtgtcgacggagaccatcacgcccaactactacgtgggcagcgagcgcgccatgctcctgcccaactgcctcttccggatcggcggcgcggcggcgctgctgtccaactcccccgcgaaggcccggttccggctcaggcacgtcgtgcgcacgctcaccggcgcgcaggacagcgcgtacacgtgcgtgttccaggaggaggacgacaggggaaacgtcgggatcaacctgaacaaggacctgatgaccatcgccgggaacgcgctcaaggccaacatcaccgccatcgggcccctcgtgctcccggcctctgagcagctcctgttcgcgctctccttcatcgtgcgcaaggtgctcagcgggaagttcaagccgtacatccccgacttccgcacggccttcgaccacttctgcatccacgccggcggccgcgccgtcatcgacgagctgcagcgcagcctcaacctgtcggatcagcaggtggaggcatcgcggatggcgctgcaccggttcgggaacacgtcaagcagctcgctctggtacgagctggcctacatcgaggccaagggacggatgcggaaaggtgaccgggtgtggatgattgggtttgggtccgggttcaagtgcaacagcgcggcgtgggagtgcatcgagcccgcggcgaacgcggaggggccctgggcgacgtcgattcacaggtacccggtggacatcccggacgtgctcaagcactaactggctgcggcttgggcatcgacatgttctttcgctgaaattaaatcgcgtgcgaataattgagatctgttaaacaacatgtctgttccatctgtttattattaatccgatatgatccctttatatcacagtagtgtataatatcatgcgtgtgtgcgtggcagggccatgaaacaggaatgttctcacaatatgttgtacacggtaggtagctctcaggtgtctttttgtgcagtctttgtgatcgaccgccgttgccggcaa

SEQ ID NO: 271 - DNA, 858 bp, Setaria italica
ccctagaaagaagatcagcgaggccgatcgagcgagcccaataaaccaagggagatgtttgcggctgctagcgagatgtgtgcctccatcatgccacaccatgtgatgcgaggagcctctgcagcctctcctccccctactacttccaagatgcaatcatgctgccccagcaagctcctcgggccctcggccgccatgattgccacaccgcacctcaagagtcgcctccacctacctccaagaggaagaggccggagaagctatagtcgatgagaaaagcgggggcggagagagaagggcggcggcgtgcgagggggccgcggaggaggagagagatggggaggtgacagaaagcgagagggagagagatgcatggtgcatgatgatggcgtggttgatctgctcttgtactcctctcatgtgagtcaagaggccatcatcagatcggtgcagttctcctggctccttcgtcttcttcctccagcagactagctcctctcccttcagcttcttttgtacgctgcgccatggctttggggaatcaagcgtcttggtccgaaatccgtcttctttccagctaggatctacgtacttgtgcgagagtatgtcatgctatgctatatctgttactcctacctgttcctattctgccttctatatatggtttgtgcaaacaagattcgtttatcttgattgatttctttcggtctttattttgaagttctattcatgtaatatttcattattggttatgtggattatttctcctctttgagctattaactctagttaaagaacttcgatgattagttttgatgcatacgtgtatcttgattgactgatgatctgaatatatcc

SEQ ID NO: 272 - DNA, 640 bp, Setaria italica
gcctggttatatattcagctttcgttgccaaagaaaaggggcgaaagggaggaaggcctgcttcacctggtttcaggttcatgtgttgtgcgtgttaccaagagtgtacgcgtcgtgtgatttcagaatgaggatgctatcaaggtcttggagatctgcgtccctctttcctgtcatcgtctttgccttgttgttctcaacttcattcgcagggagacagtgcaatttcttgacggatcaagatgccctacgtcatcaaggagaggcagcaggggctgaacagaaggaagcagtagtgccactggtgcatggtcggatgctcaatgtcaagacgaatgattacggcagctatgacccttccccaaccacggacaagccgcacttcaagctcatacccaactgatcaaattacgtatcgagcttgccgcaatggagtggccgatgaggaatttagctgcttacatatgtgtgcctgacgtatagatagagaggtattcctaggcttgctaaaattattataatgacatttagtacctttttatagatgttgctcgtgctgtgttcagtagccacaaggagctgtcagtgttcattcggttgaacttgtcatatattgtacttaaaccatacatatatgcaa

SEQ ID NO: 273 - DNA, 1760 bp, Setaria italica
caatcttgtcgctttttccgcggcgtctcctcgactcctccccttctccccacaaaaattacccatctctcctccgccaacccaatcgcctccaaaaccccccggcggcaaaaccctccatttccgccgcctgccccgccctctcgtctcgtctctcctcgtggggccgcctcgctctccccctcgattcctggggcctgggaggaggggaggatgcaggccgcggccgggagcgtctcctgggtcgccgcgcagccgtccgtcctcggcaggtgcggcggcggcggcggcgcgcagtccgcttcggtcaaggggagggctggtggaggaggaggaggaggaggaggaggcgcgagcgtccgcggggtcggcgtggtgcggtgctccacgcgcgcgcaggagaagcggccgccgcgggtgcgcaagtccaaggaggagaggagggagatggtcgagtccttcatcaacagctaccgggttgcaaatgatgggaaatttccgtcagtcaaccttacacacaaggaagttggagggtcctattatatagttcgtgagatcgtgagggatgtcatccaagagaacagagtccttggtcctggtggcttggattctatggctctgagttttgaagattgccctgattcctcagaggtatccatgaagcatgaattgggtcaagacaatatagagagcttggcaatgtctgatgatggccaagccggtcagggttctgtgtcagagtcatccagcagcgaggaatcattttcattgcaaaacaactccatcaacactgatatactgctggggtcatctaatattttagaggctggtgttctgaaaagtatagtccaaaatgggactgcatcaggtacagcattcttggagacaaaccttgagaagcaagatgaagttccatctgggggatcaattgaggttggcctgaatagttctgaagagctaaacagtcaggaggatgcacatgaggggatgggaagtgttgctactgatattcttccctcagaagctactgatgtttatgaaacaaatggtgcacttttaagagagcatgagatgttacctaatgatagtcatggtggctcaaatgatagtgttgttgatgatggaaatctccttgcggcagccaatggtgctcttcaagaaaagcaagcatcttttcaggagcatgatccatcaaatgaaagtgtgcaaggtgatgttcagagcttagattgccagattagtactacattatctgctaatcccataaatggttttgactcagaggctgaagtcacaaccaagactatcgaagcatcggatacaaaggggctattgcacacagaagaccagcacagtgtagtacaggtagatggtagtgaatttaagaaatcaacatccggtttcacaaaggaagtggttgaggcaaccgacgccaggcatgaacaaggaatgagcaccacaactgtgatcagcaggagaacttcgaaagcgcagcagaagaaagatgacaacctattctggcttgtccttagggcatttgttgttgctatatcaaaaatctgggcaaagtgaacaatgcagtgaaggcagcttatgtggaactgaagattgagatgcatccttcctacaggaaaaatgagaatcggtccacagagttccatttctatcgtacgaatacatatgcttcttttttgctgcagtgttaggttattgattagagacagttgatttagttcgtagtagcttcccactgtaggtgt

SEQ ID NO: 274 - DNA, 705 bp, Setaria italica
atgaagagagagaactgcacaacgattccacgccgaagcgtagagcgcagcagaggacgcgagaaggggcggcgagttcttgaatcctctctctccgctgctgagcctgctcatcaacccggcatggatgcaaagaacgtaggcaatgaacaagaagctcaacaaaagcttgatgcggtgacaggcagtgttccaagacctaatcaagagaccttgaaacagttcgcagattcagacgctggaaacatcagtccagcaaatggccaggaagctgacgtgaacatggaagctgccatctccaccgaggacgtcatgcgagctggcgggtttggagcaaaagatgacattggcagcctcctcccaacagctattgattcgacagatttcgaggcctcgctgcgggacgcccgcgacttcgaaggtgagaaagaggcaccatcacatcctggactgggctggaagggggagaaagctgatgatggtagcaaaccatcagatgtgccgcagcagttaccatgatatcttaccttgtaggctagtccagcttcagcttcagaaaacatttgctgatcacgtttatgtacgttgttcccaagagctgctgtacgtttgaactttttgccacaatgttatgtgtgtagcattctgctgtttcagactatcagtgctgtgtgatcatgaggataacggttcttgtctgttgtc

SEQ ID NO: 275 - DNA, 2514 bp, Setaria italica
ttcctcctcccgcggcagtggctgctgctcctcgcggcggtgctagcgacggcggcggccgtggcgcgggggcaggcgccgctggcgtcgcgggcggacctgggggggctctacagccttcgcgcctccctggggctgcgggcgcgggactggccgctcaagtcggacccctgcgcggcgtggtcgggcgtcgcctgccgcgccggccgcgtcgtgaacgtcaccgtcgcggggctccgccgcacgcgcctcgccgccctggccccgcgcctcgcgctcgacgggctccggaacctcaccgcgctcgagcgcttcaacgcctccgggttcccgctgcccggggagatccccgactggttcggctcgagcctcccgccctcgctcgccgtgctcgacctctcctccgccgcggtcaatgggacgctccccgccaatctcggcgcgtcggggaacctcacgatcgtgctcctgtccgggaacggcctctcgggtgccgtcccggcgccgttgctctccgacagaggacctcgcgtcctcgacctctcccgcaacaacttcaccggcgggctgcccaacgtttccgccgtcgccggcggcgcgtcgatgtttaacatctccgggaattcgctgtacggcgtggccggctatgccattgcggcgctgaggagaaggtttcaggtcgtcgacgtgtccagcaactacttggatggagctttgaacgggtccgatggagtagtgattaccacgacgaattgcttccacggcgtgccgggtcagcgcagccgtgtggattgcgaggagttttacaggaagcagggcgtgaaccttgttgatgctccagctccctcgccgttgccgtcggcttcgcctctgccacagccatcaccggaggtgaagaggaagaagcagggtatctccaaaaatgtactcattggagtccttgtagctgcgggagcattgatggttctgtttttggctgtattgctgttctgcttggtgaagatgagcagcaggggaagaagcagagggaggggagtggagataaacgaggaaggtactggcacacgctctgcgcgtaggagggacagcagtgtgaatccagtggcgtcatctccatcagcagtttctccaagagccaatggtggacctaaaaaggatgtgtctgccattgccggtgatttcagctatgaggaattggtagatgccactgggggtttcggtgacgacaagctcatcaagcatgggcattcaggagatatctatcacggtgtcttggagaatggctcacatgtcattgttaagaaggtcggttcaaagggtatcaacaagcatgctagtgaattggacttctattcgaggtactcccatgacaggattgttccgctactcgggtatttgagcaaggatgatgaggaattcctggcttacaagtatatgccaaagggagacttgaccgatgcattgcacaagaaacctgtagacactgcagatggcttgccctcgctggattggataactagactgaagattgcgactggtgtggctgaggcaatgtgcttccttcatgacgagtgtagcccaccattagttcacagagatatccaagcaagcagtgtccttcttgatgataaatacgaagtgcgacttgggagtatgagtgacatatgcgcccagcaaagtgggggaagccagaatgtcttctctcggatattgagatcgtcaaagtctctcgacaagcacacatcaggtccaccggccacttgctcctacgacgtcctctgcttcggcaaggtgctgctggagctggtgaccggcaacttcggcatcagcgggtcgaacgacgccgcctcggaggaatggctggcgaacactcttaaccagatcaacggcggcgacaaggcgagcgtcacgagcatcatcgaccccttgctcctcgtcgacgaggaccaccaggaggaggtgtgggcggcggcgatcatcgccaaggcctgcctgagcgccaagccctcgcggcggccgtcggcgcggcacgtgctccgcgccctggagagcccgctgcgggtggtgcggcagagctcatcgtcccggtccgactcggcccggctgcggagctcgtcgtcgaggagctcgtggcagtccgtgttcttacaggggaacaaccaccgggtgcagagcctggaccggcggcactcggtgaggtctcacgggagcggcggggaggcgtcgttctcgttctcgttcaagagggccgtggcggcggccccggaggtcgcgccggagccggtggcggcggcgctcgacgaggaagccgttgttgtgtagtgttactggtagcgagtaggacgccatttcttgggttctttcttacaggcattcctgattctttccttacgtgatgtcagtcacatcgcattgtgtgtataatttgttgttgttgtctgatgcgttgatgcggtgttccaacatgacaagaaaataaaaactgtgcataaagagcatgttttcaaatatttt

SEQ ID NO: 276 - DNA, 868 bp, Setaria italica
gtttcgtcgcaatggggttattcaggggcagcttcactctcttggtgggaatgggatgcggtgtctatatagctcagaactacaacgttccgaacgtcaagaagctattcaacacctacgtttttctggcaaagcacatcgaggaaacctaccggaagccgaagaaagacgacgattgatccttttacattggttttccctgtttatgccctgggaaagtgaaagtacagctaacgtgatacgggaaaaatgcttttttgaaatggtgaagtcaattttggtgatcggtgagttttgaactatggtggattatcttggttagttgtggaattcagttgctgtaaaagcttttgctcagtttagaccatgtatatctagacgagcactcccttttggtcgtgttcctgtgcctgggaaatgcactgaactttgtagctgaagtgtggcgatggatatctcagcatcatatcagtgtgtttgtcaagttaacatgggctgggatgatatgtttagttgaatttagatttgctctattttctaaaattgcctcttttttttccttccagatttacagatatggatgatggaatttatatctgctactgaaatggagggaatggcggaataaatgatttttttgccacctgggaaacggagctgaaatttaggagactttgaacatgtgaacacgttatcgagaacacgttgcagctgttcatgcgcttgtttgttctcttcacctgtattgctgatctgttatgaccaaaagcattgcgcacacatttctttgcgcatgtacggtggaagcaaaggttcacgcgcacttctgtttttgtgatgcgtaagtatgagcaatcgccagtttgag

SEQ ID NO: 277 - DNA, 1874 bp, Zea mays
aaacacccctaaattacgattattgttacggaagaggtgctcctctctctatctcccccacgatctccgttccttcccctccccgatctccccaatccgaccagaccggcaggcaccttcgactcgagcggagcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcggtgaagagaggtgactggtataggaccaaggatttggtgattaagggggcagactggatagttaatgaaatgaagaaatcaggtcttcggggtcgtggaggtgcaggttttccctctggtctgaaatggtcctttatgcccaaggtttctgatggacgcccttcttatcttgttgttaatgctgatgagagtgagcctggaacttgcaaagatagagaaatcatgcgccaagacccccacaagcttctggaaggatgccttattgctggagttggaatgagggcatcagctgcttacatctacattcgaggtgaatacgtgaatgagcgtctcaacctcgagaaagctcggcaggaagcatatgcagctggacttctcggtaagaatgcttgtggatctggttatgattttgatgtgcatattcattttggtgctggtgcgtacatctgtggtgaagagactgccctattagagagccttgaagggaagcagggcaaacctaggctgaagccacctttcccagccaatgctgggctttacggctgccccacaactgtgaccaatgttgaaactgtggctgtatccccaacaattcttaggcgtggtccagaatggttcgcaagctttgggcgcaagaacaactccggaaccaaactctactgcatctcaggtcatgtgaacaagccttgcaccgtggaagaggaaatgagcatacctctgaaggagttgctcgagaggcactgtggaggtgtgagaggaggatgggacaacctgcttgcagtaattcccggcggttcatccgttccccttttaccaaagcacatatgtgacgatgtgttgatggactacgacgcgctgaaggctgtgcagtctggattgggtaccgcagctgtcatcgtgatggacaaatctacggacgttgtcgacgcgattgccaggctgtcctacttctacaaacacgagagctgtgggcagtgcacgccctgccgagagggcacgccctggctctggatgatcatggagaggctcaaggttggtgacgcgaagctagaggaaatcgacatgcttcaggaggtcacgaagcaaatcgaagggcatactatctgtgccctcggggacgctgcggcgtggcctgtgcagggacttatcaggcacttcaggccggagttggagaggaggatccgcgagcgagctgaaagggagctgttggcggcttctgcatgatgtgccagccgcatgtactagttttctgatttctttctaccgaaataatacaaactgatggagctcctttctgtgtaagcaaatgctagcattcctgatttctttgaaccgtttatgtggatgtttatttgatgcactcaagcatctgacggattttgatggactaggtacaccttttcatagtagaaacaaacttgagggttgtaccgtgt

SEQ ID NO: 278 - DNA, 1747 bp, Zea mays
atgccgcaggtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgctggcaccagtgaccgctgcagcaatggaagagtgggtgcttgatgaatatgctgccaagcataaggttgccattgataagcttctacagctcagggtctttgttgaagtgcgcgacagacgacgggacgtgagctacaagatgaatcagaagttccagggaaacatgcagaagtatttggttgatggtggaagtttaccaagggaacctttaccattaagtgtcactggtcgattgcccacaccagcagatctggaagcctatgctcttgatcaatgggagtgcttcttgttgcaattgatcaattcatctcaagtcgaaaaagggtcaagttttagctcctccatgatgaagacgtttcagcgtggtcttctgagttcaagggatggtgaagcttcaaagttgactgaaaatggcttccaatttcttctgatggaaacaaatgcacaactttggtacataatgagagaatacatttcatctgctgaggaacgtggagtggaccctacggagctgatatcatttctcttggaacttagctttcataaattgggagcggcttatagcttgaacactctgactgatgtccagaggattgccatcagggatcttgcagaattaggactagtcaaacagcagcagggtcgaaaggatagctggttcattcctacccaattggctactaatctttcagcaagcttgtcagattcgtcatctaacaaagagggatttgtggttgtggagacaaactttcgaatgtatgcatactctacttccaagttgcactgtgaaattctacgcctttttgcaagggtggagtatcaacttccaaacctcatcgtaggagctgttacaaaagaaagtatctatggtgcttttgaaaatgggataactgctgagcagataatttcatttcttaggcaaaatgctcaccctcgtgttgctgacaagatacccgctgtcccggagaatgtcacagatcagattaggttgtgggaaactgacctcaacagggttgagatgattccatcgcatttgtacgaagattttcctagcaaggaatggtttgaacaatgctgtgattatgcaagggataatgggtacttgctgtgggaggaccccaagagaatgagactaattgtacgaggggagttccaccccgaaatgagggagttccttcgcaggcaaagatgaggaacgaccttgtacttgacggaccatgctatgcttctttgtagtgcatagaaacactgtatcgggtaatagttctcctttaaatatcaggaaagggtctagaaaagggctcagtttttgaattattttggtgacctgtgagctgtggaagcatatgaataatgtggtgttcaatggagcaaggcccaacatccttgatctgcttctaaatgttactagtgactgtaccctatgctggtgtatggctggtggccaggtcctgttggaactcttaggtaggtagtatggtgggatggagttggtatgctcttaatttgttgttatttggattgattctatataggacggagtgattttaaaaatgaaaaaaactcaaatgatgaaccattta

SEQ ID NO: 279 - DNA, 1136 bp, Zea mays
tgcattgttccctgaaacctgcagatgacgagcgtcaaacattaggtgaaccctggaaaccttctgttacaaaggcaacagaggtgggcatgcagtccaagaacaataagctcgctaatgtcgtgagcctgcttcagaagctccagcagcttagcgtgagcaaggatgaggacgcacctccggtcgaccatatggctttcctgtgcgagacagaaagcccggaccaccgttacgtgtctgagatactgctggcctcgggtcttctgatgaaagagctaggttcaggacaggcaggcctccagctccagctccactcctctggctacccgatcaaccctgacttgttccacgtgctggagcaaagaaaggcaggatgggccagcatacctgacggcatccaccagagcaggagcggcgccaagtctgatcccaagagagcgcaccggaagctggtgtttgacaccgcgaacgagcttctcctccagaagtttgagaaggaaaccacagtttacgcggtcagttcctccaccggagcgaaggatcatccacctgcaaaggctcttagcgggcagcaactgctgaagtttgtatcttcagaaatcgaaggcatgggtacggagcgatcgtccacctgccagatggaaggcggcgtgatacctgacgcagagatcctgcagaggctgcagggatggacgagcttcagcagggagctccctgggatggtgctggagatcgagaggtcggtattcaaggagctggtggacgaggtggtgcatggggagtctgccgacggcccggagatgaaggcggcaggcaggcggagaaggcggcggctctttgcttgatatggtttgtgtgaccatcaccatgcaccgggtgggttgtccaagtagatgggcctgatcatgctgtaactttgattgccgtatgaactttttttctctctcaagggagaggtgcacaagttgtactgttgtagtataagcagcgcaggtttgcagaggcatgaaaaatgggcattggtttgtgctgtatagatactctgtataccattgccttttgattccttgtgtttcattggggatgatgctatttcagtaaagaagtgtacaaatggcagggttcatcattttaat

SEQ ID NO: 280 - DNA, 594 bp, Zea mays
tgttgcaggttggctagggattgccgccccagctggctggttatatattaggctgtcgccgccaaagaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacccgtccaggttgcagcagtcgagttgccgatgagaaatttaacagcttaaatgtgtgcctgatttatatatacagaagcattatattactaggcttgcttaaactgttctcatgacatctaatatcatattattatagatgtgacatatagatgtttac

SEQ ID NO: 281 - DNA, 1014 bp, Zea mays
caaatggtgtttatctttttcaggtccgcttatatgatactgcattgcaaagaaggcctgccatctctgttgagtttaaggagtcaccaatcaaggcagttgctgctgatccgaatgggcatgatgtctatattggcacagggacaggggaccttgcttcctttgacatgagaactgggaaattgcttggatgctattttggcaaatgcagtggaagtattagatccattgttaggcatccagatctacctttgatagcatcttgcggactggatagctacttgcgtatttgggacacaaacacaagacagttgctatctgctgtctttctgaagcaacatcttacaactgtggtccttgattcacatttttctgttgaagagcctggagagatgaaatccaagcaactggagtcttcagtggagactgagactgaagtccgaaaagaaaagaagaaaaagagtaaggcaattacagaggatgagactgaggcacaaatccgaaaagaaaagaagagtagaacaattgaagaggaagaacaagctggattggtcgaccatagcgatattaatgatgaagtatatgccagaaaagaaaagaagaaaaagaagagtagaggtattgaagggggcaaggagcgagacagcgacggggaaatttgcagtcccaagagaagaaaatctggagaaagaagcaaatgcctgaagaagaggagcaagaaacagctggttgcctagtacaagtatcatttctcattacccgccttcttgattttgcagaattacacaattttgtgtggtagtttgttcggaattgtatcccttttgaaaccctgcaagggaagtgcatcattttcgtgtgcgcatttttctactctggtgtagctaaattttgagacatacacgctggagtagttacagccaaaacttgaaactaatttttgagatagacatgtgggactaaatttcgagatatacgcgtaggagtttctactataaaagtagaaagtttttt

SEQ ID NO: 282 - DNA, 2609 bp, Zea mays
caggttttctcttgggagccaataagatgccatgatactgtggacgtgggatggtctagacttgccgatttgaatgtccatgagggaaaacttcttggttgttctttcaatcaaagttgtgttggaatatgggttgttgatctgacgcgtcttgagccatatacaatgggtacttcaacaaaagtaaatggtcattctgaattgaagactgtttctagcggcactttgcctttacaaaatgatagtggttcaagggctaacatagggcgatcatcagtcttgcaaaatacagagaacaaccttaaaactacttcaggaagactgtcggcttcacagaactcagattctgcacccaaagaaactaactcggcaccttcaagcgggttgatcccaagcacaccacatagggctggagttggctcccataatagatctgttggaaattcagcttttcaatctggtggtaccaccttgaagagaagttcgttgaggaataacagtgcctctaatgttcacaatttcagtaaagctgatgtagtgcctgtcattgttcccagaactagctcaggaggggagttggctactgattctagaagcgatgctgctgatgtggcacccgttcttccgaaggtaaccagaagggttgaacctgctaccgattctagaaaagaaagtaatgatgtggaacttgttgttcctagagcaagctcaagaatggaaatagccgatttagcacccatttctagttccaagtcaggcagaaggttggagtctgcccctgattcgaaagaagaaagtgctgatacagcacctgttgttgtttccaatcccagggctaatgtaagaatggaaatagtctctgattctgcgcccgctctttcaaagtcaaacagaaagctagattctggcactaactcaaagaaagaaagtgctgatgcagtcattgtacccagaacaaattctagaatggaaatgatttctgattctaggagagaaccctctgctggaagaatatcaccattcagaatccagtcaagatatgctgagccacggaagctagcccatgccagaactgattcaaacaaagttgatagcagaagtaaaattactgaaacagaagacttcaattgccaaatatttcttccccgtagaaacagtgtttttcaaacaataagttctgaagaacctcgtgaagatgtaaagtgtggtccagttgacagggtgggattttcaaattcatcagaaccaaatgcgagtgtccgcaatgagaattatgttcctagaatgcgcaaaccaggagacaactgctatatcgaagtttcaagagcaggaagagcaaggtcaagtgtctctaattgggaagggagggatcagccccctagtcatgaagaaccaacaacaagcagttctacactggctcctaccggccatccatattcatctagaggaagcaatcaagcttctgaagctccaatcatagctagtgatgaagatgttctatctcttatcatggagcgacatgatctatttttaagctcaactaagtctcggctgatgaaattgcagattattcatcaaatgtgggaaagaaatgacatcaggggtgtgctctctgcgatggacaggatgggtgatcatgctgtctgtgctgatatggctagcgttctcatggagaaaagtgaaacaatcacactagatttatgtacctctatcctgcctgtcgtcaccgatcttctggagagcaaaattgacagacacttagtcgtcgcattggaattgttggtgaagcttgtaaggacttttggtccaatgatacattcaacagtatcgtcaggtccttgtgttggtgtagaccttgaggcagagcaaaggagggagcgctgcaacttatgcttcatcgaattggagaaggccaaaaataagcttccatctctaacaagaagaaaaggggcggttgcaaatgctgcacaagaacttgctcttgtcttccaggaaatcatgagttgactgacgacacactagatatacacaattagatgggacatgcttcggcctctgatggcaacaagattggatatcagctgccatggagggtgctagctattcagtcttagcgacgtcatcaagctccaaggccacagcaccaacaaatgcattttgttgctgctgttcgtgccttttgtacacatgctaacacataatccatgtcatttgtgaagagaagctgccatggacagtgacttcatccacaatattatgtggatggcggcagctggagatgttaggccccgatcgaatggtgatcagcagatgagacttgcttgggcttttctggcactcgtagttctttgctgtctgtaacatctttctcatgtatcgttatcatgtgcatgtgcaacagtcaagtggttgcatttggtagtttatggttgtgctgtgtgttggtcgatttagtggtcgttgatgagtgaagcgagccatgtacatcatttttttttaagatttgatatcttctttttccttgatgactcctctcgttatacttgagtgaaaatgatatcttgtgtacttgccttgacagcttttcggaaattcccttttgtctggca

SEQ ID NO: 283 - DNA, 2110 bp, Zea mays
gtgacttcaagaagagtgaaggacaaatggtccataagatctgctcctaggtcctctagtgcagttttgctgtatgaagttaatgtgataccaagatttaacttcccggctatatttcttgaaaggattataaggtcagatcttcctgtaaatcttcgtgccttggcttgtagagctgaaaagatttatctggaaaatcaaggatgtggttcaagaaaattttttgttgaggacttgaagccatcatatacttctcagcttaataacttccatagtacgacagttgagacttctaagtttaaacaagcacctcccaggtctggtgttagcagtgtgcttccttcaccttcttctgaattgattagcaaatggggtgtatatggaaacatatgcagaattgataagccttgtgtggtagatgagatccatcttcgaagatttgatggcatgttggaacatgagggggctcataggtgtgtttttgctagtatcactgtgaaagcaccggttcgagaggtatggaatgttctcacagcatatgagaatttgcctgaattcgtaccaaacctggctatcagtaggattgttcttcgtgataataacaaggttcggataatgcaggagggttgcaaaggcctgctttatatggtccttcacgcccgtgttgttatggatcttcgcgaaaaacatgagcaagagatcagctttgaacaagtcgagggtgatttttacacatttaaagggaaatggcgcttagaacaacttggggatcagcacaccctgttgaagtacatggttgaaactaagatgcatagggacacctttctctctgaatctatccttgaagaggtcatatatgaagatcttccatcaaacttgtgtgcaatccgtgattatattgaaaaggctggagccaagagtagcaattccacaggtcattctaatgtgcccacagatccagatccagatgttgatcatgatgaaagcaggcaatctgagcaaacgtgtgtgtcttgctcatccagtaccatgaagcagagaccaaaagtcccaggattgcaaaaggacatcgaggtcctaaaatcagagcttgataatttcattgcagagtatggtcagtatggtttcatgcctaagagaaagcatctccggtctcatggaagagtggatattgagaaggctataacaagaatgggtgggttccggaagattgccagcataatgaacctttctctttcttacaaaaatcgaaaaccaagaggctattgggataatctggagaacttgcaagaagagatcagccggttccagaaaatttgggggttggatccttcttatatgcccagtagaaaatcttttgagagggcaggtcgttatgacattgctcgggcattggaaaaatggggtggggtgcaggaggtttcacgccttctttctcttgaactaagatatcctagaagacaagcagacccggacgatgagagacagtctgaatccccgtctgggatgatgaagaagcacggagtgaaacctgatgaaggcaatgtttccccaaatgcgcagaaatggctcctgaagctgaaggacttggatgtcaattgggtggaatactaggtttagctttggaaaaagatatggtctctcatcatgaactcagctctttcctttcttcggaggtgttctggatgcattccgacaaagacgccgcagattgtgtacagaacagcgcggtgcacgggccaaccccattctgaaggcgagctaccagcaggcaacatgttttcttgccagtaatcacgactcttggctactactgcgtatctagaactgctgacaatactactcagcttcttttgcggtcaaaccgatccatggttttgacaaagtcaggccataaaatgcagaaaagggtgtcgatttcgtgcgcctgttcaaagctgttttgagtcagccacgcctttgaaaaatctgaggtgttcacaggttggtcgcctactttgttattactggtgatataagttgacctggtccttttgaaagagaaggtttacccgtctaaataaaataacaagaatatggatttttattgaagtcaaaaaaaaaaaggaaa

SEQ ID NO: 284 - DNA, 574 bp, Zea mays
aaatgggcgcgctctgcctgctctacccatccacgccgccgcgctgcccatgcggcgcccgcgcggacgcgaccgcggccttcgcgccttcccctttcctctcatcatgtgctgccaccggtgcacaaacaaggctgcagctctgcggcaggagccagaggcgcggcggcgtggcgcgggtaggtggcggcggcggtgggggcaagggggagagtggcaagaacggcgcggcggcgttctttgatgaggacggggtggtggacgacatggacgggtacctcaactacctgtccctcgagtacgactctgtctgggacaccaagcctgcctggtgtcagccttggacaatattgcttacgggaactggtgccgttgcctgtagttgggtgcttatccaatctgttgtaattactgctggggtttcttttgtaatatccgcatggtggtacatatttctctactcgtaccctaaggcatacaccgagatgatagcagagagaagaagaaatgtagccagtggagctgaagatacctacgggatggagaaaatccagtgaggatctacggcggcgct

SEQ ID NO: 285 - DNA, 219 bp, Zea mays
ctgtgcgtagtccagggccgctctggagcgcatatgaccggaggatggctccaaatcttcgttggggtcatcgggggaatccggaatcgctcgacatggcaaagtccgccgcccccgtccactttcaaacatggctagacacattcaacgtcttcaccatcgcgcgaggacacgtgtcatctgaaaagcaagttggtacctggaatctcaagtgccagg

SEQ ID NO: 286 - DNA, 1280 bp, Oryza sativa
ggatgcccccctcgccgcacgggatccagaaatttgctccacgtagaacgccacgcacgcacgcgagtcgttacggctacgaatcctctttcgtgtaggcttccccttctccatcctcttttctcatcaaacctatttgtacgcgcaccacccgttcgccgccggcgcaacccgcgcctcgccgcgaaccgaacccgtgcgctctcgctctggttgattagttgccatcgccaccaccaatccggcgttgtctcggagatttgtctaggcgttcgcggcggttcgatcggcggatggcggcggcggcggtggcggcaccacccgtgagggggtactgccccgcggcggcgtcgacgtcgtcggtggcgagggtgcggatgccggcgtcgttcgtgagcgcgccgcggcgggtttcggtgcggctccgcgcggcggcggtggcggaggtgccccgagggctgcagctccggcgggaggaggagcgggggttggggttcttcggaggcgtgtttggtggggaggaggaggaggtggtggagaaggttggggaggagagggtggaggggtggatgagggagtcgatcgcagagatcgtgcggcacatcggggaggcgccgttcctggtgcacctgttcaacgacgacgacggcggcagcgggcggggaggcgcggggcgcgtgacggtgcggcgggagacggcgtcggcggagagctggcccgacgtgcggcggcggtggggcccgggcgggatgcggcgtcccgacggaatcatactggtcgagcagatcgccgcggcggtcgaggagggcggcgcgtccgccggcgccggcgccgccgaggcggcgcggcaggtgtggggcctggtggtgcaggcccgcgggatggagtgcgcgtcgtgctacgtgctcgacacctgccgcgtccgctccccggcggggctctgcacccacttctgcctcgccagggcgcagtgcttcggcgaccccctcgagctccagctccgcaacgcctggctcaaccgcctctccggccgccggtagccaccgccgccgccgccgccgcggcgtactaatgtactaaagctaccggccttgatgcgtccgattcttgctgtgaagaagagcaaacgaagcgtgcagattgcaacggaagaacatattcagattctttctttgttttctttcgttccggtttctcccaaatgcggatttgtacagattattggttgcgaatttgcaatttgctacctcgattattccaacgaggagcgattcatcctg

SEQ ID NO: 287 - DNA, 1119 bp, Oryza sativa
ctgtaccacaagttcgtcagcttcgcgctggaggagacccgactccggaccaccctcacccctcacccctcccaggaaaagttcaagtctataaaacccaatgatgataatacagttttcaatgctctctcattcagtgcaccgaaaattagattgcttcgcagcttgacaatcgagaagaaaaactcatatcaggttcttgactttgccgctttctctgaacctgaatacgatcttcctatattttgcgccaacgtttttacaactcatgcacaaagtattgttgtattggacctcaatcctctatatgatactacagtgcacaaggattacaaagataagtactataggagtataatgcctcttgtacacaagtataacgagcttcttccttggggtggcaagattacgagtgagtcattgaagttcttctctccaattgtgatctggacaatatttgagtcaactgaacacaaccaccatgttctacattcagctttcgtggattattataaggtctggcttgaattaatggaccaagcaattaaagaaaataacaaagcaacaattgctcgtaaccaagaagaacaacataaatatctcacatggagggctgagaaggatcctggctatccccttttgaagaagttaattggtgaaagtcgtgccgaggatctggtgatggagtttctgtttgaaggagtaaatactcttggaacaaaatcatttctggattatttccctgaatacgcccgtgatgatgggtcagtgaacaagaaaaggagtatgatcggcaagtcttttgaaactaggccttgggacgccaatggagaattcattggcgatgccgaagcacagtaaaatgttcgctacgcctttcggcctgatcaatctctcttatgcttgtagtactgttttctttttttttagaaaacttacatttttcatgctcatatccctgaacttggattgaataagaagagattggtgaatctgagtcatgtattattgttctccggttgcactgattgtcgttgttagacgatggtctctgctcctggtagtagacatgatctgaaacaagaggggtcatcctgccctgcccggattaggatcctc

SEQ ID NO: 288 - DNA, 656 bp, Oryza sativa
gccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccggtccaggagatggaggcggcttacaagttcgggccgtacaagatcgacgcgagggaggtgttccactccacgccgctgtcctacgccatggtcaacctccgcccactcctccctggtcatgttctagtgtgccccaagcgtgaagtgaaacgatttgctgatctaagttctaatgagattagtgacttatgggttaccgcaaaggaagttggtatacggcttgaacagtaccacaaagcgtcttcacttacatttgctattcaggatggtccacaagctggtcaaactgttccacatgtccacatccatgtcatccctagaaggaaaggagattttgagaaaaatgatgagatatatgatgcggtttgtggcatattcctcaatcgacctccttttatccaatacttgaacccaatatttaccacaaaattcttactcagttgctttctaatagattgatgtcaaagagagggaattg

SEQ ID NO: 289 - DNA, 1910 bp, Sorghum bicolor
gcaggtgccaaacacagagaatcaaacgctccgcagcgaattcaattttgaaagccccagagagcttccatggcttccgctaccacctccatctcatcgcaccctgccgccctccgcgatgtcgtccaagctgcgaggattggcgcgctgaggcagcaggtgggcgtggccccggcggcggcgcgcggccagcgcgctcgcgcggtgcgcccgctgcgcgcggcggagcccgcgaggcagccggtggcggcctccgcggccgcggcggcgccggccgcgcccatggccgacgaggctgcggcggccctcgcggcggtggactacgaggccctggcgcgtgagctggatggcgcgtcgccgctggagatcatggatcgggcgctggccatgttcggctccgaaatcgccatcgccttcagcggtgctgaggacgtggcgctgatcgagtacgccaagctgacggggcgtccgttccgggtgttcagcctggacacgggtcgtctcaacccggagacgtaccagttcttcgaccaggtggagaagcactacggcatccgcatcgagtacatgttcccggacgcgagcgaggtgcaggagctggtgcgcaccaagggcctcttctccttctacgacgacggccaccaggagtgctgccgggtgcgcaaggtgcggcccctgcgcagggcgctcaaggggctcagggcatggatcaccggccagaggaaggaccagtcccccggcaccagggccagcatccccctggtccaggtcgacccttccttcgaaggcctggatggcggagctggtagcttgatcaagtggaaccctgtggccaacgtcgacggcaaggacatctggacgttcctaaggaccatggacgtccctgtcaacaccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggaaacatcgagaaggacggccaggcggcggcccccaggtccgccaacggcaacggctcggcgggcgccccggacatcttcgagagccccgccgtggtgtccctcacccgcgccgggatcgagaacctgctgcgcctggagaaccgcgccgagccgtggctcgtggtgctgtacgcgccctggtgccccttctgccaggccatggaggcctcctacgtggagctggccgagaagctggcgggctccggcgtcaaggtggccaagttccgcgccgacggcgagcagaagccgttcgcgcaggccgagctgcagctgcagagcttccccaccgtgctcctgttcccgagccgcacccccaggcccatcaagtacccgtcggagaagagggacgtcgactcgctcctcgccttcgtcaacagcctccggtgaggccgccagtgagcgagaaccatcgttctctgtcagtatgtacttgtaccgtgttatgttggcgtccatcttaggtgctgtatgtagagactagagagggagatgggagggaattgggatgatagaaacacatggaggggattcaggaaaaaaaaacagatgcaggttatccagacaaaaaaaaatccagatgcaggcgttgcatgtttagtttatgtaactgcagaaggagtctgaggtcctgtgttatttgggagctgagaggaagaggttatttgtgtgtgcttatagctagtggcgagtggccatagagtattggaaggaaaatcaaataagataatcaaataagaatcgaagttctgagagttcttgtttgttcatgttggttgtcaactatgtagacagtacaaagcgaaggttttgcataatttatttatttagagtttgtgcgtcgcttc

SEQ ID NO: 290 - DNA, 735 bp, Sorghum bicolor
cgccgccaccgcccaccgtctcctgatccaatggcgcgcatccacctcgtagccgtggcaatggccatgctcttagccgtcgcgacggcgcaggcaccaggcgcgtcgccgacgccggcgcccagggcgcagcctccggcgaccccgccgccggggccggcaccagccccggccccggctccggcgcccaaggccacggcacccgccccggagatccccgcctcgccgccggcgccgagctcgatcgggcagacgccaacggaggccccgacgtcccctccgcctcccagcgacgcgtccagcgtctcccccgccttgttcctggccgccggcgccgctgtggcgtttttcttctgaggtcggtgggtgggccggccggccggcgccgatggatccgcatccgcctgtgttgtgagtgtgacacgatggctctcgctacttgtatttgttggccgcgtcgtcgttgcattgcattcgggtttattactagcatagcatagcatactactgctttcctagctgggttcgatctgtgcgtgcgtggtgagtgagagagattgatgagtcgagagacagacagttgctatgtgggttgggatgccattgtataatccctcgtttttttttaccgtattctttgtttcgtctacatacagatctgctctgcttgctcgctaggagtattatttatcttatttcttattatatatatataagttattattattattgata

SEQ ID NO: 291 - DNA, 1988 bp, Sorghum bicolor
cctcctctgcatgcctcaacaacccgtctccaagaaaccacctcccctcgctccaatcccaatccaaatccttcgccacgaaccaatagaacccaatccgatcagttccccccacgcaatttcccatctgagtttcatctctttctttttcaccgataataaagatccgatcgatcggagtccggcggcagctaattcaccggcgggattggagatgaaggtcgacagggaaatggagattctgctcaacgagatccccctcctccaccacggtggcctcctcggcggcagcggcgaggctggtgcggacgacgacgccgacctctctttcctcatccacgaactcgccgcgatgggcgtcgtggacggcgacgacgagccaccggcgccgggcgctgccaacggcttcggcttctccagcatgatgatttaccccaagaaaggcggcgagaatctggtatccctgcacccgttctccatggccggccactgcgcgcacatgccgtctctgtttgatcccgtcaccttcgctgccgccgacggctgggacatccggtgctccccgccgccttctgtttctgtgtcgccaccgcccgccacgccgagggcccggtgcaagaacgtgaggaggaagaacggcggctgcggcgcggtgacggcgacgagccccaagaagtgcggagccgcggcggcggcggcggcggcggcggccaacaagtcgcacggcgagagcctggccggcctgcgcggggtcatgtcccacatcgcgcgcgaccagcacgggtgccggctgctgcagcagaggctcgacgacggcaagcgcgaggtcgaccacatcttcgccggcgtgtcgcgccacgccgcgcagctgatggtggacccgttcgggaactacctcatgcagaagctgctcgccgtctgcgacgccgggcagaggatggcgctcgtgctcaccctcaccgctgacgccttcgtcctcgtcaggatatccctcaacgtccatgggacacgggcagtgcagaagctgattgagagcctgaggacaagggaagagattagtcttgtcatcgatgctctgcgcccggggttcttggagctcatcaaggatcctaatggcaatcatgtcgtgcaaaagtgtttgcaggcgtttgaagccgacgataacaaggcgatatttgatgctgctgcactccactgtctcgatatcgggatgcaatgccacggttgctgtgtcctacagcggtgcattgcacgatcgcgtggtgagcacagggacaagctggttgctgccattgctggcaatggattcaaacttgcccaagatgcatatgggaactatgttgttcagtatgtaatagacttgaagataccaaatgcaaattcaagtcttgcacaacagtttgaaggcaagtatatccacctgtccatgcagaaattcagtagcaatgttgttgagaaatgcctgaaagtcttcaaggaggttgacaaggccaagatcatactagaaatcctcgccacgccacacttggagcaattgcttcagcacccttatgcaaactatgtcatctactctgctctccagaattccaagggttcacttcattctgcactgacaaatgcaatccgacctcatgtggaactgcttaggaccagtccatactgcaagaggatatactctcgagctttgctgaagaaatgatgagttgatgacaggttttcagcttgtaacaagaacgattgctctcttgtgatatttgtttttttcagtttcaaaaggcataaagatgatcacaaaatagatctgtataaattagtattctttggtcatgtacttctacttgtacctgtaattgatgcacggcttgtgcctggtgctgcatgatcatctgggacagaataaaattcaatcgaaagtattctacaaactatttcatatatatgtaatgttttacgttgtttatggctgcaaagatattgctgttgttacc

SEQ ID NO: 292 - DNA, 1292 bp, Sorghum bicolor
ctgcgggcaccgggccaccagggcaccatggcgtccaccgcgcgtgctctgggggcgctcctccacagggcctcgttcctgtcctcctccgcttccgctctccggggagcgtcgctcctccgcggggatcgacctattggcctgttccggaggcatgcggcgaggcggcggatttcgtcattccagccgctctgcatgggacgacgctcctgcaaaatcgctggaaggaaggatgcccagaatttgaagaagatgaagcgcaacagcaaaattggaaaagaaattgttgcagccatcaagaagggtggcccaaatccttcatccaacacaactttagcagctatactggagaaagcaagggaacttgatgtccctaatgaaattttggagcgcaacatcaaaagggcatcagaaaaaggacaagatacttacactgaaaaggtttatgaggtctatggttttggtggagtaggtatggtcgttgaagttctaactgacaaaattacaagatcagttgctgacattagaaatgtggtaaaagactgcggagcaaaattggctgatcctggatctgttacttttagattcagacaagctcgagtggtgaacataaaagttactgatgcagataaggaccaactgctcaccattgcgttagatgctggtgctgatgacgtccttgaaccaaattttgatgatgacgactctgaagaagaagcagaaaggttctacaagatagttactacatcagaaaactatccagttgtgctatctaagctacaagaagaaggattgaagtttgaaactgataatggctacgaacttcttcctctgaacccaattgaggtcgacgacgaggccatggaactaaacaaggaacttgtttcaaaattgctagagcttgatgacgttgacgccgtctacgcagaccaaaaatgagtgaactcatgagctacagctctcaattcaagacacgcttagcccatgggtctttgttggagtatatttactttacattgataggaaaaaaaattgataggtctgcttatgatgcctggttacattggttctaagttcccaaaaacttgagttagtgatctagcatttttttaagacagatcagtttataccttgggtttttgcccagcccatcctgttgggaaacttatcagcgtctgctatattctcagaaagcagatctgagatgtgagaagccattataaaataatacgatgatgcctatcaatttgttggtatttggtaaagcgttgaaatgaaaatgctttggctct

SEQ ID NO: 293 - DNA, 535 bp, Sorghum bicolor
cagccagctcacgcacacaacacagctcacgaccagcgacagagcaagcaagaaagcaagcaagcggagcaatggagtactggtacccctgcaacggcagcagcggctgcagcaaggagaagaggccgccgctcaagaggggccagctcaaactgcagatcgccaggaccctgctcggcagcctcgcggcgccggtcgccaagaaccgggatcgcggcttcgggagttaatcagtggtaggaggagtagagtagagtagctcatgccgtcgagggggtgcttgtaatagggaatgtgcaatctgatgaattttcctctttagaacaggatgtgttggtgtcaagttttgccgcgttcgttcgttatccttgcgctcttgctcaccttcagcctcttggttggctcctgctagaacagagcaccaagcttaagagccctgttcttgaatgaagcaatgtaagtagagcgagaggactacagttccttgctcttcttgtctacagctaccaagttctaacagtctacagttctgcta

SEQ ID NO: 294 - DNA, 1217 bp, Sorghum bicolor
aatcattcattcattataatgataaaaaggtaagatttcagtgatataaataagtggcatgaatgaattccacctgattgaaacataactggatcaagaagtgcagtaaacgtggaaccaaaatttgaaatcatgtttgacattgtcgaggaagacttcacaatgagatttctttatgtgttctagttcagttatgaagatgggcaggagaggatgaacctggggttgccgatggacctaaggactggtaccgttgggtgagtctacttgctcagatcttgcggcacctgcaccagcgttcttttgtacaacagatcaaggtggaactatgtaaagcagatgcagtcgcaggctctacaaggacttctctggcatgtcgacacccaccacgaatcgttgttgatccgacacccactagtgaattgttgttgatccagtgagtcgggcggcgctttggctacaattgatcgatgaagatagaatcaggtgtggaactgtggaagaacccattgaaaaaaaaaaacctaaaaagaggagagaatatggatctcaccagagttcttagcgtggaggggatggctagactggtcagtttttgctatttcctgaccgtcaggcgccagtagaagctgttggtggccgtgtgatgatcgaagaccagacggcgcaggtcctgctcgggctggggaggtggcttggaaccgatgcgaaacttgtttagtatttcctcgcagagcaagaggagaggaggcagcatgaatttctgttgatcgtgatctggtgacgctgtgaagagggatcatggcgctgagcgatccagctccctgggaaacaaagtggagccacacggacgcagcccaacatggtcagtagctagggttgcaaagcagcggcgagggtcgagagacctgaggtggccgaaggaggcactggtagcgagaggcgcgacggctgcgtgaacgtgattcctatcaatcacgatatgttgcttgatttgttggaccaggtctggcgagggcgtcgggcgagggcgaggccgactccaggacgacgcacgagattgtgttttgtttccttattatctgtgaccataatttttgctacgtaggattggaaagtgttacggtgatgaaattttatatcaggaatcctttatttttctttatttcatttcgtacccttccacaatatattattccctatcgtaaatttacatc

SEQ ID NO: 295 - DNA, 1912 bp, Sorghum bicolor
gcgctggctttgccgtagcccgtggggtctttgggcttttggccatttcggcccaattctcgttggcttcccttcttccccttcccccgaaaccctcgctctcgggcagcccgcacaaagccgccggagcgccgcgccaccatgtaccggcttctcctccgccgcttctccacggctgccgagggtgccgccgccgcctctccttctccctctccctctccatccccctccacctccatgtccccgaccctgcggcaacctctgccggacaacctgtaccgccgcatcatgaatgtcgggcgcccatccatcccgctatcccccgtcctcaagcaatgggatcaagaaggccataccgtcaagaagttcgtcatccaggccatcgtcaagaagctcgtcggcctccgccgcttcgcccacgcactcgagctgtcgttctggatgaccgaccggaggcacctccacctgacggccggtgacgtcgcgtaccggctggacctaatcagcaaggtgcacggccttgagaaagctgtcgagtactttggcatggtgccgaagcggctgaggatgccgcagtgctacggctccctcctgaaatgctatgtggaggcaaaggccgtcgacaaggctgaggagcacttcgcgaagatgcaggagatggggatgaagagttcttatacatacacttcgatgatgaagctttacttagagactgggcagcttgaaagggtgcacgccatgttccaggacatggaagagaaaggtgtgaaacctgatacgttcagtgtggagagtatgttagctgcgtacattgctgctgaagatgtcgagggggttggtaaggtgctcgacaaggccaatccacatgaaaagcttgtgaagtggcatggacaagctttggcagcgagcttgttcatgaaatctgggatgcaggtgagagctgtcatggctctcctggaagccgagaggcggatatccccaaagagtagtaggatcgcatacgctttcttactgaagacatatactgatctggggatgtatcctgaggttggacgaatttggagtgtctacaaatccaaagtgccaccatccaacacgatgtacttgtcgaggataagtgcgttactcaagatgaatgacattgatggggcggaagcaacattgaaagagtgggaaacagtgtctcttcgttatcatgatttcagattaatcaacttgatggttgatgcttattgcagagaaggtcttgtggagaaggcagtagctcttgtggatgacgccatcaagaaagggaggacaccttatgctaatacttggtataagttggctggtgggttttttaaaaccggtgaggtatcaaaagcagtggacatgacaaggaaggctcttgaatctgcgactcctccatggaaacctgacctaacaaatgtgctaatgagcctggagcacttcatgaatcaaaaggatgtagaagcagctgaggagattgcgagtatgctacagaagctgggtcctttgactaaggaggtttaccattgtttactgaagacctatgtccgtgcgggaaagccagtgtccgatttgctcgagcgtatgaagaaagatggccttgaggctgacgaggaaacagagagaatgcgagtagatttgcacccgttgtcgatcactaaataatccattttctctgttcatgtgttccttctttgttcttgagctcttctcattagcttgacacgtggccactactcctttcttgtatgtggtggcctcacagggcagtggtaatgtgtgacagtgttaagaaagcattgaaagagtgggaaacagtgactcttttcttttgtggtttcaaatttgtgaaattagtgatgaatgcttgctgcagagtcttctagaaaaccagtaactcctg

SEQ ID NO: 296 - DNA, 2079 bp, Sorghum bicolor
cgaggaagcaagagggaaaaagaaaaaaaagaaaaatcttggatgaggcattatccgtgaccacatatcgctggaccacgacctcctgaccaactgtcagcattcctcacaaagcaatcgccaagaacatcaacgtctgttcctgaaaatcgatatcaaaaatctaccaccggtccaccgctccggccgagatccatgctcgcagccaccccttcccggtccactgatccgatggccgccacggcggccttgagcttccacccggccgccttctcagtctcagctcacccacgagaggcagcagcagcgacgacgaagcagccgctccgccattgctcacctctcaggagcgtcgtccctagaagaacttgccttctcagggccaggtcctccaatgggcgcccgcagatcagtgcctcgttcggcaacagcaatgaggtgctagatgggatgccaacaggagatggtccaccggcaccggggcagggagggagcaccgtcagcatcaccgtcgttggcgcctccggcgaccttgccaagaagaagatcttcccggccctcttcgccttgttctacgaggactgccttccggagcattttacagtgtttggttatgcccgtagcaagatgagcgatgaggagctcaggaacatgatcagcacgactctgacgtgtcgaatcgacaaaagggagaactgcggcgacaagatggaacagtttctgaagaggtgcttctaccagtctgggcaatacaactcagaggaggggtttgctgagttagacagaaagcttaaagaaaaagaggcaggtaggctaccaaacaggctattttacctatcgatcccgccaaacatatttgtggatgttgtaagatccgctagccgcaccgcgtcatcttcaagcgggtggacgagatttatagtggagaagccattcggccgcgactcggagtcctcaggcgagctcactcggtccttgaagaagatcgaccattatctgggcaaggaactagttgagaatctctccgtcctccgcttctccaacctcgtcttcgagccgctgtggtcgaggaattacatccggaatgtgcagttcatcttctctgaagatttcggcaccgagggtcgaggcggctacttcgacaactacggcatcatccgggacatcatgcagaaccacctggtgcagatcctggccctgttcgccatggagaccccggtgagcctggacgccgaggacatccgcaacgagaaggtgaaggtgctgcggtcgatgcggcagctgaagctggaggacgtggtggtggggcagtacaagggccactccaagggcggcaggtcctacccgggctacgccgacgaccccaccgtgcccaagggcagcgtcacgcccaccttcgccgccgccgcgctcttcatcgacaacgcgcgctgggacggcgtgccgttcctcatgaaggccggcaaggcgctgcacacacgacgcgcggagatccgggtgcagttccggcgcgtgccggggaacctgtaccggcggaacatcggcacggacctggacaaggcgaccaacgagctggtgctccgggtgcagcccgacgaggccatctacctcaagatcaacaacaaggtgccggggctgggcatgcgcctcgaccgcagcaacctcaacctgctctactccgagcgctaccgccgcgagatcccggacgcgtacgagcgcctgctgctggacgccatggagggcgagcgccgcctcttcatccggagcgacgagctcgacgcagcctgggccatcttcacgcccgtgctcagggagctggaggacaggaaggtggcgccggagctctacccctacggcagcaggggccccgtcggcgcgcactacctcgccgccaactacaacgtcaggtggggagacatcaccagcgatgacgccgccttctagttccatccatttacgactccgagtacaagttgattttttttgttcgtgtacccaactagtaattggtccatcctgtaaattccaaagaacgcggtccatcgatttagcctgttcgcttgattgaaaagccatgcc

SEQ ID NO: 297 - DNA, 1449 bp, Sorghum bicolor
gggggggcattcttgagcttaacttctttgtgaaattagatattcaggcagggaagattgagtatggatgttctcacttatttatgcttgcaattgcgatttgcaatgcttgtaaaacccacccagatggagcagaagggtggcggccctggagcacgaagctcccactccatcactctggtggggcacacggcctactcattcggcggcgagttcaccccgcgcgtgccggtggacaacaccatgtacgcgttcgacctcggcacccagacctggtccgccctcgacgacgccacgggcgacgtgcccccgccgcgcgtcggggtgaccatggcggccgtgggcggcacggtgtacacgttcggcgggcgggacctggagcacaaggagctgaacgagctctacgccttcgacacggcgacgcgggcgtggacgctcctgtcctcctccggcggcgggccgccgcaccggagctaccactccatggtggcggacgcggagggagggcgggtgtacgtgttcggcgggtgcggcgacgccgggcgcctgaacgacctgtgggcgtacgacgtggcgagtgggaggtgggaggagctgccgtcgccgggggaggcgtgccgcccgcgcggcgggccggggctggcagtcgccggcgggaaggtgtgggtggtgtacgggttctccggcgaggagatggacgacgtgcactgctacgacccggcgacacgggcgtgggctgtggtggagaccacgggcgacaggccgagcccacggagcgtgttctgcggcgccgggatcgggcggcacgtcgtggtgtttggcggcgaggtggatcccagcgacctcggacacctcggcgccggcaagttctcggccgaggcgttcgcgctcgacacggagacccgcgcgtggacgcggctggtggacgacgacgacaaggcggaggcggaggcggagcagcagcagcaccccgggccacgcgggtggtgcgcgttcgcggcgggggagaaggatggccggcaagggctgctggtgtatggcggcaactcgccgaccaacgaccggctcgacgacatctacttcttcgcgcccgttcttgaagctgcggccgcaagctagcgcgcgcgtctggcaaactggcagtggtgaaatgtgtagcagtgcaatctgcagggcttgtatgtatgtatgtatgtatgttgtggtgaattgtgagtttgtgacgcatcatctttgcggacgtctagttttcttgctgttttcctttggtcggtttgtgggttttatgttgcgtgattgtattgaaacgggcgactgacagtaacgttatagacgtagagtgtacacacgcattgaaaggggaggcgagtgcatgtacgtatatacgtattgtgaaacccaatgaaaataaattaataaaatgttctgaaatgtcactttgtaagatca

SEQ ID NO: 298 - DNA, 2049 bp, Sorghum bicolor
cgaacctcgagatagctggtggcgtcggagggaggcgcgagctcgcagaaggagacgaggcccgagatgagatctgagtcgaactccagcgagctgcccttacgctcccgaagttcctgcaaggcgcccttcagccactcgccggacgtgctcgccgacgtcgccatcgccgccgccgacgccgccaacaaaagggccggacaagaagggttaacttcttttttgctattcggaccctcgatctataggatatttcacgaatagtacttctacatttacatcttctatttttcaccttgtagtgtgcgtgattttcgaaagactcctcatcttatccccgcgagccgcgagacagacttcaccgtggtacgccgtacgcggcttctcttcagtctgagcattcgcagagcagagagtgtagaaggcatgtttccgatggcgtcttcctcactatcgccgccgccgctctcacttatcctcctccggccgctcccgtgcagacccgtcctcctctcgaggcaaaggaagccatttccaactgtccgcgtagaagcaaggcctgagcagcggttgcagcggcggccggtgaccggccggtggaggaggggcggaggcttcgcgtgtttctcctacaatgccaataacaagacgcccccgccatcagataagagttcagacaagtgggcgatccttcgccgatgggatgtgccatgggagtggcaaaccgttgtgctcagcatggtaggctgtggagtaagctttgttctgacaggattggttgagcaatcggctttgcaatacctgggatttaaagctgtggaggcaactatagatgagaaggcagaaatactcttttttgggcaactgagcgtgacagtagtagtccttggcgttatatttagcatcaccaacacttttcgaccattcccagatgatatgtttcgttatgatattaaagaaccattcaagctgcagaatggatggcttttgtgggctggagttggcctctttggagcaataatttctattgctttagccggagctgctatgacttatctgaatggtgaaactccagagagagagactgattcactagtccttttgttgcccctgattggctcatccactaccagcactgcctttttggtgggaatcactggagttctagcaccacttctcgaggagactctgtttcgaggatttctaatggtgtccttgactaagtggtttcctactccattttgtgtacttgtgagtgctgctgtatttgcccttgctcatctgactcctggacaatttccacagctgtttatacttggtaattctctacagtctattcagatataactaaatagaaaactatatgaattcaatttttgttaatggtgccctaatgcaccgcaatgcagaaaccatcataatttccatgtgcattaattactctgccacttaaacattttgatgatgtggaaagcgatttaatgaggacagaggaggaaatgattttgataagaaactatacctacacgggaaccatgaagagatgtgataggtagatgagggagaaagaagacatgattggacaaaagattactctgcagaaactatccattggtgttgcattgggtttttcatatgctcagacccgcaatcttctaactccgatcacaatacatgcattttggaactcaggagtaatacttctgctaacctttcttcagctgcaaggatatgatctcaaggagctcttgggagcatcgtgaaggtttgaacaaaccagacattttgtgcataatatgatatgaagtagatctatcgggtatgtgctcttgcacacctgatgccagcaaaaccacgtgaaaaagaaatatgagtcttcaagttagctgatggttgcgtttccagaagtgttacgaggcatcactagtctgtaaaactgtttatactataagatggcagattggccttaatgtaagaacagctgtcctttttgagagtgtttcttacaactggagtactcaattaaattttgctgatattgtttattaa

SEQ ID NO: 299 - DNA, 2881 bp, Sorghum bicolor
ccggaatccccgccgcggaggaggctgctgtgttatattgggggtggctctagcctctaggattggaggggctctggttggttgcctagacgttcgccgccgcctctcccctgccccgaccgcgaggctccgtcgccggcgatggcgtcgccggccggcggcgggtctccggctaagcccgtcctcctgcacggcgacctcgacctctggatcctcgaggcgcgcctgctgcccaacatggacatgttctccgagcatgtccgccgctgcctcgccgcatgccgcccgcccagctcctgcgggaccaagcacccgaccgccgccgcgcgcggccccggcggcggccgcggcggccgccaccaccaccggaagatcatcaccagcgacccctacgtcacgctgtccgtgtccggcgccgtcgtggcgcgcaccgccgtcatccccaactcccaggaccccgtctgggaggagcgcttcgccgtgccgctcgcgcaccgcgccgccgagctcgagttccaggtcaaggacaacgacaccttcggcgcgcaggccatcggcaccgtcaccgtccccgccgaacgcgtcgtgtcgggcgacgaggtcgaggactggttccccgtcataggcaccaacggcaagccgtacaaacccgacaccgcgctgcgcctccgcttcaagttccagcccatcgccaacaacccggcctaccgccacggcatcgccggcgaccctgaccacaggggcatcgaggactcctacttcccgctccgccacggcggccaagtcacgctgtaccaggacgcgcacgtcagggaaggggacctgcccgagattgagctcgacgacggcaagacgttccagcacaacgcgtgctgggaggacatctgccacgccatcctagaggcgcaccacatgatatatatcgtcggctggtcggtgtacgataaggtgcggctcgtacgcgagccatcgccgtcgcggccattgcctgagggtggcgaccttacgcttggcgacctgcttaagttcaagtcgcaggagggtgtcagagtgtgcctgctggtgtgggatgacaagacttcgcatgacaagttcttcatcaagacgggtggagttatggcaactcatgatgaagaaactcggaagtttttcaaacattcctcagtcatctgtgttctctctcctagatatgctagcaataagctgagcattttcaaacagcaggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcagcaggtgcaaagggacccaggcaaccatggcatgatttacattgcaggattgatggtcctgctgcctatgatgtcttgcttaattttgagcaaaggtggcgaaaggcaacaaaatggcgtgaccggtttagaagagtatctcattggaaagacgatgctttaattaagctggagcgtatatcatggattctaagcccttcacccaatgttccaaatgatcatcctagtttgtgggtttcaaaagaagaagatcatgaaaagtggcatgttcaggtatttcggtcaattgactctggttccctaaaaggatttcctagtgatagcaaagaagcttcaaagctgaatcttgtgtgccggaaaaacttggtaattgataagagcatccacactgcatacgtccgagcaatcagatctgcacagcatttcatttatattgaaaaccagtattttcttggttcttcatatgcttggccgtcctatgtgaattcaggtgctgataatctgataccaatagaactggccctcaaaattgcaagtaagattagagcgggagaacgctttgcagtgtatgtagtgataccaatgtggcctgaaggagtccctactgcagcatctgtgcaagaaatccttttctttcagacaatggagatgatgtataaaataattgcagatgagctcaaggcaatggacattaaggatatgcaacttgaagattacttgaacttcttttgtcttggaaaccgggaagaaccaccatctaatggcagcccagaatcagagaaatctacagataaaagtgcagcgggcttagctacaaaatatcgacggttcatgatctatgttcacgcaaaagggatgattgtggatgatgaatatgtcattctgggttcagcaaacatcaaccagagatccctggctggttctagagatactgaaattgcaatgggtgcataccaacctcattatgcatggtctacaaagaatggacatcctcatggccaggtatacgggtatagaacgtctctctgggcagagcaccttggaacggttgatgatcgcttcaaggatccttcgagtttggagtgtgtaaggcgtgtgaatcaaatagctgtagagaactggcaaaggtttacagccgaagaaatgagtacattacaagggcacctcctcaagtacccagttaaggtggaggctgatggtaagatcagctcactgccagaccaagaatgctttcctgatgttggcggcaagattctgggagcttcaacttcacttcctgattcgctgaccatgtagagttattattacattttttttttcagagtcgagcttcgtaattgtctaaacttggtgcaattgtcactgaacttgtactgtatctgtaatcatccatagttggcgcagggaaagctcaaggtgtcggtggtgtttgtagagtcgtgctcctgtaagttttcccagc

SEQ ID NO: 300 - DNA, 2593 bp, Sorghum bicolor
tgatactggattttcttccttctcatacctgtagagggccctcctttatttgattagagctcatatggtctgaatgccacaattggaactttgcacctaaaaacagagaccaagttcactacttcattatatcctttcatacacagaaagtgaatagacatggaccgtgatgatatagctggtttcgtcagcggaggttgttatgagtcctgactttctaaccaagtatatataacagagttatgatatccagaaggcaggaaaatgtttcttttcattttctagttggtttgcatttgatgttatgcaattggaatggacacaactactggagacctcgagtttagtggtgatatcaacttcttgaagccatattgctcttggagcacaactcaagacacgactgtgcacaaagatagtacaccagaggcttattccagcctttttatttccaacccagaagcgtcaaaagggaagcaaggtgctatgtctagagcaaaaggtactggaaaccctttactcactttgggtttaggccgctcaccaagttcatctgataacagcaagctaagttctggcactgcttgcataacatcttcatctttattaaaggaaattgatgaggagtcttcagtagatcttggccttaaccttgggtttcatattggcaatgatattgcacactgccgacagaaatcccatgctagttttgaaaatatgctctcgacaaactctcctaaactggatcttcagttgagtttatctattggttcacctgaatcagttgtcatcgatgcaaatatgatgtcaccagatggcatggtgatgccgacgaccaatttgccacccgccactgtagaagaaggatcagtaccacctagttggggttttgagcattcgattgtttcatcatcatatgcttctgaagcaacatatgcccctgtgccttctcctgtcatgtcatcaactatgtttacaagtgtgaaaagtccagttgcctctacttttgagacaactaattcccaactacgcaacaataacacaaaaagctgtcagtttccaggatgtatgaaaggagcaagaggggcatcagggcgttgcatagcccatggcggtggtaagcgttgccacaaatctggttgtcagaagggcgctgaagggaggacaatctattgcaaggcccatggtggaggcaggagatgtcaatttcttgggtgtacaaagagtgctgaagggcgcacagaccactgcatagctcatggtggaggccgtcggtgcagtcatgaaggttgcccccgagctgctcgtggaaaatctggctcgtgtatcaagcatggtggtggcaaaaggtgtcagaaggagaactgtaccaaaagtgcagaaggtcattctggactctgcattgcccatggtggtggaaggcggtgccagtttccagactgcacaaagggtgctcaaggaagcacaaagttctgcaaggcacatggtggaggaaaacgctgcacattcttcggatgcaccagaggggctgaaggtagcacttcattttgtaagggccatggtggaggcaagcgctgcgcctttcagggtggtggtgtgtgcccaaagagtgtgcatggtggcactcagttttgtgttgcccatggtggtgggaaaagatgtgctagccatggctgcactaagagcgctagaggtcgtacagagtattgtgtgcgccatggaggtggcaagaggtgcaagtttgaaggctgcaccaagagtgcacaggggagcactgatttctgtaaggcccatgggggaggtaaacgatgttcatggggccaggcagacacaagctttggtgctggtgcacagcaatgcgatagatttgttcggagcaagactgatctatgctcagctcacagcgctttagtccaggaccactgtgttcatggcggtggtacattaggttctgctatctaccagtttgcggtggatgtcaaacctactgagatgaaggttgctttagtgaagggagatccacgcgagaagatcaacggtgataaaattttactggatccgggtagctctgttccaaatagtggtgttcatcatcctgtcctggttcagtctatggtcgatccactgccagagggcagagttcatggtggtgggctgttggctttactttcgcgggccggaagcagaacaagcaacggtggctcagaattgtactccgggcaaggtggtgtggatgtgaggctatcaggttctccaagaaattgattgcctacagttttgatcagttcccaagtttgtgctgtgatggactgagtcagcctttcagattcctccaaggttgcataggatctatccggacgtgtactgtgaaaataagagggtagctcttagagcagatgtattgtgtgttattgtaattacttaatgtggttgtggctagagagagtaaccttttgtttcagtgcatttaatcagtcaccttaatgctcaagtttggacttgatttaactctgagcaatttgcttgctttgggctgaaatataatgttcatttagttgcttattctggtgagtatagtaatttcagaaaagca

SEQ ID NO: 301 - DNA, 2037 bp, Sorghum bicolor
atggcgagtgggatgcagcaggaggccgcgaggaggacgcagtggaggagcgacacgcgtggcgtcgcttggagcggcggcgccgccaggcgaggacacgtcgggctgctccactcccacgccgattccatgggtcaatgacgggtgggtccggtcaggcagggcgggtcaacgcccgccacaacggcggcagcggcatctcgaggcttgctctttgtttggaggctgacacgtggggcccacagcacagccacagcggcagaaagaagccccaagcccccaaccgaacaaaaacgctatcgttctcgtcgggagccgcgacggcgcgcatggcggcgacggcggcggcgcttcggtgctgctttcccggctcctccggtgtcggcagtggcttcgtgaaagccaaatcgtccaggcgaggctggtgcgcagcggccgtggcggcgccgtcgcgggaggcggagccggtttcgtcactggggcaccgtacccgcgtcgacttccccatccttcaccaggaattcgatggtgctaaattagtttacttcgacaacggtgcaacatcacagaaaccttatagtgtgatgagaacactagatgagtactaccgatcgtacaattcgaatgttcatcgtggtattcatgcactcagcgcgaaggctactcaagcatatgaggatgcaagaagaaaggttgcaaattttgtcaacgcagctgatagcagagagattattttcactcgaaatgctactgaagctatcaatctggtagcctattcatggggactatctaacttgaaagaaggagatgagattgtccttacagttgcggagcatcatagtgctattgttccatggcaatttgtttcccagaagactggtgccaccttgaagtatgttggattgactaaagaaaatgccccagacattgagcagttaaaaaggcttctgtcgaacaagacaaagatagttgttgttcatcatgtcgcaaatgttctaggttccatgcttcctattgaggagattgtaacatggtcaaacagagttggagctaaagtccttgtagatgcttgccaaagtgttccccacatgccagttgatgttcagaaacttggcgcagactttcttgtcgcatcctctcataagatgtgtggccctacaggcgtcggatttttgcatggtaaatttgagattttgtcatctatggagcctttcttaggtggtggcgaaatgattgcagatgtattccaagacaaatccacatacgctgagcctccctctagatttgaggctggaactcctgcaattggagaagctataggattgggagcggccattgattatttatcatgcattggcatggagcagatccatgaatatgagaaagagttggggacatatctgtatgaaagccttctttctgttccaaatgtccagatatatggtccagcaccttcccaaactgttcaccgtgctccgctgtgttctttcaatattgagaatgttcatcctacagatattgcagaaattcttgatctgcagcacggtgtagcaattcggtcagggcatcattgtgcacagattttgcataggacccttggtatcactgcaagtgctcgtgcaagtcttcacttctacaatacaaaagatgaagtggataccttcatcgatgcgcttaaagccactattgatttcctcacgtctaaatactagtgtggttcgattagtaagttgtccgtttttgtcagtttggtcactctctcatttgagctgctgtacagagaaaaagtatacatatattcggtacaaagaaaacatacagtggacatcttctcaaactgtactgtacttccttatttggcggttcttgttaaattcaacgaggttcaggatgcatagagtagaaacgaccatttttaaccagcatatgagaaatcctaggtcaatgttatgcagtaaaatgctgtgttatatttgtgtcctgcacttgactcgccagcttgccataaactatatcaagctagtgagcactctttct

SEQ ID NO: 302 - DNA, 1254 bp, Sorghum bicolor
gcccacttctgttccgtggacccacacatcagtaaccaactcagcaggctcccgtcccgaccaccagataagctgcaagctgcttatcttctcccgtcccctgcaactggaaggaaggaacacgtccgcgccagccaagcagagaggggatcccgcatccatggaggtggtgggcggcgtttcgctgaggccgtcgccagcgccggcgcgtatccgacggaccaccctgtcatgcgtcgacgtaggccgacgcctcgttctcaggcccgcaggggcgccgctgggccagctgccggcgaggcgcgcgctggtagtggaggcccgggggaggagctggtcggaacggcagatgcagcagcagcggcgcatgccgcagctgcccaagatcgaggacgacggcaacccgcgattcgtcatcttcatccgcaccgccaatgtctacttctggtacccgctcaacatcatcacgggcgggacgacggcgaagatcatgcttgctgctaaggacaacttcctcggcaagtacatctacaaggacacgctcgccaggaacctcgctgccgtcatttacaaagatgaggatgagattatagacacagcaaaagagcagtaccgtgtgctcaagaccgaaaatgagtttcggtatggctacaaagttgtggagaaagggaacataaggtctgctctgacgacaagcaatgtgattgaacttccaaagaaagacgagctcaaaactgtggttgacaaggtgaaggacttctttggcgatgtaactgctggcgccaaagaatcctttgcgcagataaccgggtctgctgtcagcaaagaggaagaggaagcagaaaacaaagagaagttccgctccaagaggcgaaagaagcagcggaagtcgaaggagggcctcagtaagtacgctgagactaacgcagtgtcactagctagtttgaaccctatcttcacccttcctgtagccagtctaatcacatcacataatctcccgtttacatctttcagagacggagaaatgattcagtcactcagcacattgtcagacaagtaaagcatcgatcggctgtagtttcgctatccatgtcccagagctgctctgtaatttgtccagcttctaaatttttgcaaagagacaacgtgtaacttccttgcgactaacatgtgttttgccttctcactaaatttcacaaaatccggtgaaggggttaaggttactttctcattccaattatatgttgttttgtc

SEQ ID NO: 303 - DNA, 1281 bp, Sorghum bicolor
aaagggaagtgatgggggagtgcgaggacggcaaggagtacaggtgctgggaggagctgttgccggacgcgctgggcctcatcttccgcaacctgccgctgcaggagatgctcaccgtcgtgccgcgggtgtgcaagtcctgggggcgggtggtcgccggcccctactgctggcaggagatcgacatcgaggagtggagccagcagcagagcaagccggaccagatcggccgcatggtcgagctactcatcggccgcagcggcggctcgtgccgccggatcagcgtctccgggctgccctgcgatccgctcttctcgttcatcggagacaacgcacgagcccttcggacgttggagattcccaggagtgagatcagcgactcgatcgtagaaaccgtggcgccgcggctatcaaacgtcactttcctagacatcagcagctgcaccaagatcggagcccgtgccctggaggctttcggcaagcactgcaagtccctggtggggctccggcgggtgatgcacccgatcgacctggtggacaaggtgtgccagcacgacgaggcgcacgccatcgcgtgcagcatgcccaagctccggcacctggagatggggtacatgctgatcgcgacggaggcggtgctggagatcctggggcagtgccgcgacctcaagttcctggacctgcgcggctgctggaccgtggacgacaagttcctgcgggagcgccacccggggctccgcgtcctgggcccgcgcgtcgacgactgctacgagaacagctactgggaggagtgctccgactactcggacgactcctccatctactcgtgggagttcatggacgacgactactacgccgtcggaagcgacgacgaggccatctgggacgacgggcagggactggagaacctcgaggtgaggttctacggcggcggattcagcgagagcttcgccggcttcgactggccaccgtcgccgtgagaccttccgggttgcgttgaccatttgcggttcttggctgcttctaccgtgtgcgtgcgtgcgtgcgtgagcctttgtgtgttgttcccaaagctttgcttgcagatgtgtgtgctgtgctgctgtagtactgtgcctgcgacatcactccatctccctcgagcttgcagatatgtgaagtgaactgctaattgtacaatctagatgtaaactccggtgtttacatgaaggaaatcagcatgctgcaccggtgagatttcaccggtgccatcccccatcctactaatcggctagtcctaga

SEQ ID NO: 304 - DNA, 1206 bp, Sorghum bicolor
atccagagtccagggggcgttgccgcgttgcgttccgctctcccttttctgctgcgacggctggtcgagcgccggcgccgccacccttcgccagctcttcgcaggcgacgagcaccgaccagacatgggggaaggtggagaagagaagtcattcaatttccttcaagttttgctcgagggcagcatagccggaggaactgctggtgttgtggtggaaacagcactttacccaattgatactataaaaaccaggcttcaggctgctcgaggtggaagccggattgaatggaaaggcttgtattctggattagctggaaatcttgctggtgtccttccggcctctgcaatatttgtcggagtgtatgagccaactaaaagaaaattactggagacacttcctgaaaatctgagtgcagttgcccattttactgcaggggccattggaggtattgctgcttcccttgtccgtgtccctacagaggtggtcaaacaaaggatgcaaactggtcaattcaagtctgcacctgatgctgttcgtctcattgttgctaaagaaggatttaaaggactgtacgccggttatggttcctttctacttcgagatcttccatttgatgccattcaattctgcatttatgagcaaattcgaattggctacaaagctgtggcgagaagggagttgaatgatccagagaatgcacttattggtgcttttgctggtgccatcactggagctataacaactccccttgatgtcatgaagacaagactgatggttcagggacaagggaaccaatacactggaattgtaaactgtgctcagacaatcctcagggaggaaggccctaaggcattcttgaagggcattgagccgcgagtgctgtggattggcatcggcgggtccatcttctttggtgtgctggagaaaaccaagtcgatgctagccgagaggaggaaccgcgagctacgggccgtcaaggacgaatgagtgaagatcatttttttaacgttgaattcctatcatgtgaaactagataaacaaaatacaccagggccttctcgtactccagggcgttcacgttatcacgtacacgtcgaacttgaccaataagcccacggctccatgccgttagcctcagcgccctcaacaaccagcgactactgccgggtccggcgccctctgccggtcgcctgagtcctgacttc

SEQ ID NO: 305 - DNA, 3120 bp, Sorghum bicolor
cagcggcagcagatcgagccccagttccagcagagtcccattccgccacgaaaaaactcgctttccaaatctctctctcactctctttcgttttgtccaaaaacacccaaatcgtgtcgcttaaatctgcgcgattcataacgaatcgccatagttaatcgaagcattaaacgagggaaaaaaaggggagaaaaaaaggagagggacagggagagagagggaggcggaggccatcatcccattcgccggctggtcctgatccttgtccgggtctatttgggcggcgccgcacgcagcaggagggagagatcagcgcggggcatttacgatggtggacaagaatgatgggtcagagggtcttaaattcaacacgtcaaacctcattcaaacaaccgaagaggttgcaagagcgtttattgctgcggcttcggctgccactgcacagtctgcacggccatctgtagtgtattcatccaaagatgagagtggcagcccaatgcagaagcttcagcagcaattctcgaaaatcatgaaagggtttacgtcctcaccggacctgtcaggaacttacaatccagaagtgcttacaactcaaaagcggcagtggtcgaggtaccagctgaagtcattgggtgataggtgcatcagagaaccatcacatctgttcgagagcatagtgattgttgggcttccacctaacgcagatatccaggagctggaaaacattgcactagggagaaatgatgaagatggaaagagatcaagaaatttatttagcaatagccaccaccaagttcacgcaatatcaaatttggaaccacaggttctttttgcgtaccctccagagaagcctcttccactcaagtacaaggataccctctctttctgccttcccggaggtgtacaggttcatgctgtcgaacgtactccttcattcagtgagctgaatgaaatcctcctgggacaggaacagcttaaagaaagcaaccaatcatttgtgttccgcctacaggttgctgataactctgcattatatggatgctgtgtgctggttgaagagattgtacagagaccatcaaagttggtatcgatgctaatgaatgacaaacccatctttccacgccggagtcgatacgtggtaactacgccccggtgttattgcatcctgtccaggcttccgttctttgaactgcattttggggtgttgcagagtattcttatggaagaacgtctggagtggctcactgatggtgttagcatgctaacttccttatcgcttgaggaatcctgtgagaacgatatctgtgaaggaactgaagttacagcacagaaacagtatttagatagtaacacaattgatgtggataaatcatctgaatctagcatgggagtttcatcaaaggagctatctgacactgacagcagttttgggtgtagagagaaccagcttgactttgtttctaaagaacaacagcaaaatagttcttgtgataaagagcagagtgatcgtaaaagagaaattatcacttgtgatgcttctgaagtgtctgatcattttgttcctgaagatacatcatctgatcagtctggagctaagcatcatgaacttgattctgcatcaggtatccaggatgaatctggtgcaaagaactgtgatgattctccgaagggaaatgtggatgatgaggagcttgatctcttcattaccgatactattttaccacttatgcgatctcgcctttgtgaagattgtgaatcatctccaagttcacagggttctccttctagaaatttcgacacccaggaatcggattcagaggagccatcttccatcggtgatggggacttagttagacacaacaacatactgcagtgggctaaggcaaaaaaatatggttctttgcaagttgtctgtcaatactaccagttacagtgtcctgctaggggttcatcacttacttttcatcccttggagcatttgcatcctttgagttttcaccggccaggtgaaacagttcttcacattgctggttctactattgagcttaggtcacgcgatacaagcttagaagttgctgagatgcgtaattcactcttcgctgaggaggaatcgactgctttatccacatgggcggtggcatccatttgtggatgcctaaggttggaacatgtaatgacactttttgctgctgcactcctggagaaacagattgttattgtctgttctaatctgggaatgttatcggcttcagttttgtccatcctacctctaatacgaccgtatcggtggcatagtctcctcacgacggtcttgcctaatgacatgatggattttctggatgccccagttccatacatagtgggtgtacaaaacaagacatctgatgtgctcaacaggctaccaaatgccgtggtcattgatgccaacaggaatcagattaaatcttcttcagttccgcaactaccacagcacagagagttgctttctgccttgcgcccgtatcattcaatacttgttggcgaaagttatcttgcaagaaaacgtcctgtttacgaatgcacagatgcccaggtggaagcggccaaaggtttcttggcagtgcttagagactaccttgacacactatgctcgaacttgagatctcatacaattaccaatgtgcaatctaacaatgacaaggtttccttacttttaaaagagagctttatcggttctttcccaatccgggataggccttttatgaagctttttgtggacacgcagttgttctcagtacagacagacctagttctctccttttatcagaaggactaagtgtctgacagacttgaatgtctgtctcatgttgccaagcctttagatgttgagctaaactgtacatatcggcttagaaagaatgagctgccttcgtcattttggcagctgagtgtgttaagagctggggtattgaagaagaatgcctatagctgttgtaagttagtctggtgcggtgatccgccatctaaggttttgtaggctgttgtaggctgatgcttctatggattgttcctgcaatacctgtgctgtaatggaaccatatctgcggcagaatctccgcacttgaatgtgttatgtcaaga

SEQ ID NO: 306 - DNA, 791 bp, Sorghum bicolor
cggcccatcacccaccccatctccctcacgtgcgcgcgagcgtcgcgctccaggccttcctcttccccgtctggcatcgcgaaccgccgcacccgattcggcacgcccacgccccacccccttcaccgtgtctctccgcggcggcgggcgcggttctccggccatcaccgggcgcatccggaaaaactatgaggaggtacagccccccttatcgtagtccccccaggagggcatatggtggcagaggaagaagcccccctcctcctaggagggggtatggaggacgcaacaaagagggtagtggaagccttttggtccgcaatatcccattaagcgtcagagcggaggagcttcgagttccttttgaaaggtttggccctgtccgcgatgtttacattccaaaggactattactctggggagcctcgaggatttgcctttgtggagtttgttgacccttatgatgcctctgaagcccagtatcacatgaatcgccaagttttctttggccgggagatagctgttgttcttgctgctgagtcgcgaaagaggccagaggaaatgcgcagcagagctagagtcagaggttactctggtcatgaaggtcgccgatcttcatattatgggcggtctcggtcccgttcccgctctcctcgctataggggccgtcctcggtcaagatcatactctcctgctccaaggcggcgagatgactactcagcttctcctaggagacaggaagcgcatcgcacatcctctcccaggcgcccgacaaaggagcatgacgaagat

SEQ ID NO: 307 - DNA, 3667 bp, Sorghum bicolor
tcatcttggaagcgtccgcgactcggcgcaccgaatcccaaccaccgctagtgccgccgagcatatacatcgccctgcctgcctgccgctcgccccgccctcagctgctcagcgacaagcaagctgatcacctcagcaagagcagcaagcagagcggcgctccagccttccaggccgccgtgggggatatgcacacgccgccagggcaggcgtgccaaagaagcgtagcgtagggggccggccgcggccatgtgggcgccgtcgcgggggtcgtcgtcggggagcgggcggcggacgtggcgccgccgcatcgcggactacctcgccgacgaccagaccgacgtgtcggacaatgagtccttcatcacggcgcacagcgacgagtacgtcgccgcctccacgtccatgtccgccgcgggaggcgggggaatgctgccggcgttcctcgcggaccagagcgacctcgtggaggtgatgctggagctggacgaggagtccatggtggtgcgcagcgtcacgcccaccaccgccgcgctgtacgggacccccaccgcgtcgtcgctgcccgggcccggcgcggcggggccgcaggcgcacacgccggacggcccgcggagcctgagccggtgctcgtcgacgtcgtcgcggatccgcaggaagttcgcgtggctgcggtcgccgtctccatcgccgtcgctgcgtcgtcccccgcccgcggccggggccgcggcggcgacggcggcgttgtccgaccagcaggtggtgcgggaggcggcgctggcggcccgcgagcggcggcgcgtccaggcgcgcctcctgaaccggtcgcggtccggggccaggcgcgcgctcaagggcctccggttcatcagccgcaccaccaccgacgccgacggcggcgccgcgctctggcgcgccgtggaggagcgcttcaacgcgctcgccaccgacggcctcctcgcccgcgacgacttcggcgactgcatcggtacgtggcgttcgttcgttcgttcgtccatgaacgaggccgcccgatcactcgcgcgcccccagccacgacgacgtgctgacggcattggcgttgcagggatggtggactccaaggagttcgcggtgggcatcttcgacgcgctggcgcggcggcggcggcagaacctggagcggatcagcaaggacgagctctacgagttctggctgcaaatctccgaccagagcttcgacgcgcgcctccaaatcttcttcgacatggtggacaccaacgtggacggcaggatcacgagggaggaagtgcaagagctgatcgttctgagcgcgtcggcgaacaagctgtcgaagctcaaggagcaggctgaggagtacgcgtccttgatcatggaggagctcgatccggagaatctcggctacatagagctgtggcagctggaggcgctgctcctgcagcgggacgcgtacatgacctacagccggccgatgagcagcggcagcgcggcgcagtggagccagggcctgagcgccggcgccggcgcgggtgctggtgggcagcagcagcagcagcagcaggcgcagccgcagccgtcgcggtggcagctgcagcggcggaggtggagcccgcgtcgcgcggcggcgcgggcgcgcgtggcggcggcggagcgctggcggcgggcgtgggtggtggcgctgtggtgcgcggccatggcgtcgctgttcgcgtggcggttcgtgcagtaccggcggtcggcggcgttccgggtgatggggtactgcctcccgacggccaagggcgccgccgagacgctcaagctcaacatggcgctcgtgctcctcccggtctgccgcaacacgctgacgtggctccgatccacctgggcgcgattcttcgtccccttcgacgacagcatcgccttccacaagatgatcgcgttggcgatcgcggtggggatctgcctgcacgcggggaaccacctggcgtgcgacttcccgcggctgatcgcgtcggggcccgacgagtaccggctggtggcgcgcttcttcgggcgggacaagcccagctacaggggcctcctcgccggcgccgagggcgtcaccgggatcgtcatggtcacgctcatggccgtctccttcaccctcgccacgcgccccttccggaagcgggaggcggaggtcaagccggccaggtccgcccgccggtggtgctggccgctcgcccacctcgccggcggcttcaacgccttctggtactcgcaccacctgctcatcgtcgtctacctcctgctgctcgtccacggctggttcgtgttcctcgtcgacaagtggtaccagaggacgacatggatgtacatttctgtgccactggtgctctacgtcggggaacggacgctacgggccttccgatccaaggcttacgcagttaagatcctcaagtgtccaacaatctccccatttgagtggcatcctttctccatcacttcagctcctggagacgactacatcagcgtccacattcagaccaggggtgactggacacaagagctcaagcgcatcttcgtcgagaactacttcacgccatgcgtgccccgaagagctgccttcggcgagctaggcgcggtggagcacaagagtccgccaaggttgctggttgacggcccctacggcgccccagcgcaggatttcaggaactacgacgtgctgctcctcgtcggccttgggatcggcgcaacccctttcatcagcatcctgagagatcttctgaacaacatcaagctggctgatgagctgatggatctggcaatggagaccagccggtctgaggacagcgccaacagcttgagcgcgtcaacggcgagcagcagcaacaagaggcgggcataccgaacaagctgcgcacacttctactgggtcacaagggagccggggtcattcgagtggttcaagggagtgatgaatgaggtcgctgaaatggacaagaagggtgtcattgagctgcacaactatctgacaagcgtgtatgaggagcgagatgcaaggacgaccctgctgtcgatggtgcaggccctgaaccacgccaagcatggcgtagacatagtgtcaggcacaagggtcaggacacattttgcaagacctaactggaaagaagtatttacaagaatcgcgtccaagcacccaaattctacagtcggggtattttactgtgggagacctacacttgccaaagaactgaagaaactgtcacttgacatgagccacaaaacgggaacccgctttgatttccacaaggagtacttctgatggaaaatagaagtactcctgatttctttagtactagaagatacagatacaaaaaaatcacaaattttgcatagaagcaaactgatcctcttcacagtatgtaattgtacatagtataaagcagagggtagttagaaacaatttttgttaaccaaatgggagggtaaaaatatgtcttgcgctttcagacagacattggttactgcagatatacatgtatagatcatagctattcattgtatgctaagcatacaagagactgaggccaacaatctgaatgcatatcattcaaataactggtcgtgtttactttattactaacagtggcattatgcagaaatcatatatatattcctttttactccggtagtagttactccca

SEQ ID NO: 308 - DNA, 1404 bp, Sorghum bicolor
attttttttcttctccctttccttatccttgtccctagtccctacccacacgcaccccgctcgaccaagctcccgcgcccgcggccggcgccctcacgctcccgcggctgggcctggcgcccgcgcccgtggccgtggtcggcgcctccaatctcacagcttggctcgggaccaagaggcgagggatacgccctgcgcgagtgcgcgctcggcagaacgatgccgctgcactgttccctgcccgcgacctgttcggcgttgtgcctgcgagcagcggcgcggcctgacccccgctgtccgagctcccacgcgcgcctcgtcggcctagctctttctcgcccgcgccaccagaggctcgtgcacaccggctgcgcgcgggccgggacgagcgactctaaggccgtgcagctggtgctgggcggccgtgcgcgcagcgacgatgacgacactgactccgagtccagcgatggcgaggactcccaggatcggatgacggacgaagagcggaagacgctgcgccggaagatacgggagatgatggaccgcgtccctgaaacggcggggctgacggacccggaggagcggagggccaagatgcgggagctgctgaccaagtacgagctggtggtagaggaggaggacccggactggcccgaggacgccgaggatgggatgggcttcagcctcggccagttcttcgacaagatcaccatcaaggccgagaagaaggacgacgccgaggaggatgatgactcggggtatcaaagcgacaaggagattgtttgggaggatgacaattacatcaagccggtgagggatgttaggacacaggattgggatgcgtccgtgttcaccgatttcgggccgatgattgtgcttgtgcataacagatataagagaccgcgggagaatgagatggcgagggctgagcttactaaggcaattgagatgttttgggaacacaatctgccgtcaccaaggtgtgtggctgtagatgcctgtgccgagcctgaccttgtggacgcgctgaaagtttctggtttccctgagattctcttcaccaatgcagggaggataatacaccgtgagaaagttgtccggtcggcggaggcatggtcgaggatgatggcgtttttctactacaaagcagcaaggccaccgttcttgtgtgaagcagatgggaagggtcaagaaaaggttcctttgatgtcatgagcacaacgtggaggcttagctttgtagtacaactattttagtgcttcgaagttcgaatcaaatttttagaaaatcaatgcagtttgttagaacttcacatatgtcattaggaagtttatgctgttaggactaagagttgaaacttacaactattatgagaaaaatacattaatcagcctcttttattac

SEQ ID NO: 309 - DNA, 1194 bp, Sorghum bicolor
accgatcgacgctaacgacgacgagcgcgacagcgatggcggcggacccggacacggaggtgcaggcggagttcccgccgctggtccgccagtacaagagcggccgcgtcgagcggttctttaacccgtccccgctcccggccggcaccgacccggccacgggcgtcgtgtccaaggacgtcgtcgtcgatccggccaccggcctctgggcgcgcctcttcctcccgcccagcagcagccacggcaagaagcagcagctccccatcgtcgtctactaccacggcggcgcctacgtgatcggctcggcggccgacccgtggacgcacacctacctcaacgggctcgtcgccaaggccggcgtcctcgccgtggcgctcgagtaccgcctcgcgccggagcacccgctcccggccgcctacgaggactcgtgggaggggctcaagtgggtggccacccacgccgccgccaccgccgccgcgggcgggggaccggagccgtggctgaccgagcacggcgacttctcccgcgtgttcctggccggagccagcgcgggcggcaccatcgcgcactacgtcgccgtccgtgccggcgagcagcagggccagggccagggcgacctcctcggggtgcgcgtcagggggctgctgatagtgcacccctacttcagcggcgcggcggacatcggcgacgaggggacgacggggaagcagcgcaaggcgcaggccgacgcgttctggcggttcctgtaccccggctcccccgggctcgacgacccgctttccaacccgttctcggaggccgccggcggcagcgcggcgcgcgtcgccgccgagcgagtgctcgtctgcgtcgccgagaaggatgacctcagggacaggggcgtctggtactacgagagcctcaaggccggcggctaccccggcgaggtggagctgctcgagtccaagggcgagggccacgtcttctactgcatgaacccgagctgcgacagggcgcgggagatggaggagcgcgtcctgagcttcctacgcaagtgagcgactctgagcgcgcgcccgtgcaaagcgctcaactgcgcaagtgagatggaataatttctcgtgtaatttgtttgcttaaaattcatttcaagtttcgaaatgtaccttaccgtcctccaaattgcaaatctgttggacttgttttgttttagct

SEQ ID NO: 310 - DNA, 1102 bp, Sorghum bicolor
gccatttccggagcagagcagagcaggcaggcaagtgggtgggtcagagtcagacaggccagcccgccacgccgtcccgacggccatggcccaacccttctcccctcacaccccgtcctcatcctgggtgactcgccgccctcctacctcgacgtcctcaccgtccgcctccaccacgagaacgagcgcctctcctattccggggtgcagaccgcgccgcagggccgtcgcgccggcggcctccctccacctcggccccggggagatcgccgaggtctcgcgcaacaaggttttgattgcggcgacggtggcgagcgcgatcgggcagctgtccaagcccttcacttcaggcaagaatgggggcgccggcgccggccttgacctcaggaccatattccgctctggagggatgccatctacccactccgcgagtgttgttgcagttgctacttcgcttgggctagaaagggggtttgcagactccgtatttggaatgtcagtggtgtttgcagccattgtaatgtatgatgctcagggagttagaagagaagtgggcaaccatgccagggttttgaacaagttttggatcctcaaagagaaggcacctctggagtattctgaagtggacatggcttctgagtttgtttcggttaccgaggaggtgatttcaaatgcaagcccctcgaagcacggttctagtacagaatcaccaagggtgaaggggctccatagttcagaacctgaggtaactgaggtgacagagctgaagcaggcttacatagaggaggattaccggttgagtgaatctgttggccacacagagcttcaggtcacagtcggcgccttgttaggttttgctgtaagcttagcagtatacgcgacactgtaacacagatttttttttatattactttcttaattagttacacgtttacacttttacacaaaaataacagaatcgattgattattcccaccattcaatcagagatgcctaagctcgtttcacattattctgtaaccgaacatgcgagatctttttgtttttcctatagataagagtgaagtgaatgatctgtcatgagatgatgacctttgtgccc

SEQ ID NO: 311 - DNA, 1395 bp, Sorghum bicolor
ccgaaccctcccggtcccggcaccgcaaccgctgttcctccccgcggcacgcgcgcgcgccacagccgatgtgccgcggcaggattcctcggcaccgcgaccattcggcttctccccgacccggcacggtcccttccttccctctctccggcggcagatggcctcctcctcctcaccggcgcccaccctggccggggaggctctacgccagaaacgcatcctctccagcaagctctacctcgaggtcccctcctccaaggcgccggtggtgtactcgccggcatacgacatctccttcctcgggcttgagaagctgcacccgtttgattccgccaaatggggccgcatctgcaggtacctcaccagggaagggtacctggacaagaaacggatggtggatccattggaagcctgcaaggaggatttgctagtggtgcacacagaggcgtatctgaacagtctcaaaagcagcttcagagtttccaacattgtagaggtccctcctgtctcgcttgtccctaattggattgtgcacaagaagctattataccccttccggaagcaggtgggtgggtccattttatcagccaaacttgcgcttgagagaggatgggccattaatgttggtggaggatttcaccattgttcggcagatgaagggggtggattttgtgcatatgctgacatctctctctgcatccagtttgcttttgcccgtctaaatatctcaagtgtattgatcatagacctggatgcccaccaaggaaatggacacgaaaaagattttgctaatgatggaagggtttacatttttgacatgtacaatgctggaatttatccctttgatttcactgctaagcaatacattgatcaaaaagtagaattagctagtggaacagaaacagatgaatacttggagcaacttgacaaggctcttgaggtctgcaatagtagatttcagccccagttgattgtttacaatgctggaacagacatcctggatggtgatccgttgggcagattgaaggtaagtcctgagggtgtggttaccagagacgagaaggtatttacgttcgcaaaagatcaaaacattcctctgctgatgctgacatcaggaggctacatgaagtcaagtgctcgagtaatagctgattcgatcatcaatctgtccaacaaaaacttgataggattaggcagcgagctgggttgagcaagaacttggaatatctcatggacgtgtatatgtcctgtgaataaaggtgtttggtacttgtgatttgtgatggataacatgtatgccacaaaaatggtctgtacataacacggggtctttgtgaatctatgggtttgtttggatacctggctcccttctagcctggttaggaatcaagccag

SEQ ID NO: 312 - DNA, 1280 bp, Sorghum bicolor
cgcccggtccactatagaactgttctactctactccactaccacctgtcattttccttccctcttcatcaacgtctcgacgaagctgccagtgctgcaggtagaccggaccgaacaactgcagctcgggagcggccatttctccgggggcgggagagctctacctcttgcagcggtagaacaagagcagccagagtgaacagaaatggatgcggatggtagctccaagagaagtcgcccagttcgtcgtgctgtgaagaagctcaagttcaaaccgaaggtgcctccacagaagccaaagaaactgagtgcacaaaagccacagcaagaagaccctaagccaattgatcaagacttgatgaagatattgagggtgggtaactggttatccaattgtgtcgttaatatcaaaataatcggactgaacatattatttgtagatgagcgcccaatgcagaataccccctcgacaccaccttctgcagatgttgttaacatgtcaccaacacaattcggattgcagaaacaaaatcaattgccactccaaattcctagatccttccctgttcctgttcattcaggaatgttttacaaagaagatagtgacgacgacgacaacgatgatggtagtgacaatgttgagttgcatgagactcagccaaattcaattgaatgtgaagctttaacacgtccagcagaggagcttgatttgcttcaacaaggtagcaaagaaagaatgttcctcttccagctcccaaaatctcttcctttgcccaaaaggacgtccagtaccagtatagttgaaagacaaggaaagcccactggcaaggaggtgaaggaaggatgcaacctgcagcagctgcctcagggttatttgggcaaaatgctggtatacaagagcggcaagatcaaaatgaagttaggagatgtcatgtttgatgtgagcccaggagcagaaactaggatggcacaacatgtagtagctcagaacactcgagacaaacattgttgcttacttggagagattgagaatcggcatgttattgtgactcccgatatggattctttgttgaacgacaagtagagattaggttgtaatctgtagcaactgtagcagctttggcatatgttgtgtgtagacttgtagctagttagttaggcagggtttggctgccatctgtaccaattgtatcagccttgtcaaatggtgtataggattttagttgtgcagtggtgtacgttttactgtgattgtactactatgttagttttagaaatgcc

SEQ ID NO: 313 - DNA, 378 bp, Sorghum bicolor
cggcggcggagttcaagaagtggctgaagcagttcgacgccgacggcgacgggcggatcagcaggcgggagctccgggaggccatccgccgccggggcgcgtggttcgccagcgtcaaggcctggtgcgccgtccgccgcgccgacagggaccgcaacggcttcgtggacgactgcgagatggagagcctcgtcgagttcgccgagaacgagctgggcttcctcatttccaaggagccgacgtcgacgcccaatcgacgggcgcaaccaccactgcggtggtgaaccgtctgttcctctgctgttcatcttcatcacttatcagcagcgcctctccgtccaccctccgaataatttgtgtggaaggatcggatcgaat

SEQ ID NO: 314 - DNA, 1161 bp, Glycine max
cttcatttgtaaatgactaaatggcaatgagctcaattcataccttgtacgctttttctttccgtttgtgtttcccaaattcatctccacaatttaagcctctgaatgccattccactaagaagaacaaaacactacaacaacaacaacaacaacgttaaatttccccgagaaagaacaaggaccagagcaacccttgatgatgttgaaacagaccaactttcctcaatcccacttgttgaaaatgagaaagccaaaaaggatgtagaggaaagtgtgaaagtgttaaaagatgcagctaagacaagaaaggtagcagcagaggagattctttctgcattgtctatcattgagaaagcaaaagttgatccttctgccttttttgaaacccttggtggaaaggaatcccctgggaggacctggatgctaatttttactgctgagaaacaactaaaaggtggtcgatattttcctctcacagctgttcagaggtttgatgctgctgcaaagaggatcgaaaatggaatatatcttggacccattggacagttaacatttgaaggcagactttcatggaaaaagagaatactggcttttgtttttgagaacattcgaataaaagttggacctttgcaacctctagagatcagtctaggaaaaaaggaagacaaagaaccgagtaccaaggatcctttcttcatctggttttatgttgatgaggaaatagctgttgctcgaggcaggagtggaggaactgcattttggtgtcggtgtcgtcgtgccaataactgattgtttttaactttctttccttctctacttctgagttttgatggaaagatacatgtatatatgtaaacatttaagttcagttggtggtaaacatatttgtacttgtttattgtatagttacttgtttgcataaattccaggaactaaaatatgtaattagtttgtgtttcacgataatcctactgtcgtggaggtcatcccgacttttcctattttatcatagtcgtgaaaccctttcttgttaaagaagacagtagcatggatgattggatttattctttctgatgcatagggtctttatgtatataaaaaaaaatgtgtttcggctatcgagcaaagaaacgaggagtaaaagagtttgtaattcatc

SEQ ID NO: 315 - DNA, 2605 bp, Glycine max
aactaactgaacctctcagtcgagatatgcgattgcggtggcgtcggcggtggtccgggttgttgagtccccgatcgacggccaatgcagcggttcgttgcggcggcgtgcggcgtcgttgatggccctgcagatgacttggcagccgagtctcctgagtcagaaacgcaaaaccggaaccggtcctcccttagggctccgtaacctaggcaactcgtgctacctcaacagcgtcctccagtgcctcacctacactcctcctctcgccaatttctgcctccgtctccaacactcttctctctgtgattcttctgggtcttcgtgtccgttctgcatactggagaagcagattgcacggtcgctgcgattggatctcacgcacgacgcgccgtccaagatccagagctgcatccggatcttcgccgagaacttccgctgcggccgccaggaggacgcgcacgagttcctccgctacgtcatcgacgcctgccacaacacctgcctccgcctcaagaagctccgccgcaaaggcgcagaggccaatggcggcggcgacgaagctggtggcagtacagtggtgaaggagattttcggtggcgccttgcagagccaggtgaagtgtctgtgctgtggatatgagtcgaataaggttgatgagataatggatattagtcttgatgttttccatagtaactcgcttaaagactccatgcaaaagttctttcagcctgaggttttagatggcaacaataagtacaagtgtgatagttgtaagaaattagtggccgctaagaagcagatgtccatacttcaagcacctaacatccttgtgatacagctaaagagatttgagggcatattgggtggcaagattgacaaggctgttgcatttgaagaggttttggtgctttctagcttcatgtgcaaagcaagccaggatccccaaccggaatataagctctttggcactattgtgcattcaggctactcccccgaatctggtcactactatgcttatataaaggatgcaatgggtcggtggtattgctgtgatgattcttgtgtaactgttgcaacccttcaggaagttttgtcagaaaaggtttacattctttttttctcgcgaactaaccaaaggccagtgtcaagtagtaattctcttgcttcaaatggtgtaaagcctcattccaatgggagccaaacatctgaatgcccaaaggttggtgtaccaccaaaagcagtgcatgcaaaatcgaattctgagctatcttcttggaaggatataccaagagtttctaagactgctaaagcaccttccagctcacgagtgaagtttgacattaatggaagctcttcttctaaaagaaattctgctcctgtgagtgtgaatgggaaagttgatgtttgtaggaatcagccttcagcagtaaatgggcatgtgaaagattcagcttctttggagaatggtaaggaagattcttcattacccaccaggaatggcattgacgaaaataaagtttctgttgacaaattgaaaagaaaggagtcaacagtttcaaatggacacactggtaatcagacagttgatattcattctgtaaagtcagatctcaaggaagatactgacagaagcaggataatagcaggtagagtgcctgacaattttaagcaagaaagcaatggcctcaacaacaaacctacaatattggggaataagagaaaactacagggggacccatgcattttacttgcacatgatggtcagtctcaagcaagagttcaagaactgaaggacattcttgggaaagaggcaaagtcagttttgaggtcaattggctggactgataaggtctacgaatttatgcgttcaaagaagttacgtgcacaagaagctggaaatttgacaaatggagatgaaataaggaagttgttaataggagatgcgcagggagctttcatatccaagattcccgagtcattgaaacaggatatgattcaacgactccaatcatttagccaagaaaaaatacaattttcaggaccttgatcagagcatgaatgtcgatctgtcgtgctagcgaggcgtggtgtgaatactctgtattactaattattgtagtgatggtggcacccttgctgggatgctcagtttgggtttgttacatactctaactctttgaggctggcgataatagcaggagaatgaggagacttgttatcattgaagcatggctttgttatgcttctaggtgcttcattcatatttgagatagaagttcagatttcatgtcaggccagttttctttcttcatggaggctataaagttctattgcatcttgaggagagcttgccaggaattctattcattctgtacaatcttatattttagcgatgtactgaagcaaaatcttaattttctataaaattgctcaacaaattttgcagcgaagatgaggctgtgcatgacttgtggatacactacaccctattaacagtgtctgtagttcttaaaaattcattcgctatgtaaacgttttgcccgagaggacaagatcctgaaatttgtgagatttataagtaaattttgatacacatcggcaacta

SEQ ID NO: 316 - DNA, 800 bp, Glycine max
tccctggcaatatgatacgaaatgcagcgattaaggagttccttaaaaaaaagtatctcaattcacgggctgccattgaagatacttatttttccaccaaggatacttttgagagacatcgcgtggttttcaccgttggaacttccattgcttccgttgccactgcttggttcggttattccttgcgccatttacatgacatcaaagttgatcaaaggcttcaatctatcgaaaattctatgaaaaacaattccaatctccaacattcccaaatcaaagacattgtcgcgggttccgcttccggagcttttagtatccctgcttgtgttgccactgctggaacctccttaatcatcgggtatgccttaggatggagaggtggaatctggtatgcaactaagaagttccgaaaggagcagatgaaaatgctaggacagattacacctaaaagatggcaattgcttgggaagataaagcctagagggtttcaattccagttccttagaaggaaacttacaagattcaaagtgtctgacactgccacaaaaaatctgaaacgagtataaagggtgtttctaccgcacatattgctgtaaaatccgattagtatactactataaatggttctttcaagcaccaatattgatagagatggctgcggatactggattaggctttcaattagacaaacagagtagcaacttagttattatcaattatcatcaaatttttctctgatattttattttggcctgcagttgctcgcccttcataaattcttcatccctcatgggaggagt

SEQ ID NO: 317 - DNA, 2267 bp, Glycine max
ataagttctgttctcttcaaaatggagactaataatgcatgtactatgcattctcattgcatagagatgtccatggaagtgcaccaagttgtgccaccacctcacaagagcacccttcagaaactcaagggtaggctcaaggaaactttcttccctgatgatcctctgcgccaattcaagggacaacctcttaagagaaaactgatccttggagctcaatatgtgttccctattctccaatggggtcctaagtataatctcaaactcttcaaatctgaccttgtttctggcctcactattgctagcttggccatcccgcagggaattagttatgctaagcttgcaagtcttcctccaattgttggactttattctagttttgttccaccacttgtctatgctgttcttggaagctcaaaggaccttgcagttggacctgtttctattgcttctcttgtgatgggatccatgttgcatcaggaagtgtctcccacaacagatccaattctgtttcttcagctagctttcacttcaacattatttgccggtctctttcaagctttgcttggaatcctaaggctaggcttcataattgattttctatctaaggccattcttattgggttcatggctggagctgctattattgtctcactgcaacagctcaagagcctgcttggaatcacacatttcactaatcagatgggtctgattcctgttatgacttctgtttttcacaatatacatgagtggtcatggcaaacaatattgatggggatttgcttcttggtactactactattagcaagacacgttagcataaggaaaccaaaactattctgggtctcagctggagctcctcttatgtgtgtcatcatctctaccctcttggtttttgcaattaaggctcaaaatcatggcatcagtgtgattgggaaattgcaagaaggaataaatcctccatcatggaatatgttgctctttcatggaagtcacctggacctagtcatgaaaacagggcttatcactgggattttgtccctcactgaaggtattgcagtaggaaggacatttgcagctctcaaaaactacaaagtggatggaaataaggaaatgatggcaattgggtttatgaatgttgttggctccttcacttcctgctatgttacaacaggtgctttctctcggtcagcagttaacaacaatgcaggcgcaaaaacagctgtgtcaaatgtagtgatgtctgtgacagtcatggtgacactcctttttctcatgccattgtttcaatacacgcctaatgtcgtgctgggcgcaatcatagtcacagcagtaattggcctcatcgatctccccgctgcttgtaacatttggaagatcgacaaattcgattttgttgtgatgatgactgctttcttaggtgttcttttcatctctgtccaaggaggccttgctcttgctgttggattatcaactttgaagatactcttgcaaattacgagaccgaaaacagtgatgttggggaagataccaggaacagacatatatagaaatcttgatcaatacaaggaagctgtgagaatacctggatttcttattttaagcattgaggctcccatcaattttgccaacatcacatatctcaacgagagaacgttaagatggattgaagaagaagaagacaacataaaggaacaattaagccttcgattcttagtattggaaatgtcagctgtgagtgctgttgacacaagtggaatctcacttttcaaggagttgaaagcaacactggaaaagaaaggtgttgagcttgtgttggtcaatcctcttgctgaggtcatagaaaagcttaaaaaagcagatgaagctaatgatttcataagagcagataaccttttcttgacagttggagaggctgtagcttcactttcttcagcaatgaaaggccaatcatcaaccattacagaaggggcacacacaattgtgtcacataattgataaaataagactgcaaaatatataagcaaaagttaaaagaaaaagaaaaaaaaatagaagcagcaacaactacaagactagcatagaatttgcctaatggcaataccaatcattgtaaaatcctacagtttaaacaattgaagtgaaatgtgtacccttgtcatttgtgcttgtgcttactagatttgcctcacaagcatcgtagtcgtaacttgtatgggaactacttgttgcttgttaattcaatcgttgaagttgatttccaagca

SEQ ID NO: 318 - DNA, 1360 bp, Triticum aestivum
gggcagcgagaaagggagaaatttgataacccgaaggcatgcactttcctggaagaactgaagtccaacagagcacgtagggttgagctatctgatatcacaggtcgcatagtagatttcagcgctgaccaacatggtagccgtttcatccagcagaaattggaaaactgcactgctgaagagaaggcagccgtgtttgcagaagttcttcctcatgcttcatctttaatgactgatgtgttcgggaattatgtgatccaaaagttttttgaacatggaactcctgagcaaagaagggatcttgccgccaagcttgctggtcatgttgtacctttgagccttcagatgtatggatgccgagtaattcaaaaggctctggaagttatggaacttgaccagaaaatagatctggtccgcgagcttgatggaaatattatgcgatgtgttcgtgaccaaaatgggaatcatgttatacagaagtgcatagagtgtgtccccacggaacatattggttttgtagtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgagatcttctaatcagagagattgtggagcagactgacggaaatgataccttgctggcaatgatgaaggatcagtatgctaattatgttgttcagaagatacttgaaacatgcaacgatgagcagcgggaacttctggtcagccgtgtaaagggtcacttgcaagcactgaggaagtacacctatggcaaacatatcgcgagccgagtcgagcagctttgcggtgaaggagatgccgagtgcgactcataagcgacgggagtgcctcaacgcccgccaaattcatcagcaaggaagaaagcataacttggaaccgcggtgcttcaaagtgctaacaaaacatggaactccagcaaggaagattgtacatacgtgactttgcttaggcagtgtagggaggtgctaggcacaaggtttattctgtgcgcaccagtgtatctatgttaagagtgtggatatgttagggtgtgcttatccacactgtactagttggtagccgtgtgcaaaatatgtatagtaccagtgg

SEQ ID NO: 319 - DNA, 1239 bp, Triticum aestivum
ggatatttcgcccctgctttctgttctgcctgcctcccaacaatggctctccccctcgttcgcctcctcctcccgtcgctccacgcgtgccagccgccgctccgccaccctgagtactccgccccacctcgccacagccacgtttccttcgctgtccccgctgccgcccgctcctccggcaaccgcttggcgtttgctgtctgcgctgctagcgcctcggtcgccccggcgcctgcggaaactcaggcggatgcggaggatgagcagcccgtggggccgaagacgcggcttatcgcgatgaacatcccgtgggatttcacgcccgacgacattcgcgttcttttcgagaagcaaggcaccgtcgtcgacgtggagctttcgatgcacagttccaaaaaaaacagaggattggcatttgtaaccatgggttcagaagatgaggctctttcagcactcaagaatctcaatttgtctactttgaacgatagaacgattaaggtggactttgcaaaacctaaaaagaagcaacctgctgtgccgtcagctcctgtggagaaaaatgttgtgtttgtcgggaatttaacgtggagagtgagatcccgtcatcttcgggagttatttgcctcaaccccaggtgtccaatcagttgaagttatctttcataccaccacaccaaggcgatctgctggctatgcatttgtttccttttcctcgaaagaggaggcagaggctgctatttctaccttcaatggcaaggaattgatgggacgatccattaacgtgatgttcaaagaggacactgtcaaaaagaacaagtcttctgattcagaggaagagaagttggaggaggcagaatcttctgaggagagtgatagctaagaatggattattgtgagaaccacagaaagaagttcaatgagttgatctgcaggactataatgctcttttgctaggttaccaagctcctggttgatttcactcatcccataactcttgaattgtcaaacactgttctgtaagttctcctcttgatatggatcacatttggaggttagcttgatactagagtacatgaaatctgtgagctgttaaaatctgagttaatttattgtagaatataagtgttaatgatgaatttgagtgcaatcggctgacgaatttgactacattttttcttctgtaatgaaatttattttaacatttttcggccgcttctgtaatgaccatgtgtatttcagg

SEQ ID NO: 320 - DNA, 1600 bp, Triticum aestivum
cggatcgcgccggatcagataaattgaggctgcagggtggatcagaccctaagaataatcatctaaccatccctcgcgatgggagcagccaaaacattgccgcacagattttcactttccgtgagcttgctgctgccactaagaacttcagacaagattgcatgttgggtgagggaggtttcggacgtgtatataaaggtcgcctagagagtgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccgaagctgtctgactttggccttgcaaaactcggtccagttggtgacaacactcatgtttcaacacgtgtgatgggaacttatggctactgtgccccagaatatgctatgactgggcagctcacagtgaaatcagatgtctatagctttggcgttgttttccttgaactgattacagggcgcaaagcaatcgacaacaccaaaccccagggggagcaaaacctggtggcatgggctcgcccactcttcaaggatcgcaggaagtttcctaagatggctgacccaatgcttcaaggccggttccctatgaggggtctgtatcaggctttagctgttgctgccatgtgtttgcaagagcaagccacaacccgtcctcatataggagatgttgtcactgctctctcatatctagcttctcagacatatgatccaaatgccccaactcaacatactcggagcaattcatcgacccctagggccagaaatgttggtgggcggaacagcgaacagcgcaacggacgctcaccaaatcatcattctcccaggacatcaaagcacggaggggaggtcagccggactagttctactggtggtgattctggccgtaggtcaggattggatgaaatggacatggcaggatcacaggcaggcagtccagctcagacaggaaggaagagagaaaccccaaggactgctgacaggcagcgcgccattgcggatgctaaaatgtggggggagaactccagagagcggaagcgaccgaacggcagctttgatagtacaaatgagtaaactggacagttctctttcacgacgtcactctagcagggggtcgacgagtttgctcatcagcaccagacgggccaggtttaggaacacggtctttgttccagctctgtcccgttgtctgtgaataaaggcttttcttgccatcagcactgcctcacggttgctttatctgtaagttgttgcagttgacatgccttctccgggcggcgtccattccttgcgaatgtgattgtgtcatgtactcg

SEQ ID NO: 321 - DNA, 1195 bp, Triticum aestivum
aggcctatatcacagacagctcgatttcgaaggaatgccttcagaaagtgaaggtacaataccacatgaaagctccaatttatgtgtattatgaactcgacaacttctaccagaatcatcgtaggtatatcaaaagtagaagcgacaagcaactacgctatgggctgaaatacactgatagctcatgcagtccaatagaaaagagcgacggccttccaattgttccctgtggattgattgcctggagcttgttcaatgatacttatgattttacccgtggatccatgggaatagtggttgatcggaaaaatatttcatggagaagtgatcgggagcataagtatggcaaggatgtctatcctttcaactttcagaatggatctttgattggaggaggaaaacttgaccctgatataccactaagcaatcaggaagatcttatcgtgtggatgcgcgcagctgctcttccccagtttcgaaagctgtatggtgtcatcgaagaggatatacaagctgatgaaatcattaccatgcacataacaaacaattacaatacctacagctttggtggaaagaaaagcctggttcttacaacatcaacctggctaggtggcaagaatgactttcttggatatgcataccttatcactggttcctcgagcattttcttgtccattctctttgctctgatccatgtgaaaatcccaaggccacatggtgatgctgcttacctatcttggagcaggaaaaacggcaataactaagcttctgtgcatagttttttctttgtgtaagctagcagtacagcaccctggccagaggtttccccgcggcgttccgtctgcgcaccctgtctcgagggaaatggcatagtagcagcttcaggtttcatacacttgacacttggacggagcatgaaatgcgtagcagcttcaggtttcatacacatacttggagcatgaaatgcttgatgactgctgaggatatatggtaaggccatggttcaccgacatgttcgtgcaattcaggccagcgctctgacggcgccctcgaggaaaactagagccgtgtaaaaactgatatatgtgtatgtaaagcgccataccatggattccatgatgttgtatgaatacatataatgtttcagtttcgcaccgatgtcgaagcatgcttttcccccgcttcaaaaaaaaaa

SEQ ID NO: 322 - DNA, 2430 bp, Triticum aestivum
ggagcgcccggcttaatggcgctcgcgctctccacgctcccgttcgcgccctccaccccggcgcccgcctcccgcggctccgccgcgttccgcccccgcggggcccacttcgccccctcccccgccggcaggagcggcggcctcggcgtcgggctccccctcgcgtgcgcggcgccgcggaagaaccgcgggcggaggcggcgcggcgggggcctggtggtgttcgcggccgccgactactacgcgacgctcggcgtgcagcgctccgcgaccatcaaggacatcaaggcagcataccggaagctcgcgcgccagtatcatcctgatgttaataaggaacctggagcaaccgacaagttcaaagagataagctcagcctacgaggttctgtcagatgataagaagagagcgttgtatgaccaatatggtgaagccggggttaagagtgcggttgggggcaacgctggagcttatacatcgaatccatttgatctgtttgagacattcttcggagcaagcatgggtggtggtggtggcttttctggtatggaccagagtgcatttaggacacgcagaaggagcactgctgctcagggtgaagacatcagatatgatgtgattctagggttctcagaggcaatatttggaacagaaaaagatatcatattatcccatttggagacttgtgatgcttgtagcggttctggttcaaaggttggctcaaaggcaaaaatatgctccacatgtggtgggcgagggcaagtaatgcgaactgagcagacaccatttggtctcttctcccaggtttctagttgccccacttgtgtaggagagggtgaggtcatttcagagtattgcaggaaatgctctggagaggggcgtgttcgtgtcagaaaagagatcttttttgtctgccttgatgtagaggagccatccgatattaaaagggatggtatcaacttgtattcaactgtgtcgataagctacattgaagctattttgggtacagttgaaaaggtcagaactgttgagggaagtagtgaacttcgaatacctccaggcacccaacctggtgatgtattggtcctagcgaagcaaggtgttccatcgttgaataggccatctatacgcggtgatcatctattcactgttaaggtctctatacccaaacgtataagtgggcgcgaaaaggagttgcttgaggaacttgcatcgttgaaaaatggtggttttgcccgtgcacctgtgaagccaaaacctgtacataaagagaatggaagccgcgctgctccagaagtatcagatcaacctgatgatggggagggtgactggttgaagaaactttctgattttgctggatccattgtcaatggggcatccaagtggctgaaagacaacctgtagcctgcaaatatttattgcacgacgcattctcttcaacaccagccatggtgttatccaatctgcaattcttcaattcatcgggattcgacgagctgttgcatgcatgtgttctgttgaagaggctcatcttttacggcctgtgggctgtgaagtggcaacgcagaggtttagtgtcaactaattttattgacgccgtttttattttgttttgagagggatatccttgtaaagcatgaattttgctgtagtcgcactcgtatttcctagagcatgtaacagtcggccgcagatattgaaatagatgaagctacatcctctgtaaatacatatatatctttttctggtagatcatctcagtacaacatcaggctgtgcaagtgattgtttttgttgcctcaaattcagaataaacggggcactcgtctcctcattcctcaagtgcaatttttttgcaatagaacacaagatttctggacagaatacaattttgtgtgtgcatattctgttcttgttcgtcttacaaggcatcttgagttgcaaaatgaaagtgaataaaggcacatgatatcatctgaacttgaaggttgttgcacaagccctagtcatgtgtggaagtggagctgagcttgagcaagacgaggacggcggccgccatgggcagggacaccatgagcagcgcctccacgatgttgggccgcgtgatgtcggggagcagcacgctgccgtacttcacggccgccgcgccgccgacggacccgagccccagcgtcagcaggtagccggagtcatcctgcgggattcgccccttgctgtccggctccgcctcggcgccgtcggtgtcgcgggacacgcgagcgcgaccgccggcgcgtctcctcgccgagcgccggcagctcacgcggaagccgcgccccggcggcagggctgcgccggggccggagacggtgggccgggatggcgcggccaccgcgcacgcacccgccatggacacgagcggggcgcgacaggaagcagagacgagacggg

SEQ ID NO: 323 - DNA, 2147 bp, Triticum aestivum
ggagcggggtacacacgaggcgtcctcttgtggttgcgggggtttggtgggggtttgggggtctcgcctttcctggcggcgcatccacgcaccgatttcccctcctccctcctcctgcgattgcgggtccagattgatcgatccccggccggatttgctccgtcacatcactcgggatctcctcccctaacccctcctcatcgggccggattttttccccctttctctctagggggctccgccccgctcggatcgatggcgtgcatcccgacgggcatccggctgccggacctggacatggtcaaggcggcggcggcggcggccggagcgggggtggggccgccgggcgcggggccgccgggcgcggggccgctgcggccggcgcactcctcggcctcctccgcgctctccgatgcctccaactcctcctcggcctcctcgctctcgctcaagcgggcgcgcacgccgcggaagcgccccaaccagacctacaacgaggcggccgcgctgctcgcctccatgtacccctccgtcttccccgccgcgccgccctcgccgcgcctcctcggcctcgcctccgcgctcgccgacgacccctcccgcgccgacttgctcccgcccttccccgtcctcggcaacgccgcctgcctcctccgcgacgccgccgcgccgccaccgatgacgccgcggagccccgtcctcgccagggcctgcccgtccccggcggccgtcagcagcgccttcaccgagttacgcgactcggcgccgtcccccgggacgcccgacggcgccggcgccgacgggcctggggagctcgactttgaggatgatgacgacagcttcgacgcagactccttcctcctcggcggcgtcgacgagggcgccgctgcccaggggatcgacggcatcatgggcaaactcagtatggaaagcggcagcgatgcctcttccattaaccgcgtgctctccagctccggcatagacccctacatcagaaacctcatggtgctcggactcgggttccggcgctcccggtccaacatcaagcaggcgctcaagcggcacgacgatgacagcgaatggtggatgtgccctgccattccattgaaggacattatgccggcgcctcccccatcgatggaaccaccaccaccggtggagaagaagaagaagaagactaagaagaaggcgctgaaggacatcgccgctgggccgtgcattacatgtgttaaggaggaaattcctgaccctgcttatggggatgatggaatttttggaccgaaggcgcccaagacaggattgggcctgagcctcaacactgaggaggtgctgaaggcgtggtatgacagaggctccgtgttcgctgacggcaacatacctgatgcatcatccactgatgggctggctaaactttcagacattgaactgtttctagagaatggtgctgctggtgctatcagggaaggcagcatacagaaattgaagcacaagcagaagcagtgcactcccctcctctcaaataagactcggtaccaagcacggaaggtgcacgccgagtctcgtcctcgggtcaaggggaggtttgtcagccaggcggctcttctgcagaaagccgcggagaaagagacctaggggaggacgttcttgctcccatgaacattttgtcttgggatttcatttcattccccctagaagtgaagcagatgagggcttcttttcttttctgcacttatgtgatcatgtagagagggtagagattgcctgtagagtggcttctttgtcaggggatagctgctggttagtttcccagctcagatgctgccggggcaaagaaggccgtaagccaaaaacatcgtaacaatggtacagtgctgtggcaatgaccaaagtgcttctgttactttgcttccgtcttatgctctgaaccctctgaaggaactgcaccgggtgctagttttgtacaaaactgaacctgcaaaatttgttaaacttcagggagcatttgattcgcaagaattctaaagcatgtgaatagaaagaaagaaaaagtaggattagaatgtcatgtatgaatcccttggtcctgcaatactcggaggaaaaagcaaggcaagatgtttgagaagtaggcattggcaatgttatgt

SEQ ID NO: 324 - DNA, 811 bp, Triticum aestivum
cagacaccatccggcgacgccatgaagcacctcctcctcccatccccgctccctctcctcctccacggccgcgcctccaagccgctactcctccacgtccgccagcgccaccgccacgccctgagcgccgcacccgacggcaactccggcgacacctccacggccgcgtccgagccgcctcccacgaacacccagcccagcccgccaccctccgcgcctccgtccaccaactccggcaccaccagcgtcaagacccgcctccggtcaaggaaccaggcccgccgcgtccaggagccgtacctgcccccggtggaggtgaagatgatgaggggcaagggcaaggcgaacgcttccgcggcgccgaggagggagaaggagaagcggaagaagacgtgggacgagatgagcctcggcgagaaggcctacgagctgtacgtcggggagaagggggccctcttctggctcaacaagttcgcctacgcctccatcttcatcatagccggcgcctggatcctgttccgcttcgtcgggcccgccaccgggctgtaccagctcgacgcgccgccgctggcgcccacggacgtcctgcgcggctcctagtgagagcacgtacctaggtttctagatagatagcgcggcgggaaagataagggatggatggccggaaagaagattgatgaataattgctgcttacaatggcttcgatggtatgcttgtatgtgattattacgaaattatcgtagatggatgaatgtatgtccgtgtgtaatttgggaactaaagttttcaccctgaattcctgaacaattt

SEQ ID NO: 325 - DNA, 2004 bp, Triticum aestivum
gaggcgacaagaagcaggatgaggagcctgctgggggaggagcgcagcttcatcatcgagagcgacgacgacgacgaggaggatcccgctcacaggggcgacggcgttggccatggggatgatgggtcgtcgtcggactcgtcgtcgtgcgccaccccgcgcggcggcggcggcggcggcggggacagccagcccaactcctacaccaaccaatggccgcagagctacaggcaatcgatcgacattctgagcaacgtgcagtcgccgagcctggggttcctggggaccccgacgctgagccggctgtccaactccttcctcaacagctccttcctcaacaactcgttccgaggcaaaacccccgagatcgtctccaacctcgtcaagccgctcatacgccccacgacaagcgacgagcaacagcaacagcaacagcagcatgaggatatccggaagagctcgcagtacctcctgccgtcgaggaagccgtcgctgcagcagatccccgaggatcagaagccgctggtggttggtcatgaggtttctccctaccagcagtgctcttacacccagggagctatgaacggaataaatgttctgtgtggtgtcggaatcctgtcgacgccttatgccatcaagcaaggggggtggctgggactcgtgatactagatgtatttgctctgctcgcatggtacaccggtgtgctgctgcgccgttgcctagacagcaaggagggccttcagacgtacccggatatcggccatgctgcctttggaaccacgggtcgcatagccatctcgataattctgtatgtggaactgtatgcctgctgcatcgagtatttgatactggaaagcgacaatttatccaagttgtttcccaatgtacacctgagcattgggggcttgacgataaactcgcatgtgttcttcgcaatcttgacgacgcttgttgtcatgccgaccacctggctccgtgacctcacctgtctgagctatatttcagctggaggtgtggttgcatcaatccttgtggtcatctgcttatgctggattggggttgtcgatcatgtcggctttgagaacaaagggacggcgttaaacctcccgggaattcctatcgcgattggactgtacggttactgctactcgggacatggggtgttcccaaacatatactcttctctgaagaatcgcaaccagtttccttccattcttttcacctgcattgggttctctaccattttgtttactgccgccgcggtgatgggatacaaaatgttcggcgaagccaccgagtctcagttcaccctcaacttaccagagaatttggttgtttccaagattgccgtctgggctacggtggcaaatccaataaccaaatatgcattgaccataaccccactggccatgagtctggaagagttgctgccgcgaagccagcagaagtactccaacataattttgcttagatcagccctggtggtgtcaaccctcatcattgctctgtcagttcccttctttgcgcttgtgatggctctgattggttctttattcgcgatgcttgtgacctacattcttccttgcgcctgctttctggccatcctcaaggcaaaagcgacttggtatcagactgcgacatgctcattcatcatcgccgtaggggttacctgcgcctgcgtggggacatactcatccctctccgggattgtccagaactacgcaacctgattctccctacatacataattgagaagattgctcgttcaaccgcgttattatacatataattaagcatatgtatgagcgagagtggaggattcaaattttgccgaacaatgaattatgtccatcgatatataaatgttgtatgattaaatttgtattgctgttaaatttgtggcaaccccgataactttgcattattattgttaaatttgtgtgttgatggatctttatcagtataaagtcccagttcggctagctaattaccgactacttgaa

SEQ ID NO: 326 - DNA, 760 bp, Triticum aestivum
ccgcccgccggagatggcgatgaccgtggaagtgctcgctggacttgcgtgtatgttctccacgagtgttcttttgcaaatcctggcatgtgctttgtacaacaactggtggcctatgttagcagcactcatgtatatcattgtgccaatgccatgcctgttctttggcgacggatccacacggttcttgagtagcggagagggtggagcgtggatgaaagcagccaagttcctgaccggcatgtctgccatgggaagcctcgcaatcccggcgatcctgaggcacgctggcctgatcgagacgggggccatgttcatcgagttcacctccttcttcatcctcgtgtgcacggtactgtgcttccacagggccaccctggacgaggagtggtaaaggctcgcgcaggaccacaaggagtgcctgagagaagaatgcctgttaggatgtcgaaaagaaatcccttggtgggagggagctaacgtggaactgtgtgtacaaagaagcgtgcttcaagcgcttgactactgtatttacgtatacgcgtacccgagattcggtaatctagttggtaatccgtgctgaacaggtcgtgtaaagcatatgtgattcggcggcgttgatggacgcgaagcagtcttgctgtggttggtttgccacttgtgcatccagaatctgcacttggagcatggtacaaactattggatggaatgaagtgacaagattttgtttagatgttgcacctgaagccaaagttgctca

SEQ ID NO: 327 - DNA, 960 bp, Triticum aestivum
cttaatcacatgcacctttctgggaatatcttttgatctgctggctccaatcccttggataaagcatatactgaagaaattcagaaagaatgatatggtccagttggtccctgaagaaaatgaggaatacagatctatgaacaatgacgaagaaacaaatggtctggtatcgcctctaatgtctgagagagaagacagtgacattctgaatggtttcgaggggcatgatctttccatgtacccaataaaccggagcttccacatgccaaagcagaaattcgactttgcacaatactatgcatttgacatcacaatattcgcgctcacgatgatctactcactgtttgctccgcttgtggttcctgtcggtgcagtatactttggctaccgttaccttgtggacaagtacaatttcctgttcgtgtacagagtcagaggatttcctgcaggcaatgatgggaagctgatggatagggtgctgtgcatcatgcaattctgtgtcatcttctttcttgctgctatgttgctcttcttcgcagtccagggtgattccatgaagctacaggctatatgtactcttgggctgttagtgttctataagttgctgccgtctggaagtgatcgcttccagccgtccttgttagaagggatgcagacagttaatagctttgtagatggtccaacggattatgaagttttttcacaacctgacctggattggaatctgtatcaatcctgaagaaaactcaaggtcaatacacacttgtttcatttcgaagtcatctactatcaccagagcttcacattgtacatctcttgttcttttgtatagttgatgtagattaactccttttttctctagccggtctgttcgttttggaaatgacaaacacttcaatttagatcatgtaggcatgagctgtctatctgaattgcatgaaaaaacatcaggcattatca

SEQ ID NO: 328 - DNA, 3031 bp, Zea mays
gaaagaaatacctcttctccactccacctccgcgtccccaccttcagcgtcacgcacctcgacgcgcagcgcatggcgactcggctctcgtccacgggcccctgatctaggcagccggaccccgatcggttgcccgtgcagcgcgacccccacgaccaggatccagggagtcgggccacggtcctcggcaaggcatctcatcggcgaacgttttttcgaggccgggctcctgctcccccggaatctagggttcgcctcgccccgcgtcgccctcgatgggcccggccgcgcagccgccggacgccggcggcggtggggacccggaggcgtggtacggcagcatccagtacctcatcaacatctccgccgtgggggccgcctcctgcgtcctgctgttcctcctcgttaagctccggttcgaccaccgccgcatcccggggccctccgcgctcgccgccaagcttctcgccgtctaccacgccaccgcggcgcagatcgctctccactgcggcgccgacgccgctcagttcctcctcttcgagcgcgcctccttcctcatcctcgccgccgtcgccgctgccgccgtcgccgcggcgctcccgctcaacctcctcgcgggggacgccgccgtcgtcgaccagttcgcttccacgaccatctcgcacatccccaagtcgtccccgctcctctggctccacctcctcctcaccgccgccgtcgttgccatcgcgcacctcggcatctctcgcatggaggacgcgctacgcatcacgcgcttccgcgacggcaacggcaaccccagcgaccccaactccagctccgtcgccgtcttcaccataatgatccagggcatccccaagacgctggccgcggacaagaccccgctcaaggactacttcgaccacaagtaccctggcaaggtttaccgtgtcatcgtgccatttgatctatgcacgctggagcatctcgtcgagcaattggggaaggtccgtaacaagatctcttggctggaggcaaggttgggcgcccgcgacctgtttgatgacattgtgcacgataacgacgacacagtgcagtcagaagagcattggtttgtgcgaaggtgcagagggctgtgggcaatggcaggggagaggctagggttcactgacgaggagagattgaggaagttgcagactaagaaacttgtgctcgcaagcaggctatctgattataaggaagggtgcgcccctggcgctggtgtagcttttgtggtgtttaaagatgtctacaccgcaaacaaggcggtaaaggatttcaagatggagaggaagaagacaccgattggtaggtttttcccagtgatggagctccagctcgagagaagtcgatggaaagtggagagagcaccaccggcatcagatatctactggaatcatctaggtcttagcaagatatcttcacggctgaggaggattgcagtcaacacctgcctaattttgatgctcctgttcttcagttcacccttggcaatcatcagtgggatgcaaaacgcggcacgaatcatcaatgtggaggctatggatcatgccaaatcatggcttgcctggcttgaaggttcaagctggttctggaccataatctttcagtttcttcccaatgtgctcatctttgtgagcatgtatatcatcatcccgtcggtgttgtcgtacttctccaagtttgagtgtcatctgacagtgtcaggggagcagagggctgcattgctgaagatggtttgcttcttccttgtcaatctcatcctattgcgtgctcttgtggaatcatcacttgaaagttggatacttagcatggggcggtgctacttggatggtccagactgcaagcagattgaacgctatttaagcccatcctttttatcaagatcatcgctttcttccctggcattcctgatcacatgtacctttctgggaatatcttttgatctgttggcaccaatcccttggataaagcatataatgaagaaatttaggaagaatgatatggtccagttggtccctgaagagaatgaagactacctacccatgcagaatggtgaagaaactaataatttgacagcacctctaatgcctgagagagaagacggtggccttttggataatatcgaggggcatgatctttccctgtacccactaaacaggagcttccatatgccaaagcagaaatttgacttcgcacagtactatgcttttgacattactatatttgccctcacactgatctactccctgtttgctccgctcgtggttcctgtgggtgcgacatactttggctaccgttatctcgtggacaagtacaacttcttgttcgtttacagagttagagggtttcctgccggcaatgatgggaagctgatggacagagtgttgtgcatcatgcaattctgtgtgatcttcttccttgctgcaatgctgctcttctttgctgttcagggtgactcgatgaagctacaggctatatgtactcttgggatgttagtgttctataagttgcttccctctagaagcgatcgcttccagccatctttgttagaagggatgcagacagtgaatagctttgtagatggtcccacggattatgaagttttttcacaacctgacctggattggagtctgtatcaatcctgaagatcaatacacacttttgttcattacaatgacatctttcacgacttcgaacctggtgtatcaaagtcatttattcttcttgtacagctatgtagattaactcttgtcttcttagatatgtatttgttttgtcagatatgacaggcacatgcagttttggtgatgaacatggcctgtcaaaaaattactttaaatgatacatagtcattttcttgttttttttttttgtttaaggatctaaggtcctataaccagaagatgtcatatttatgcatccttgtgttgtagattccctatcataatggatggtgactagaagagataatttacatgactgatataagaatcaaaatttgttactggaa

SEQ ID NO: 329 - DNA, 1852 bp, Zea mays
cctgccacgccacgggcagctcagctcagccagccgcacaagccccaaacagaaagagactcacccaccgcgccacgcaacagcccatctccgctctgctctctcgcccaccccgattcccccccatggctatggcgacgacggaggccaccacgctgacggcgctgctcaaggaggcggcggccgccttcccgacccgccgcgcagttgccgtaccgggcaggctggagctcacgcacgccgccctcgacgctctcgtcgacgcggcggccgcacgactcgccgccgacgccggagttctcccgggccacgtcgtcgcgctttccttccccaacaccgtcgagctggtgatcatgttcctggcggtaatccgcgcgcgcggcgtggcggcgccgctcaacccggcctacacgcaggaggagttcgagttctacctctccgactcggaggcgcgcctcctcgtcaccaacgcggagggcaacgcggcggcgcaggcggccgctgccaagctcggcctcgcccacgccgccgccagcctccacgacgcggccggccctgtccacctcgccggcctcccggcccatgctccggagaacgggtcccacggcggcggcgcggcgggctctctctcccccaacgacccgtcggacgtggccctgttcctgcacacctccggcacgacgagccggcccaagggcgtgccgctgaagcagcgcaacctggcggcgtcggtgcggaacatccggtccgtgtaccgcctcgccgagacggacgccacggtggtggtgctgccgctgttccacgtgcacgggctcctctgcgccctgctgagctcgctggcttcgggcgcgtccgtggcgctgccggcggcggggcggttctcggcgtccacgttctgggccgacatgcgggcgtcgggcgccacctggtacacggcggtgccgacgatccaccagatcatcctggaccggcacgcgtcgcggccggagggcgtacccggcgctccgattcatccgcagctgcagcgcgtcgctggcgccggcgatcctggagcggctggaggcggcgttcagcgcgccggtgctggaggcgtacgcgatgacggaggcgtcgcacctgatgacgtcaaacccgctgccggaggacgggccacggaagcccgggtcagtggggcgcgcggtggggcaggagctggcggtgctggacgaggaggggcggctcgtggcggcggggagccccggggaggtgtgcgtccgcggggacaacgtgacggcgggttacaaggggaacccagaggcgaacgaggcggcgttccggttcgggtggttccacacgggggacatcggcgtggtggatgaccaagggtacgtccggctggtggggcgcatcaaggagctcatcaaccgcggcggggagaagatctccccgatcgaggtggacgccgtgctgctaggcctccccggtgtggcgcaggcggtgtcgttcggggtgcctgacgacaagtacggggaggagatcaactgtgcggtgatcccgcgggacgggtcggcgctgcgggaggaggaggtgctggcgcactgccggcggaacctggcgtcgttcaaggtgcccaagaaggtgttcatcacggacgacctgcccaagacggccaccggaaagatccagcgccgcatcgtggcgcagcacttcgtgcagccgaccagtgcctgatcgttgatcctggtgcttgccaagtcatgggtcgacggattggaatttcgctacactagctagcattttgccgttgttcccgcattgcgaggtggacatggcctgactgaacctgaataaacaaacacatgcatcgtctctc

SEQ ID NO: 330 - DNA, 7923 bp, Sorghum bicolor
tcggttcgtgcgagcgcgacgcgaccccagctttgcataacgtccgtccccgcgggccagcgcagcacagcggggcgccaaagagccgtgtccgcctgggattcctctccggctggcggcaggcctgatcgtggcctacctccaccgccttctccccgcccataaatagcgcccaccggacgacctcttcccctcgcgctctggttttcctctcttcgcgtcggtgttcaaccaagcgcctcgcctatcccgtcccatctggccgccttcgtcgcatcgccgcgtttgcgttttccatctcttcgttttcttctatgcttttcgattcgatttcgatttcgaaccggatcgtttcttctccggttgattgatttgtttcgctgctactgcgcttccgtgctctcgcagattccctggggcgtttcgctttcgtgcgacgcggggagcgaacctgagtttgatttggcggggttgttcggttaatcggtttgcggattattctttcctgcgattccgtctagctttcgtgtcgatcctgtttcgtcctctccttctcagcgtgtgggttgcaggattggattgggtccgattggggtcatatggcgtcgtgtgtggcgaggagatggaggcaggtcagtcttctgtcagatccggcgattcactatttttgtcacttggacatggattcagtggtttcaggctcaaaaattgtctgccggtgtggtaccatcagatagtggcggcgtcgtagcctggacacgaggtggattcgaaacctttggtccattcttattttaacggctgatctcggttgtggccttttgggtgtttgtcctccatttactttagagaagatgcagataaggaagtgtccttgctggttatggagagatcagttgatgggtggaggtttgcttatggttcagtcctcgttttttatttggtatatggctgttttgttgtcatcatggtggtgtgaagattgccaccggactaattagattagaagcttgattggaaaaatgttgttagctggatctgcagaggcaacagaggtgatgttttggaggtagattgaggcgttgactggactggatttcctagcatcgggagaagatcgtttggatatatctacctattgttcttctattgattcatcatcatactcttaaatttgtgtccgttgcaattcttttcttatattggggctggtggttttgtccagcagtttgaggaggcgagtcagcaactcgattatatggaaggatgggttggaggcgagttcgatcctgcttctgcttgtgcagtcagaagttcggaactgtccagggttccctgtgtttgttcaccaaccgtcctctcacccttgccaatgttctttgaaaattgaccttcctcataggctgcctttgaccttcattagtaaatctgcagttttggaaaacagtttgtcctcctagatgcaaaaggaaaggtccttgctggttatggagagattagttgaagggtggaggtttgcttatgttcgttgttttttattttgttatacatatatggctattttgatgtcaatcatatggtggtgtgaagattgccaccagactaattagaagcttcattgtccataattggaaaaactctgttagctggatttgcagaggcaactaaggtggtggtttggaggtagattgaagatctgactggactcagagttcatagcatctggagaagatctgtttggatatatctacctctcactttctattgatactcttaaattccttgtttcttatccatttgggctggtggttttctcctggatgatatggatggattggagcctgagtttgattctgcttctgcatgagcaataggaagttctgaactgtccagattccctgtgtttgttcaataacagtcctctcctgtcgatgttctttgaaaactgaattttctcgtaggctacctttgatgcttcgatactaaaactgcagttttgggaggcatcgccacagagataggaattgcatctgaaattgtcggcgattgatcaggctatcctatccccacattatttgatgaatgttcatgctgttttagtgttctcatctcactatcaaatagatactcacgagagggggtggtctcgctgattgcagatctctaggtgatgcttgcacgggcacaaaaggaaccagtctcttcatatactcaaacctacaaccttgaactctcaactctcattgtgtttgttcagtgtcttctacctcaaagtagataatgatcggggtcgttgttgcaagtcttctgatattttttgcatgggcttgtcacgtggaatatgtgttgggagtacttctaaccttatcaaatttacaaaatgctatgaatcatgatacttctattgagttaaaatccggatacttctaattccatctgcagtggtagaaggtactgggcatgtttgggacttgggagattcaagcagagatgggtagaactacagcactacagctttcatttaatcaaacttgtttctgctttatcatgctatgctttgaccgaaactttaattcttgtgctgctggcatttctgtgtttcacagatcaattagctgaagtagtaattggtagtccaacagtcaaaatgtttggtttgggatttctatctgtggatgctttgtctggctttatatgtttttgtgctcgcttttacatgtggttgcaggatgagtttggcaattggaaattcctgtagcaaagaactgaaatttgaaactgggggcaggtcagagtctagagcacgatcattccggttttgttagtttcgtcacttgttctcagtgatttcagatctaaatggttggataacattctggctctccatggatatcactgatagtaaaacaaggtttgagaccctggatttattcggtactgtatatagctcaaattggttgtggtgtgtgttcgtgtcctttagagatgcaggaggacattggaggtggactttcctcaattggagataacaaattgggaaaaaaattgtgacacttgacctttcacttctcacttttgtttatttggtctgcaattgtgttcatctgttttgattatatttccagccacttaaactttaaaaggatggtaggatgcctaggaattccttttgtgctgcaacaatctaaattacaaggaggcttctaattcttcatttctatcaacagtcctatccagttacttccttcaaccagtaactctttcaagtttctgcagatgtgacacacagaagctgagatagaatttccaaccatagttgctgtctccaaagcccatccctgttccactggccatttgttccgccttggatttgaaagtttttgaagcctatccctgaaccaaaatagacaggaatcgtagatgggctctttggtaaatgtagattctgcacttacaaatttgcaagttcaatctgatcctgatcgtaatatgtgcctgtccttcgaactctgctaccttcacttctgcactgaccagggaacttccggactgacctgctgtttggatgctctgcgctagttagatgattcacatgatcacaaccaagacaatgctctgcccagagtttgcgccaactactattatgattattgactgcacatcactttccagttcacttgtttgatttggattggtggttttcttggtttccagttctttgagagcgttaatgcttggaatcttggatgttaggagtgatggggcacaccttacaatattcttccatctaaccagagttgacacctaatactctttgctcatactggtcctttattttggatccagttgtctgatttaagttgatggatgtttggttggattcccgcagttggagctaaggtgtggatgggatggttaggccttctgagttctagacgtttccacctatggagtcttccttccagtgataaataatcctttgcataaactttattttgaagctgcccttaacccacatgcctcaactgatggtgcaggtccactatttgtgttgatttccagtaagaactcttgcttgacatgcataccttcattgagcaaaattattctgattctggaaacaattggttcctagtaggatattttacttgagaatatgtggtcatcatattcttatgtctcaaattcccaatctctccattaggatctctactaatgtttaatctagttcctagtttgcttctgattttactaactttggtataacccctagtccacctactcgttcagtaagtgcattcgttattaaatttgtcatattgcacagttctttttagtaagcatataagtattatatatattatatattatatattatatattattattatgagcaaaggcaacttactaactaactatactccttttagttcctggtttgctttcgattttacttcctttggtataacccccagttcaggtatttgttattaaattcgtcatattgtacagttccttttagtaatttatttaggtcttattgtgagcaaattcaacttactaactatactcttttttgagctgtaataactggaatagaagagagatctcatgtgatactgttatttagttttgtttgttatcatgaggttgattgcctggaacgaacagagcacttcctttactgcatcctttatgcctttatctctattttatgcagatccaatctgctgtttgtgacattggtcctccctttttttgaacttcgttctgcaatttcctcactttgggcttccatctggtgcatctgctgtggatcaaaaccgagaaaggatgttgctccttttgttcctcccaaagaaaatctgtctgaacaaacttgtttggttgctcttgactatgccagcttatatgcccatcttggtgacgcagtgcaagcttctctgtactttggatggaactggagtcttctgtttgcttgctgtttggccatttctgtcatggactagcagcttacatacatggattttcaatttcacattcggtttcacaagtttgggttgaagttgagtcatcctggttcagattattcaggctgttgcattgatatgcagtgtttgaagtggaagatctttaggattggagtgtagcaacaaaaactcggtggaagcttcagtgcttgcctaaattcattacgattgggtttcttgaccttaaatgattagtgaactggttggttccatttgtcacctgtacatgttggtgtttggtcaacttgaatgcaagctaggctggaattggttctgtttgtgtagaatctccaaattagtatggttcatcttgttatgtggtggtttagtagttagtttaacttcgcactaggattggtttgatttggttaggttggaaacccaactgcctgccttgcaaagtggtacaagcaacataggccatggcaatagtatcgtaacatctaatgtaccatgtttgtgtagtatctgcatttattggagctgacagctgagaaatggggatgctaaaatgaagaatatcagtttaatcaaattattagccaaagaaaccatattttttacttggatttctggttatcaaataataatatatggaatttgggagaaaacttggtacttctactagtgaacttgagctggcacctgtgtttccctatcagcggtcggatatctcaactgtaagattgcacgcgtgctggctgtttttttggttgtgcactttgactttattggacaagattaactggaagcatgtgatgttttacaattggcacacgttgaatgttcggagtcctgagactaaataaactactagatgcaaactccacatatttgaactaggtttatttacttgttgattgttgatttttgacttattgattgttcccactaaatgttttgttggtttttttcaaagggtcttccttccttgtttgttgttttgcacgattaacttgtcataacacatgtgctcaatgctcattcataagctatgccttgtttatatgctgaaagaatagctactttgtttggcgcacaaaccggtggcatgatttgtttaaattttttcaaataatgtctgaaaacatgattttttttcctggctattatttgtgtttccttgattgttttgtttgtttgtttgtttgcggtttaacactgcctttgccggtcccaagcccggatgcgaaaatgtggagggaactgcaggttgctcagttgcatgattggcattaggctactgggaagaaatgtggtttggtcaaacagctagacgctgaaagctcagagtagcatacctaaccatcgttcagcacctgtattctggtgtcgcattctgagtctctttcagttccactttataccattgcaatctggaatctgctggctaaatgttcagtagctgccgctggttctattcatttcaggtctggtgttcagacttgcagatgagggagcagggcatgtagcaaaagtgaaccagtttttttcgagaacgcatatatttctttaagcaacaaaagtgaaccagttgttaggacggtcatgtctcctgccgtggctggtaatactaattgttttggagattgctctgctactggtgctggacaagttctccttttcttttaaagagaagtgctggtcaagtttatttcattatccactgaatgaacgcatcaaaataaacttgtccgaagtgcccggacactggaggcacatccttgtcattgtccctgttaggcgcgcggcaagctacctgaacccgtttcatttcatctactgagaggtgggaactgattttttttttttttgagcaatcagggggggggattttcccacctggttttattgaagggtgactcaatgtcacaaaggattacgagaaagtttttgtaagggagactttacaagtataaacatgctagtctaggtaagctggtttagaatcgactgtagaaaaatacaccaagctgtgttgatgtccttctctttcttcttgaacctgggacgccaagcttctgcatccatggcacaggcgtgtatcacctggcgaagcgtaagactttcaccggttctccgacttcacatgaagagttgatctttgatccaatggatacctttaatcttcagcagtattggtgcctaagcgtgccttaatattgtttatctaattattagctttgtcaaactagcttagaactgtaagttaagccatgtacagtcccaggcctgcgggctgcgcccttatcgtggagataaacgcttagcaaatagcagtagctatccagctccttccctgggagatatctgtactgatggactcgctggattcagtgaagtagctgctacttggtcctaatttctccttccgttcttgtttgcatgttgatttctgtttgccactcatgctcctcgcatccctgtttggagtaggtattttacaccacctgaaagttttagctaagtttgtcagacctatgcacaaagcacaaaactttcgaacagagaaacgaagtagccgcaggagacgagtggccgtatgggcgcacggggcagggaacagcgagggaggcttcgtcggcggcgggggtgagggggttcgctgctcgcggcgccggccgcaccgccaagcatggcgccgctgcaatggtaacgtgtgttcagacctaaggaacgtgtaagaagaaatgtaactctgatcactaacctgcatacatgaaaatggtaattagagtgaagatcggagaagtagagaaaaactgttggacacgaggttgtagaagaggacaatattcttctgtttaggaatagggtggatggtcgggcaacataatcttgggcacattggatgcgaccctgaatgcaacgagcccaatttgtgagttaaacc

SEQ ID NO: 331 - DNA, 2201 bp, Sorghum bicolor
gccagcctgctctggatttcctgaatctgaaccatccaattttgattgacggccacgattgtagcagtagcgcataaaactgtcatccccgtgagcttcccaaaccctaaatttcgtttttcctcagtcttcactccccagcctaactcaggaacgcgccgctgctggcctgccgctcccccatcgaccctaccgtcgtaccgccatggccacggtgccctgttccacccacagagacatctccatgccactcctctcgtgtgtcctagttgtgctacaggcactgctgccgtcgcgggaagcgagccccgccgtcgtcgcgcagctgtctgcaggcgccgccaccgcgccgtcgcagggcgccgccggcaacgggggagatagtgcagccgcttcctgctgcttttccatgcgagcgagttgagggcagccgcacgcaccgacgcacaggctcgtgaagtcccgatccgttctgaacacatggtgggtgtccgtcattttgcgtggctatccactaaaactaactataataataagttgggtgtgcggcagcatatttcccatgatttttgaagtcttttagccaagatatgtttttttagtggcttttagcaaaggccacattctaacgatgtctcatagccaattttgtctttttttctgttaatgatttgcttcatgaatgagattatgtgatgcagactacggtgctgagtcattttcgttggatgcagactatgatgcttcggccttttctttttattctctggtttatatggagcatacttgtctgtcacttaagcaatagtaatagcttgacatatcttattctgtcctttttaccaactactagataaatgcttgccatgtgctgaatcttgtttcctaaaagcatatgtgttgttcactttgtggaaatttggtttgaaagcgtatatgttgctgcctatgtattttgtggtaaactgaattatcctgaaatcatataaaagtgtctatctaaatactgaatttcctcaaatttttagacagagtttgttcctgatgctttgtttgttgatcctaaataggcattacattctcttggcagtagaatgatatttttcctgatgttgggttctcaactgatgttaatgttgatggctggacttaggagctctctaaaatttccatttggcatgtgtatgtgctcatttattcttcagttgggttgcagcatgttgttacatgggcatgtcgagatagtaaatgcctagacgtgtttcatgtcgtgcagataatacaagcagctctgttatgtggttattttttttgttttcgatctggaccaggttcactaaatataattggttttaactggctgctgcagtatctgaaggagaaagaagacggcgcccaacgcctctgctccaaagcaggcaccacagaagcagaattgtcctgctggctgtgatccgaaatgccagtttgaagtgttctagagccagatccactggtacgcacggttcacctccctgttccctgtttcacccaccggtatgtacgcacttattttcactctacccattagtgatgtttagatctgtataagattcaacacgctgtgatactgggtatatctatttttcatgtagtactttagtattatctattttgagattaaacacgctggttttaacctacaactaccatattgaacaaaacttacttgtgacaaatcttttagataaaatttgaactcaacattgtttatatcaacatagtttctttgtttgattctgaaagtgctataacatttggtgagcttgtgcaccttactaagatgctttaaattctaatcttctctgaaagtatcttactaaaatggtttaaattctaatattctctgaaagtgcagatctggaacatttggtgatacattgtgttgctgaaacttgacatattctgctgctgcaacttgatgaactatgctactgcaacttcatatatggatgctgctgctgcaacttcatgcaattttgggaacctgtaatttgttggtggcttatgtgccatggtgcattgcacgatgtggtgctttatgtaactttgtatctcatcttatgagaataaacttgagatcttatggtgctggattgagttcttatataaataaaattgaattgtttgtctatgtgggctgtatatttgtatttgcaata

SEQ ID NO: 332 - DNA, 10583 bp, Sorghum bicolor
cttctcggagacggagtgaggcaaggtgaactttgagcggcgcgtgtatgcagcgtgcggcagttctactcagacacggaggaaggcgaactgtggcgtggagcgtgtttgtacgatggcgctgcgtgcgtgcgtgcgtgcgtgaggttgaagaaggtgccggttttgggccgtgttgtaaataaggcccattcgtaactcgtcctcagtgccttttttttgtcccagtagggttaggttcgcagggaagcactcactcgtttgttcggcggcggcggcactccaggccttggtcgctcactcctcaactcccgtccctagcccctatgcctgtggtgatcaagttggggctggtggccctggtcccctcgccgcatctgctcgcccctccctgcatcctatcgcggcgcggcggatccgatgcgatgtcccaaggaaggacggccaagttgagctctcgcgttcggttgtgaaggagacatatcgtcgctggtaggatggaggggagcctccttgcgcgactccatctgggcgcctcgccgtaggtggcgtccctgaggacgacgaaggcgttctcgccgtccgctgaggcagccggagccagatcctcctgttgccgttgcatcgtttgaggagcagatgatatctgtcagccaacaagagagtacggcaccttacccccctctctatccctctccgtttcagctaggtactgctgtagatttcagttttttgttgatgtatcatgcaagcatattatcttgccgcagttttgttttgactcaacgatagagcgaatcttatctagatctagaatttccccagcatgtattttccttaaggcagtagaatagaattcaggtagcaggctgtaaagtacattttctttcaggatttggatgattagtcatacaaaggtctagtatacattgtactgctgttgttatttattatatccggccagcacctgcagtattgtcaagtgagttgaattagtctgcagatagaggagatgagtggtgacaaagtgacgaggtctcctttgtctcactcacagctatgaccagctcagcctatgttgcccccttgatggcctgcacatttttcttcaggttcaaagtttgccctgcctatgtaaatcttggtcagtgcagtgttaggtgcagaccgatcctcaacctctagagtcaaccctttgattcgatatcatttgcacttgcagcaccaagtactgcctattctttttcagacgaaaagcgacagaatatatagtagcttcaaccttgtgtaaaaaaagctcaaattcatattcagtagttgcccctctgaatcaatgaatgtctgaattggttgtaaagacgaaaagcaacaggatatataggagtggctttagtaaaagaaaaatgaactcaaattcagtagttgccacctttgatttacagttagttgttggggagatgagaatcatcgctaagatttttgtgcatatgactccaagagaggcctttagttttttgttaaaatttttcattgcatcattcctgatatcattactatatcaggttttaggaaatgtgtgatattgatattggtgactttataggaaccattagtgacatgttagttcctaactgtttctaaattattgtcatgctgcttgatgttatattatttgtcaggctactatttgaagagtcacactggcacagaagttcattccagtatacatgggaagtgcattcagaaataaggtttgtggctgcaattatttgttcattacctgaaagttcttgtttattttttgttttgcttgcaaaatctgaattcctaaatgattttagtcatgagttatgctctagaatttaacagtgctgattaattacttagctggtgctgaattgtaaatttcaaatagactgcagtgactgaatgtgtttataaatcataattcttttgtaataatccatgtagctttcttgtttggtttaaaatagatcatttgaaaatttatgtggaaattcatgtaaccacccatgtccacttataattttgattttacattgtttggctatttgattatctcgaatgaggttacatcatgttgttggtcatgagtaaagacacggcacagaataatattatacatgtacacaataattttacattttttttctaccaacagtatctcactcatttggttaggacctcggtgtagacaatattcttagtgtatgtctcacttgtactaatcttctttgtcttcttcttcttgttcttcttgtcttcctcgtcttcctcttcttcatgttttcctgtgagtaccttaatgttctttgttgctgtcgctctagacagcgcaacatatagttggccatgagagaatactggattaggcaggtatacgcccacatttggtatagtttgaccttgcgacttgtttattgtcattgcgaagcttagtctaactgggaattgtttcctctttaaacggaatgggaacatctcatcgtctgagggacatagcggtattcttggcaagaaaacccgcattcctgagtgttgtcctagcacaatctctgcatcaattgcattcttctgaaacccacgtacgaccagtcttgtgccattgcaaagtccattagctgggtcgatattcctgagcagtatgattggacagttaagtttgagtttaagcatatgtggaggcagtccattcggtgtaaggctattcaggaattcaaggggatagtagttgtgtgggtcgtcttctacagaatcaaagctgtggtacaccatctccttcccctcaaagcgatcaatcatttttaggttgatgctatctacgcagtcgttccttgtggatagaatcgctcttgatgtgatgtattttggatccttcaaggaatcaccatcctttttgtagatatggttgatcagtttatccaagccgttatcttcttcattgtgttccacacatatgctttgaggcagaagtatttctccgttaccatttgtctcttctgtgccgttaccaacacgcagaaggtattcggcgaaccatgggtcgttttgagccctcatgtttcttgtgagcttcaagtgttgcatgcaattccatagctcggatctgcgtaacgatgtgtctactatctgtgctcttgaaccctttcggacaacaggaaggacttgtctgaaatctcctccaaacacaattgttttcccgccaaatggtagatctcgtctgtccattatgtctctcatgcttttatctagtgcctcaaccgcttgcctcttagtcattgatgcttcgtcccaaattattagtgatgctgcttgtagtagcttggctgtcccgctttgttttgtgaatccacaaattgatgtgttgtctaatcttagtggtaccttgaacctcgagtgcgcggttcttcctccaggcattattgaagccgcaacaccagaagtggccgttgctagagcaatcttaccttggttacgcacggtggctaggagcgctctgtaaaggaatgtttttccagtgcctcctgggccatcaacgaagaagatgcctcctttgttgctgatagctgttgataggatcttctcgtaggctatcttttgctcattgtttaggtactcatgcaaagttgtgtcctctgggtccacttggacagatgattcctcaataatctccctaggtacactatctgatgtgtcatgttgtatgtcaatttttggaagtggaaacgattctatgtcttttcccattgactgcaacatgtccctgatattttttagtaccatttgttggactgtgtgcttgcacttgcagtgtctactatagtcttctgacattgcctcaaggtgattgttccaaagactacggatgtcgtttggttcgcaaaacaccaggattgttgcaaacagtcttctcagggatgatggcattcggaacagctcagcttctctcatgcattcatctattgtgttgtctgcctcaatcagtcctcttttttctgcagcgtcccgaaacgttggcattacttgaccatcaaccgttctaagctcttcatagctccttgcgcccggaacatggtttaggagtaccctaagatagtaccgttctccttcagctggatgtgctgcaaccaacctgccaatctggtatacagttttctgttttcttgtttgccatagcttgtatcgtgtgttccaagtatatttctcgggaaagtctctgtacagtatgccacgtgctttttcatcattgttgttcctttcgaagtatgcagtcagcattgacctttctgtgcctccacggttgataacatccttgattttatctttgccattgtatgaaatcatgtgcatgtttgggaggtgcagctgcagctgctggaccggagggtttattttgcttaattcaaagccatatattctccacagtgcttctggaggtgtcacccatcgtgcatctctgtactgtcgaatctcgtcgacttgtgcttcgttttctgccccgataacagatatagatgccttgtcatgtcccttgtataggtatttatataggtacttcactgctttaatgctcgagcatatctcaacatttatgtggcagttgaacatcatcaataggtaagggttgtaaggaacaacccacctgttatctagttcgcattttctgactattgcggaccttccgtcgttgcgtctcctatataatgggtaagagtctttgccttgtattgtagtctcaataaacggctttgggtaattgttcttgcatgacttgcgattctttgtgcatggacaatatctgttgagtgctccgcagggaccatgcatcatatgtttgactaccaatttgtatagctctgggtatttgtgcttgttaggtagctcggcggagatgattctatcgtactgttctgggcatgtgtacttgtattttcctgtcatgattagcaagaagtgagcatgtggtagacccctcttttggaattctacaacataggtataagccttgacctctccgagaatgttcttttcaaatagctgcttcttcatttcttctagttttgctctgaaaacacgaacaaccaggtctgggcaatgttgtggtgtctgaccaaacttcagttcatttttgatctcttcccagttagggttgcatgtcatcgtaaggaatatgtctggttttccaaattttctaaccagagccatagcatctagataccgacgatgtttatctcgtggccctccaataaatgatgatggaagtattctttttccaatttcattcccctgctgctcgccagcttgaatgctatccaggagtcctttgtataggtctgctctgatttctttctgatgatgatacaagtagtccaatctagagttttcgatcttgatgtatgtatctacagcaaactgttggaatagccgtccgccatgtaacactggatcgaaaatattttgtcgtacatggaatttgtagcagtagtattctctcatggttacgcacaacctgctgtttgaatctattttataatattgaaaagtcaagagttaatttcacatggatgcatatgctatatatcataatttaattttgtaatgtggtatactaacctgggtcctcgccattatattttttctttgcacgagcctttatcacatcttccatgcttacaccgacttttgggatgtctggatgccaacctagttcgccctttggaaataatataggatatgataatggatcatagcatccatggtatgatcgtatgccttttacttcaccgtttaagccatggagtattatgttcttgtcagtggtatttcttctttcgtttccttctatccatactgcagctatctctttagtgattggttcgttgtatactctctgatccaatctttggtcaaggttcaagataattctatagtcctcgatgttctgggcctgtcccaaacttctaaactgttttgagtatgggttatcgtgtagaacgtctgtgagtatgctcattacatgcttgtcttgctcatataattccttgcgacaacgacgataacgatgctcaagacttggatcatcatcatagaagtagagctctaggtgtgtggcatttgctggagtattaccaatcgagggtacattgtggtatatctgaccatgtgctcgaaaggtgtagatgccggagtttctgatgtcaatcatgtctctgtcaagctgacaatataaagtggtaaatgagaagtgtccgttgaagaaccttatgttgtttcgaaaatgtagtgcatctgaatcgttgcttgtccagagcctcatgagttgagttggtgtctctgtatttgctagtctgatatctcctttcttacaacataagccttcggattcatactcaaacttttttgcattgcaaaatttgcaattttgcacatttttgagcatgtgagccttttctggtatgttgctgtagacaatgtcatatgggtcaaaaacttttgaatcctcatcttcctcgttgtctgagatttcaatttcatcatctatttcccactctgtttttagtaacagaatttaaaaatcaacaaagtatataattaatttaaataacatgttttgaatatatttagcataccttgagcagagaacatatattcatcctcgttggtgtcttgttcaaatatcactccatcattgtctgcacattaatgtttttaatttatattagttctcgatttcataagcgcataaataatatctttataaacaataccctgatcttcattgtaggctgatattggtgcatctttgtttttggtagttggacacattgaagagggaatatctgtccaagaagtatggttagttatacataaggttgtatattgtcctgtaaataattactcgataaacttaccatgatcattactatagattgtttgtggcccatctttatttttggtggaagtgggaatatctgtcaaagaacctgtccaagaagcatggttagttatacttaaggttagattttgtcctataaataaaaactcgataaacttaccatgatctttattgtaggttgtttgtggttcatctttgtttttggtggctggacacatcgaagcgtgaatatctgtaaaagaaccatggttagttttacatgagcttgtaatttgtcttgaggcgtcaaaagtatcatataattatagtgttaccattaatcatggcttgtaaatgtggacgccccctgtcgtcatctccatttaatgtttgtctttctcccggcgtcacatgcttcctttgatttaaatcaatggttgatgttctaacttccatgtctggttgtgtatatgcagggttctctaaggcgattgaatatttggtttgtgctctacgcttgaactttttgttttctgtaattttcttaattctagctgccttttgttctggttgcatatttgcatactcttcacggttccttttgattctttctatctttttttcattgctcatatgtgcatatcgatctctctctcttttccttttcttttcattggcatccattattgaatcttctaaccctaatggattgttttcctcattgttttttgatttgtttgaatctataaagcaaaagaatgaatattaaatatagtgtgatactttgcattaatgtaatagagaaaagaaaaaacaatatttaattaagtttacctattatgtttccaagtttctctgtgccatttgcagcatgtacatcttgacaactatcaatcctgccatcttcatgatgtataatattgcctactattaggcgggcttgccctgtgatggtagatccaggtgcgggtcctttgagagactctttatttttttgcttttcatgataggcttcacgaagccttttaagcatttcctgctttttttcatttgtcatcttagcataccgctctctctctcttttcctttttttttgctttgcatccattaatgtatcttctacctgattgttttttgtaatgtatggatctgtagatcaaaaagagtgtataataagaacaatatgatattttccatgaatacaatagagaaaaacattaaagcaatatattcaagtaaatttaccttgttgcaattttgtttttaggttttcagttgcctctatgtcaccttcattgccgacatcttgacctccagtgtgtacatcttgatggaaggggacgtggcagcgacgctggcttactggcctgcgcgtggcagtgataaagacgctagctctctggccggctggcctgcctggccggggacgtggcggcgaggctggctcgctagctggtgctggcttatctcgcagggaacgtggcggcgagactggctcgccgcgacgctggctcgctggctggcgctgggacgtggcggcgaggctggctctctagccggcgctggcctgtctcgcagggaacgtggcggcgagactggctcgctagccggcgctggccctagctcgcgtcgcaagaggcggactcgcagcgtcgcaagaggtttttttatgttttttttactttgatctctctagggctgtttatataaaatatttgtagaccaatttggatttggacatctatatattatattatatagcagattggcagtcctatttgggtttggacatctatattatagctattgtaaaatgtaacgtaacctatacggatgtaacgtaacctatacgtgtagaccaatttggattagcagattggcagtcctatttggatttggaaaatgaaacgtaacctatacggatgtaacgtaacatatacggactgcagactggagattgtggctatttaacctatacggatgtaacgtaaggactgcagactggagattgtggctattacgtggagtacagactggagattgtggctattatggactgtagattggcagaaaaaaaaagggcagactgaaattttggctctttattagtaggtatagatatgttgtacaactccctgacgtgtttttatttttttgctattcaggagcctagagtctttgtcttcaagttgtacctacatccagcatgtattttcactagctactatcaactgatgaaaaacatttatgataatttgaagaaagatgaagaactagttaatggaaaactagtcacaccaaagtctggggtcttcttagttcagttagtgccagagaaggaagatgaattgccactcacttttccttttggatgtagtgatttgtacatggagggctaccattacaacagtaagtatttttctttgttttcaacaatttactttacattctcgttgaattcactagaatgaaatgcaccataggtccctaaacttttctcacattcttgtctaggtccattaattttcaaagtaaaatacaccataggttgttcaacttttgaagtggatcattctaagtttattttaggtctaagcatcatgcatttgaattcacttgaaaagttaaaggacccaaataatcactttaagagttcatagacccagatgagaatgaggcaaaagtttaatgaccaatattgcatttatctcaattcactgttttggttataggagtatggtataggttttctaatcatgaggctgatcttccttccaagaatcaatttgattacacttagagagtaaagctggttcttacctcaagctatgcatatctttgtggttataacattaagattggtcatatagcatttaagagatgctattatgtgctacgtaaaaccaatgttctccattcatctaaggaagggctacaagagctcagatcgggacctttggcaacacctacagttggaatctcagaagctttgcgcttcaatgttcaacagagattggtaaagcatgcactctattctggtaagaaaatctatatcactgaaaaaatcttcaattatttcaatgtgtgggggactttgtctattgcaatgtatactgaagtggtcccaaaagagtgtcttcttagcttgacacagattagcaataaattatgggtgataaagcgccacctttaatttgcaagaaggtaattagtcctcctctctctttgtgtcgtctttgttttgcttaatattagcacttatatgtctttataattaaatgcataatttccctttcagtcatagaaaatggaaaagaaaatgaaaaactagtcgcatccttaatcgaatggcagaaaaaagccgagaagagaattgtcgaagctgtttgcaatgttggtgatacaagtaacacaatggagtatgttgttttattttcagatttagttacacccacggccacggcgacacggcgttgtagctctatgaactgatctactctccaccctgtgttttcccgccctggtatatcaagagtttattttgttttatgcttttagctcgctctgctttcgaaaaaatgataagttttcgaacacataaagagatactcctagcaaaaatattctactcttttatgagctgctattagtagaccaatcacaagtttgtttagtttctcccaaaaag

SEQ ID NO: 333 - DNA, 1136 bp, Sorghum bicolor
gaagatggcagcgcgtggcttcaaccgcagcaaggaagactgcaagaaaaggttcaaaagcgttttacactattacaaatataactacaggcaaatttccaccggcaagcaatattactgtggtagtccattggagcgccacctcaatcgacttgaggccaaggcggcctcggggtcttcgtcggcggcggagtcgtcgtttgcgggtgcaggcaaggcacgggcgaggccgaaggcgaaggcgggggagaggaagaagcggcgcaggagcgtcgggctggcagcgcccgctggccagtccggcgcgggggtggcgcccgctggccagtccggcgcaggggcggcggcggcgcccgacgccctactggcgctcgtctgtcgggaaatggactggcgcgagcagaggatcctggagcgcgttcaaaacatgttggttaccgccggcgtcctgcccagttcctttggcggcgtgttcccccccccccccccacctcctcctcctcctcctcctcttccattcggcgtgtacccgccgccaccccctctcgcgatggcaggccatctccagcagttgccagtatattatctgttaaagttgtggcttacgcttcaccttgacatttacttactaggaatatttggtgattttttcttttgcaccaaggttaggtgcttcttttacctgaatttttaatggaacccacaaatcttttgtgatgtttctttttttcattctgagatctgatacagttaataatgcatgtgatgctttctcaagcaattggttggtagaaagcatatcatcaggtcaatagtgcaccaatcataggctaggacccattgtagaactggatgatttgtctggaggtctattagtggttgtggttgaaattaaatatgtgcattcagcatttgtcataaagtatagtaacacataacatgaatcagaatagataatgaaatcctgatactagaaatatggtttattgaaaatgggtagctgtcgtctatcacttcgtagtcgacagagcatatgtttctgtatagattatgagatatcttggattgttagtagcttttctactaatgttcaaactgcagaacgtaaaggagattaccaaggaaaaactgttcag

SEQ ID NO: 334 - DNA, 1445 bp, Arabidopsis thaliana
acctaatctcatcaccttctcttccctccactcaaatctctcctctcttctttcttcttcttcaatacaatacaatcaaaagaacagagagataaggttagagcaaaacactgtctgaaacaaacaacaaaaaaatggcttgctctaatctaacaacaatgtgggtttcatcaaaaccatctctttctgctgattcatcttccttatcattccgatctgttctcaagtgcccaactaacacttcctcacctccttcacgagcttcctctgtttcaccactccaagcgtctcttcgtgagctcagagaccgtatcgattcagtcaaaaacactcaaaagatcaccgaagctatgaagcttgtcgctgcagctaaagtcaggagagctcaagaagctgttgtcaatggacgaccattctcagaaaccctagttgaagttctttacaacatcaacgaacagcttcaaaccgatgatgtcgatgttcccttaaccaaagtcagaccggttaagaaagtagctctcgttgtcgtcaccggtgatcgtggattatgtggtggattcaacaatttcatcattaagaaagcagaggcaagaatcaaagagcttaaaggtctaggtcttgaatacacagtcattagcgtgggcaagaagggaaattcttatttcctccgtcgcccgtacatccccgtcgacaaatacctagaagccggaactttacctacggctaaagaagctcaagctgtggctgatgatgtcttctctctgtttataagtgaagaagtcgacaaagtcgagctcttgtacacaaagtttgtctctttggtcaaatcagaacccgtgatccacacgctactgcctttatcacctaaaggagagatctgtgacattaatggaacctgtgtggatgctgcggaagatgagtttttcaggttaacgacaaaagaagggaaattgacagttgaaagagagacttttaggacaccaacagctgatttctcgccgatcttgcaattcgagcaagaccctgttcagattcttgatgctttgttgcctctgtatcttaacagtcagattcttagggcattacaggagtcattggctagtgagcttgcagctagaatgagtgcaatgagtagtgcttcggataatgcatcggatctcaagaaatcgctttcgatggtgtataatagaaagcgtcaagctaagattactggagagattcttgagattgttgctggagctaatgcacaggtttgatttgttttgaaccctctttgaatcttctatatgagtccaaaactctcttcttcttctttttttttcgttatcgtttgtataatgtataattgataatctctagaactctttataatcatgcaattacaaacaaaaacgcggttgtatctattttggcttttcattggataaaatgatggagatcttcgt

SEQ ID NO: 335 - DNA, 1300 bp, Arabidopsis thaliana
aaagtcgactgtgttcaaccatatgagctctgatggtgattctggtaacaggaaattcatgaactttgtgattcattgcatcaagaatagaagactagaagggggaggttaattagattatcttaaggtgtataaaatggaaaaaaagagtgtaccaaattctgataagttgtctctgattagagtgttaagaggtataatatgtctgatggtgttagtttcaacagcttttatgatgttgatattctgggggttcttatcagctgtagtgttgaggcttttcagcattcgctatagccgtaaatgtgtttccttcttctttggctcgtggctcgccttgtggcctttcctctttgagaagattaacaaaaccaaagttatcttctctggtgataaggttccttgcgaggatcgagtattgctcattgcaaaccaccgaacagaagttgattggatgtacttctgggatcttgcactgcgtaaaggccagattgggaatatcaaatatgtgcttaagagtagtttgatgaaattacctctctttggttgggcgtttcacctctttgagtttattccagttgagaggagatgggaagtcgatgaagcaaacttgagacagatagtttcgagttttaaggatccccgagacgctttatggcttgctcttttccccgagggcacagattacacagaggctaaatgccaaaggagtaagaaatttgctgctgaaaatggccttccgatactgaacaacgtgctgcttcccaggacaaaaggtttcgtctcctgcttgcaagaactgagttgctcacttgacgcagtttatgatgtgaccatcggttataaaacccgctgcccatctttcttagacaacgtttatggaattgagccatcagaagttcacatccacatccgtcgtatcaacctgacccaaatcccaaatcaagaaaaggacatcaatgcttggttaatgaacacattccagctcaaagaccagctgctcaatgacttttactccaatggtcatttccctaacgaaggaacagagaaagagttcaacacaaagaagtacctcataaactgtttggcagtgattgccttcaccaccatctgtacacatctcaccttcttctcatcaatgatttggttcaggatttatgtctctttggcctgtgtctacttgacctctgctacgcatttcaatcttcgttctgttccacttgttgagactgcaaaaaattccctcaaattagtaaacaaataaactttcattgctttcagttcacaataggaattcttt

SEQ ID NO: 336 - DNA, 2363 bp, Arabidopsis thaliana
ctctctctccgaacgaaatcactgacctgacctgatctctctctctcttcctccgtctcttctccgtatcggctttaggtcttctccgggaagaaagcttcgaacccaattaacgccggacggtagactgtgaccgactagtccccaaaagctcaagtcaatgagaaaatgctcctcaattttaacgttttagagatccatacccaacaagccctgttttcgcatattctttccgttggtttctcaccatcttcgtcgctatgtcaagagttttgatctctaaaatcgttggaaagcaaacacaatctcttgtctcgaaccagaaagatagagtgtctcaatggggaagctatagaactgcttttacagctgctctaaggtcgcctcagctcagaacttactcttcatctggtaggattccgagtaatgtgtattgtacttttgcctttagagatctcaaaggaagttttttaagtaatcatctgtctcgaagttatactactgcccctgcaagaaatgtagttagtcatcatgcccaaattgcttggagaaggcttcattataagtattctgagcgtattagtaccattgctcaggcgtttagcttgtctcttacccgttcgcacttgttaatacctgggatcgttgctgtcacttgtggacaagtagcatgggcacaaagagctcctggttcggggataaatcactatgcttcagataaatctctctatacaagggctaagaatggtcctatctttctgtcttcgttattgttttcggttatagagggttttatcttgattgggagggctttttatatagcttgtttgtttactcctactattctgatggggctggttgtggaatcatgtgggcctcgttttaggaaaatatggcttgagatggtccatcgaactctggaaagagcaggtcctgcttttatcaaatggggtcaatgggcagccacgcgacctgatctattccccaaggatttgtgttcacagctctcaaagcttcacagtaatgctcctgagcatagcttcgcctacactaagaaaactatcgagaaggcatttggtcgtaaactttctgagatatttgaggagtttgatgaggtgccagtggcatctgggagtattgcccaagtacatagagcttctttaaggtttcagtatccaggacaaaagtccaagtcttcgctggttgcggttaaagttagacatccgggtgttggtgaatcgattaggagagattttgtgataattaatttggtggcaaagatatcgactttaattccagctttgaaatggttgagattggacgagagtgtgcaacagtttggtgtcttcatgttgtctcaagttgatctcgcgagggaagcttcacatttgagtcggttcatatataacttccgtagatggaaggatgtctctttccctaaacctgtgtatcctcttgtacatcctgctgttttggtggagacatatgagcatggagaaagtgtggcacgttatgttgatggaatggaaggacatgaatggattaagactagattggctcacatcgggacccatgccctcttgaagatgctcttggttgataactttattcacgctgacatgcatccgggaaatatccttgtccggaaaaaggcttcccgtggaggccttttcaaaacgaagaagcctcacattgttttccttgatgtgggaatgactgcagaacttgcaaagaatgaccgagagaacttacttgactttttcaaggcggttgcgcgtagagatggccggactgctgctgaacgaacacttaaattatcaagaaagcagaattgtcccaatccagaggcttttatcgaggaagtagaggaagcattcaaattctggggaacccctgagggagatttagtacatccagcagattgtatgcacgaattacttgagaaagtaagacgtcatagagtaaatattgatgggaatgtgtgcactgttatggtgacaacattagttctcgagggttggcaacggaaacttgacccaggatatgatgtgatgcacacgttgcaaacaatggtgttgaaaaccgactgggctaagtctctttcttatacggtggatggtctgatggcgccgtaggcgaagaaaggttccatctttttgaaattttgtttgttatcatcataggagtcgaaacaatttacacatcttagatgagagaacatagaaagaaagtacatgttcttatgttccttttgtttttttctttcattcttttgtcttttgctttttattgtcatggattttggttcattctaactacatagattgtatttacgcggttggtttccgttataaaccgcctgt

SEQ ID NO: 337 - DNA, 1324 bp, Arabidopsis thaliana
tctgtggcaatttgtgtctttcttgcttgttatatgatggataacatcaactttgaattctcaaacgcttcacaaggaagccggctacagttgcagcaacaaccgccccagccgtttaatttacaagacttgaatatgattcaatacaatcaaccatcatctccttggactacggagaccttctctggtctaactccgtacgattgcacagccaatcaatcttttcccgtacaatgttcatcttcaaaaccctacccttcctcgtttcatccgtaccatcatcaatcttctgattctccatcattagaccaatctgtatcgatgattcctatgcagcctcttccggatcaatatatgaagccattatatcaaagatcttgctcgaacgattttgccgcaacaaatgcttcatcagcctcttactcgctttcttttgaagcaagtcatgatccacaagaactatgcagaaggacctatagtaattctaatgtaacacatcttaatttcacatcatcacaacatcaacctaaacagagtcatccaagattttcttctcctccttcattctcaatccatggagggtctatggctcctaactgtgtgaacaagacacggataagatggactcaagatcttcatgagaagtttgtggagtgcgttaatcgtcttggtggcgctgataaggcgacgcccaaggcgatattgaagcggatggattctgatggactcacaatatttcacgttaaaagccacttacagaagtatagaattgcgaaatacatgcctgagtctcaagaaggcaagtttgagaaaagagcttgtgcaaaagagctgtctcagcttgacacaagaactggagtgcaaattaaagaggcacttcagcttcaactagatgttcagaggcatcttcatgaacaactagagattcaacgaaacctacaactaagaatcgaagaacaagggaaacaactgaaaatgatgatggaacaacaacaaaaaaacaaagagagtcttctgaagaagctaccagacgctgaagcatcattgtctcttctcgatccccatattcactctcctccttcgcctttcttggtacacgacgctgaagccctgatgctaacaagttatgaagacactcaactccagtccaccaaaagttgaaaaatgagagatactctggctaaattagaaaaggcctaaagcatgtttctactctattcaaagtggtataaagttataagagtcgcgacaagaatgtccaaagtgctacacacactaacacttggaaacagaatcaggtactaaatgtgagcaagtggtgtgt

SEQ ID NO: 338 - DNA, 1786 bp, Hordeum vulgare
gcgctagggcttaccaaaccccccaggggcgggcggtggtgattcttgctgcctgcgaggaggatgcaggccaccgggagcgtgacttgggtcgtcggcgcccaggcgtccgtcttggggagatgcagcggcggggtgccctacccttcgccgtcgtcttctgcttcctctgtcaggtcccaggggctcggcacggtgcggtgctccgtgcaggcgcaggagaagaagccacgggttaggaagactaaggaggagcggagggagatggttgagtccttcgttgacacgtatcgggtttcaaacagcgggaagtttccttcagtcaatcttacacacaaggaggttggaggatcatattatatagtccgtgagattatgagagatatcatccaagagaacagagttcttggccctggtgacttgaatgctaagacattgagttttgaggattgccctgattcttcagaattatcaaataggcatgaattgggccaagacaacatagagatattagatatgtctgatgggtatcatggcaacaaagattctgtgttggaaatgtctgacaagggtgaagcattttcattgcaaacgaatttcatcagcactgaacagttcctgacttcatctgatatcttggaatctggtattctgaacagtgtactccacaatgggaatgtagaagatgcaacatgcttggagccaaaccttgagaaacaagatgaagccttgcgtgggaaaccaagggagtctcagactaagagttctgaaatgcaagccccatctcttgctcatgtttctgatttgcataaagaaactgagctcaacaatgcaggggatgcacatgacgaaacaaccagtagcatcactgatgaggttactctttcctcagaacctagtgtagtttctcaaacaaacggtgcacttctacatgagcatgtgacactacctgacgattgtggtggcataactaatactgctgtcgatgaagctattggttgctcagaaaataatggtgttcttcagacagatcggatccttatacaggagcatgagatattacctgaaacagcaagtatcaagacagaagttgttaagattgcagatagccaatttagatctgcaacatctgcaactcaaatggatgcttataccttgaatacaagtgcagcaacaatggaatccgctgcgtccattgatcatcatgatgtgcttgagccaccactgatcaatgccagccctaaccaacaacgaatgtcagaagatcttgcctctcatccagcaatggatacaaagggttttttgcaaaaggaagacaaccacaacatggtagagaaagatggaagtgaattcaagatatcagtatctggcatcacagaagaagagcgcgaggcaagcaaggccaatcatgaacatgtgataagtgcgacaacagcgatcagcaggagaactgggaagggacagcagaagaaagaggacaacctattttggcttatcgtaagggcatttgttgtttctatgtccaagttgtgggcaaaatgattgatgggcgaaatgcatcttcatctgataccgctgcgcttcatgggatgtcttcctgcctactaagaaacgagaagcactttgtgaagctccattctccccaatgcatatagatgttcttcttgcgcagcacttagggtgttttgttatgcttggtttagtttatagcctaattttgtagttcagatgtattggtcaacttgctctgctgtgtcaagttgacactgccaactctagcgtactg

SEQ ID NO: 339 - DNA, 1774 bp, Hordeum vulgare
gcctccatttcaatttcaaccccgtctcctctccattcactcgccactcctcgctgcgctgcgccgcggagagttcctccctctctcaagagcccaccaaacgcacgcgcgggcggaggcgatcggcggcgcgatggcggcggcgacgacgatgacgtggcacgaggagctggccacgctcgtcggcgacacgggcgtgcgcctccctgccgccgcggcgccggcgcccaattcgggggcggcggcggtcgggggcggttggtacggggaggaggaggaggggaaggtggaggaggggtgggcgcagcaggccagggggttcgccgagtccacggcggagatgctgcgggagctggggctcggcgtgtgggacgtcgccgcgcagagcctcgccggcgccgaggacagcgagctcgcgcggcggctgcggcggccggcggcggccgcgggcaagcgcctcagcttcatgaacgagtacctccccgaggaccgcgaccccgtcaggtgctgggccgtcgttgccgccgtcgcattcgtcgcgctcctcgtattaggtgtaggaagtggcgatgataccccagtggagcaaccgaagaaactttacataagccccccaaatgctaaaagatttcaacttcctgatggaaggcatctggcttacgaagaaaaaggaatttcagctggaagggcaagattttcactggttgccccccattcttttctttcatcaaggctagctggaattcctggaatcagctcatctcttctagaggaatttggggcacgacttgtgacctatgatcttcctggttttggtgaaagtgatcctcatccaggccgaaatctgaattcttctgcattagacatgcttcatttggccgatgcccttgggattgtggacaagttctgggttgtaggctattctggaggtggcatgcatgcttggagtgctctgcgctacattcctgaccgggtggcaggtgcagcaatgttcgcccctatggtaaatccatatgactccaagatgaccaaggatgagaaacgtaaaatatgggacagatggtcaactaaacggaaactaatgcacattttagctcggaggtttccatcactattgcgcctcttctatcaccgaagcttcctttctggaaagcaaggacagcctgagagttggttatcattgtcaacgggaaagagggacaaaactttactggaagctcctatgttcaacgcattctgggaaaaggatgttgcagagtctgtgcggcagggagatgcgcaaccatttgtagaggaagctgtgctgcaagtatctgattggggtttcagcttgtcagacattcaaatgcagaagaaagaggatcagggggtgtttgaatttatcaagtctctgttcagtcaggctgagcgagagtgggtgggatttctaggcccaatccacatttggcagggaatggacgatcgggtggtgcccccgtcggcgaccgagtttgcccggaggatggttccaggagccaccgtccacaagcttctcgacgaaggccacttctcgtacttctgtttctgcgatgagtgccaccggcagatattctccaccctgtttggcaccccgcagggccctctaaaccctgtaccggaacccagtgaagtggcccgggaaccgacggaagaaacaagccctgcatacgaagaagaagaagaagaagtcgcagaacaggagcaggaaacatcaggcctggcctgatatcatgttcagcatcaggatcatgagtaa

SEQ ID NO: 340 - DNA, 1077 bp, Hordeum vulgare
tttccgatggcctccacgtcctcgtctccgctctctcttgtcctcctccggccgctcccatgcagatccctcctcctctccaagcacaggaagccattccccaccccaagaactggccgcctagcagcttcagcagcagcagcaggagcccagcagcggttgctgcggccgccggagaccggccggtggagcgggagctcgaggagcggcagagacttcgcgtgcttatcctacaacaatccgcccccgccttccagtaaggactcgaatgagtggcccatccttcgccggtgggatgtgccgtgggagtggcaaactgttgtgctcagcatggtgggctgtggagtaagctttgctctgacaggattggttgagcagtcgatattgcaatacgtagggtattcagccgcgggggcaaccatagatgagaaggcggagatactgttcctcggacaacttagcgtgactgctgttgtgcttggtgttatatttagcatcaccaataccttccgaccgttccctgatgatgtcttccgttacgatgttaaagaaccattcaagctgcaaaatggctggcttctgtgggctggtattggcctctttggtgcagtcatttccattgctttagttggagctgccatgagctatctgaatggtgcacctccagagagagagaaggactcactggtccttttactgccactaattggctcatcaactctcagcactgcctatttggtggggattactggagttctagcaccaattctggaggagactgtgttccgaggatttctaatggtgtccttgactaagtggtttcctactccagtctgcgtgattctcagtgctgctgtatttgccttcgctcatttgacacctgatcaattcccacaactgtttgtattaggtgttgcactaggatttacatatgctcaaactcgcaatcttctagctcctattacaatacatgcattttggaactcgggagttatactgctgctaacctttcttcagttgcaagggtacgatatcaaggagctattgggggcatcttgaaggctttataaccgataa

SEQ ID NO: 341 - DNA, 494 bp, Hordeum vulgare
agaccaatcttcggcgagcccatcggcacattctcagagcggagaggaagcaggaggcggcggatcaaggagaggagacgagaagatgggtggcggcatggaggtgaacaagaaccggtggatcgaggagtggaacgccggccgggagaacctcgagctcaacttccgctttacccgccgcagcctcgccgtcatcggcctcttcggcctcgccgtccccatcctcgtctacaagggcatcgttcgcgaattccatatgcaggacgaggacgccggccggccgtacaggaagttcctgtgagcgtcgcctccggtggacgtcgaggctccgagccgtctgcagggcttcggtcagggagaaggaatctccattcggtttgttcccgtactgttgtaatcaggccggagtattttggagatctcttatgttgtgcggtttgcgtttaataagctgtaaggaaatgctgcttttctgattgctgaaacctgacaag

SEQ ID NO: 342 - DNA, 968 bp, Hordeum vulgare
caggcaaagcaatgaggaggtacagcccccagtaccggagccccccaaggaggggatatggtggcagaggtagaagtcccccaaggaggggatatggaggacggagggagcagggttcaggaagcctcttggtccgcaacatcccattaagctgcaggccggaggatcttagagttccttttgaaaggtttggtcctgttcgggatgtgtacctgccaaaggattattacaccagggaaccccgagggtttgcatttgtggagtttgttgacccttatgatgcatctgatgcacaatatcacttgaaccgctcattattttttggccgagagataactgttgttgttgctgccgagtcacggaaaaggccagatgatatgcgtaatagagctagagtcagggggtattctggtgaacctgaaaggcgtaattctcgttatgggaggtcccgttcccgttcacgctcctactctcctcgctatcggggccgtcctcggtcaaggtcaaggtcatactctcctgctccaagacggcgagatgattactctgcttccccaccaagatcacatcacacacagtctcctaggcgtctgccaaagggacatgaagaagacgagcggagatcctattctcctgctggtagaggtggcggcgagcgtgatgctgatactaatggaaagagaaggtcgccgccatctgacattgacaggtcgcctctacgctcacgtaggcactcctcggggtcacctgtggggtcgcgctcaaggtcccctgaagcttctcctgcccgcagcgactgataagattggcggtgttacccgtattgccccgtctcccgtggccatgtactcttatctatagcttcattgtctgagtaaaacccatctgggatgtgttggctggtgctgcggtgcctctttagttagcagatgtgacttgttggctgcttggtgttgctgaaccttgta

SEQ ID NO: 343 - DNA, 845 bp, Hordeum vulgare
ccctgttggaagagttcgtgcgaaggccagcacacaccctcccatccctcctctccggccacaaccccaccgccgccgccatggtgaagtactcgagggatccgtccaacccgaccaagtcggccaaggcatgtggcaaggatctcagggtccacttcaagaacacacgcgagacagctttcgctcttcgcaggatgcctttgggcaaggctaagaggtaccttgaggatgttctcgctcacaagcaagcaattcccttccgtagatactgcagaggtgtgggccgtactgcacaagtaaagaaccgccagccaaatgggcagggtcgctggcctgcaaagtcggcccagttcgtgctggatttgctgaagaatgctgagagtaacgctgaagttaaaggcttggatgtcgacaacctctacatttcacacatccaggtgaaccaagcccaaaagcagaggcgccggacgtaccgtgctcatggacgcatcaacccttacatgtccaacccctgccacattgagctgatcttgtcagagaaggaagagcctgtgaagaaggaggctgacaacgtcgttgcaccaaggaaagctatctaagctaacggagtggctgcatttgtctgagaatcttagttgtagttcctttcaagtacctttggtggcagtgtttgttgcctcctagatgtttttggtaccaacatggagtaaggatttgttaaggttgatgctatccttgtgattgcgaatggtctttatatatgctaaaactgtttcggatattcgagcattagcccaccagaacttgtttcttagagatctttgtcctttcgggctgtacactta

SEQ ID NO: 344 - DNA, 1067 bp, Hordeum vulgare
ccaggaaccaaatcgaacaaccgagagaagccatggagcgactgcagcggatcttcggcgccggcgggatgggccagccgccgtcggactcgccgctgctcgactcctccgagcaggtctacatctcctccctcgccctccttaagatgctcaagcacgggagggccggcgtgccgatggaggtcatgggccttatgctcggcgagttcgtcgacgactacacggtccgggtggtcgacgtcttcgccatgccgcagagcgggacaggggtcagtgtcgaggccgtcgaccacgtcttccagaccaacatgctcgacatgctcaagcagaccggcaggccagaaatggtggtagggtggtatcactctcatcctggttttggttgctggctatcgggtgtcgatatcaatactcaacagagttttgaagctttgaaccccagggcagttgctgttgtgattgaccccatccagagtgtcaaggggaaggttgtcattgatgcatttcgtctcattaaccctcagaccatgatgcttgggcaggagccacgacagacaacatcgaatgttgggcacctgaataagccatctattcaggctcttattcatggtctcaatagacactactactccattgcaataaattaccgcaaaaatgagctcgaggaaaagatgttgcttaaccttcacaaaaagaaatggaccgatgggttaattctgaagaaatttgacgcacattcagaaaccaatgagcagactgttcaggaaatgctgagcctagccatcaagtacaacaaggcagtgcaagaggaggatgagttgtcccctgagaaattagcgatagctaatgttggacggcaagatgcgaagaagcatctagaagaacatgtctcgaatttgatgtcgtcgaacatagttcagaccctggggaccatgcttgacacggttgtcttttagtctaccactagtgttgttccaaccatctatagactcacccagtctatcattcatgttatatgtatcaaaagcctgcctccacgcagcaaggtacattcgggttctaactga

SEQ ID NO: 345 - DNA, 382 bp, Hordeum vulgare
aaaggatccgagacacagcttgcgaacgcggcgggcaatggcgatcagggggataccttcggcgcgggagatgacgatggaggagttcaaggagtggctgaagcagttcgacgtggacggcgacggccggatcagcagggccgagctccgcgaggccatccgccgccgcggggggtggttcaccaccctcagggccgggcgcgccgtccgccgcgccgacagggacaacagcggcttcatcgacgacgccgaggttgagaacctcgtcgccttcgcgaagaaggatctcggcatgaggatctctgcctggtagccacctgcctggactgtggctccatgggtttttatcttctatgctatgctcggcctatagggtaccttt

SEQ ID NO: 346 - DNA, 970 bp, Hordeum vulgare
cggccatggagaccctcctctccccctccgcattgctcggcccgctccggggctccaggaagctagcggcccccgccgccgtcccgtgcagcaggtccgccgtctcctgctcgctcaagaagcagacgcagacgcaggcgggcgtcgcctggcatggagacggcggcgtcgggagctgggcgtcgttcttgcaccacggcctcgccgcggcggcgctgtccctggccctcactctgtcgcccgcgcccgcgccggccgtggcgtcggagttcgacgtgctcaacgacgggccgccggccgacacgtacgtggtggacgacgccggcgtgctgagccgcgtgaccaagtccgacgtgaagcgcctcgcccgcgacctcgaggcccgcaagaacatccggatcaacttcgtcaccgtccgcaagctcacgagcaaagctgatgcgttcgagtacgcggaccaagtgctggagaagtggtacccgacggtggaggagggcagcaacaaggggatcgtggtgctcgtcaccagccagaaggagggcgccatcaccggcggcccggccttcgtgcaggccatcggcgacgccatcctcgacgccaccgtctccgagaacctcccagtgctggcgacggacgagaagtacaacgaggcgatcttctcgacggcgaagcggctggtggcggccatcgacgggctgccggacccgggcgggccggcgttccaggagagcaagcgggagtccaacttcaagagcaaggaggagacggacgagaagcgcgggcagttcacgctcgtcgtcggcggcctgctcgtcatcgccttcgtcgtgcccatggcgcagtactacgcctacatctccaagaagtgatccagtcgagcgccgtgcactgtacagtacagtaatttttcgaatccccccggttttctgttggactaaagttttagaagtgaacagagagagatcaatgc

SEQ ID NO: 347 - DNA, 511 bp, Hordeum vulgare
aaaggatccctagctttacctccgccaccaagcgcctccacgatgaagctcgtcagattcttgatgaagctgaacaacgaaacggtgaccatcgagctgaagaatggcaccaccgtccacggcaccatcatcggtgtcgacatcagcatgaatactcatctaaagactgtgaagctcacactgaaagggaagaatcctgttacccttgaccaccttagtgtaaggggaaacaacattcgttattacatccttcctgacagcttaaacctggagacgttgctggttgaggaaacaccaagggtgaagcctaagaagcctactgcagggaaacctatgggtcgtggacgcggccgtggtcgtgggcgcggtcgtggcagggggcgctgagctatgttataccttggaaattttgcactgcatgcttgtgtgcagtgtaatcttgtttcttagttgtcggagcaatattcgtattagagccaagacgttgatattggctgtacccggtaccttt

SEQ ID NO: 348 - DNA, 697 bp, Brachypodium distachyon
tctccctcgtccatcaccatggcgacccacgttcccggatccctattctcgttcctcgtcgttctcctcttctcctgcgccctgaccgccggcgctctgcggttcgacctgtactcgggccacacaaagtgcatctccgacgacatcaaggtcggcgccatggccgtcggcaagtaccacatcgtgcagcccgaggactcctctcagctcccggacccccaacgcatctcgctgcgggtcacctcgccctacggcaacagcctgcactactcggagaacgtgcagtcgggcaatttcgccttcacggcgtccgaggccggggactacctcgcctgcttctgggcgcccgacttccgcccgccctccaccgtcgccttcgagttcgactggcgcggcggcgtcgccgccaaggactggagcaccgtcgccaagaagggccaggtcgatataatggaacttgagctcaagaaacttgaggataccatcaaatctatccatgaagaaatgttctatcttcgtgaaagggaggaggagatgcaggaactgaactggagaaccaactcacggatggcttggcttagtttcctctcacttggtatctgcttaccagtggcagcgttgcagttgtggcatctgaagaacttctttgagagaaagaagctgctatgatttctctacgactaagaacattttggca

SEQ ID NO: 349 - DNA, 733 bp, Brachypodium distachyon
ggatccgggatctctctggtttcctcatatcaccagagaaagaagagaggaggggagcgtgcaagaggcggaaatggctgcgatatcagcagcattctccggctgctgctcttcgtcctgcctgtcccagccgggcctgctgccgaccacaaagtcgagaaggcacttcaaggtcacggccatggctcccaagaacaaggtgaacaagtacgacgaggggtggtcgaagcagtggttcggggcggggatcttcgcggaggggagcgaggaggcctccgtggacgtgttcaagaagctggagaagcgcaaggtgctgagcacggtggagaaggccggtctgctgtccaaggcggaggagctgggcgtcacgctctcctcgctggagaagctgggcctgctctccaaggccgaggacctgggcctcctcagcctcgtcgagaccgccgccaccgtgtcccccgccgtgctcgcctcgctctcgctgccgctgctcgtcgccgccatcggcaccgtcgtcctcgtgcccgacgactcctcgctgctcgtcacgctccagacggtcgtcgccacgctcttcgccgccggcgccgcagggctgttcgtcggctccgtcgtgctcgacgggctgcaggaagcggattagcatcatggcgattggcaaatggcaactagtatgctctgagtaaacgatcaccactcgggtacccgagtggtgatcgtttactcaggtacc

SEQ ID NO: 350 - DNA, 2095 bp, Brachypodium distachyon
gcatcaaccctctccttatccccttgcgtctcccgctctcccccaaccaaagctcgcccgccatggccatggcctccacctcctcctgctcctcgcggccgccgctcctccacccggcctccagaaccccgaacccctcccgcctcccgccgctcgtatccagggcctcctcctctccccgcccgctcctcctctccttcgctccgcccgcgcgcgggcggttccgcgccgccgctgtgcagcaatccgacttcgaagacggggaggaggaatgggatggggaggtggaagaggattattacagcgaggaggaggaggaggaggaaggggaggagatggacgtggaggcgatggaggaggaggcgcgggccgccgccgccgacctcgccgcgcgcctcgaccgcgagctccgcgtcgatggtgatgttcgggagaaaagaagaaccatgagggataagacatcgacatctaaacatatcccagacaataatcttccgaaggtggcagttattggcaggccaaatgttggtaaatctgcactgttcaatcgtcttgtcgggagcaacagggctatcgttgtcgatgaacctggtgtgaccagagatcgtttgtatggacgatcttactggggtgatcaagagtttatggttattgatactgggggtgtgattactctttcaaagtctcaagcaggtgtaatggaagagcttgccatcacaactactgttggtatggatgggattcctctggcctctagagaagctgctattgccaggatgccatcaatgattgaaaaacaagctgttgctgctgttgaagaagcagctgtacttctattccttgtggatggtcaggctggtcttgtggcagctgacatagaaattgctgattggttacgtcggaacttctcacacaagtgcatcatacttgctgtaaacaagtgtgaatccccaaagaaagggcaaatgcaagcattagaattttggtcactagggtttacacctgtaccaatatctgctattactggcactggaactggagagctccttgacatggtctgttcagaactgaaaaatttcgagggactagaagggttggatgatgttgaagaagacgaaaaccgtgttcctgcaatttccatcgttggaagaccaaatgttgggaaaagtagtattctaaatgctttggttggagaagatagaactattgtaagcccagttagtgggaccacccgtgatgccattgacactgagttcaccacagaggatgggcagaaattcaaactcattgataccgcaggcatccggcgaagagcagcagttgcttctgctggcagcacaactgaaacgctttcagtaaaacgtgcatttagtgccattcgtcggtctgatgtggttgcccttgttgttgaagcgatggcctgcgttacagagcaggattataaaatcgcagaaaggatcgagaaagagggaaaggcatgtgtcattgttgtgaacaaatgggatacaattccaaacaagaacaatgagagcactacgcattatgaactagatgtaagagagaagctccgagtacttgactgggcacctattgtttattgctcggcaatcaatgggaacagcgttgaaaagattatttcggccgcttctttggtcgaaaaggaaaggtccagaagacttggcacctctattcttaatcaagttgtaagagaagccgtagcattcaaagcaccgccgcggacaagaggcggcaaaagaggccgtgtctactacacaacacaggccgctgtccgaccgccgacgttcgtgctcttcgtgaacgacgcgaagctcttcccggagccgtaccggcggtacatgcacaagcagctccggtctgacgccgggttcccgggcacgcccatccggctgctgtggcgtagcaggaagcgggcggacaagcagcggcggaagtccaacaacacggaggctcgtggctcgctcgtaggagccagttcgtagcacgtgaaaaggaatgccagaaaaggaatgcatgcctctatgtcgcgaaagaaaaagagaagaaatgtactagcgagttattaggaccgtcacaa

SEQ ID NO: 351 - DNA, 3581 bp, Brachypodium distachyon
ctcatcgtctccatcctaaaccccgccattcccctcctctcctccccccaatggaggcctccgcctcctctacgcctcaagccctcaccctcctcacctcctcccctcgctttctctctctccacccttctgctcgccggcgcggccgcggcagcggaggagggctcctgctgcggcctccgcctcaccggaggttagagctgggataccgtgccaaccgcccgctggggtgctccgtcagcggttcgacggacgtatcagtggacgttctgggcggctcggttgccgccgcggccgctctcctcgctgccttgcagctgttgtggctcaggtggcgcggcgcgagggatggggaatctccggaggttttatgtacacaggacaaaagcattgtaaataaggaacttaggacaacaacacggtcggtatatgatagtaattatgcaccttgtgcaactcatgaaaatggattttcagagccatctgtttctggaggaatgactcctgaagtggagtgccaggctggtattccgtgtgtagatactgtaaatacgacaacacgggctgtttctgcgattactcgagggacatcgttacagacattatttgatgtatctggaaaagaagaagctagttgctcaacttcagcagaaaaaacaagttccactgaaaatattatgaacgttcttgcgatgccacactctctgtcacaaggacaacatacaaagtatatctctaacagaatgggctggcaaggtggactctctcgccattttttatccctttcagaacaaaaggaacatgctcaaattgacaaaggtcctagtgatagcaaaacagacagtgagaatgctcatttgcttcaatgccagcagagtgaccaagaggaaaatcttgatttgacatctctttcatcctttaaaagaacagtggaatgccctcttaattttgttccccaagccagaactggaaatttgttcaaatcaagaaaagctattgagtttacagatccatatgaagggggctcttatttgacaccagggaaattagttccagttgcatgcttaagggaaggtcctgcgagtaaacaaaagaaagcagtgaaagatcatgacgctgcaaaaactattggctggactatttccgatatactgagcaaggagaacctagagaacttcattccggcaaagacacttggattaaacggcacagtggacacatcagattacataaggagatacaatagttcattaatggatggaaggttgaaagactgtgtagatttgttggaaaacatggagcagaagggattgcttgatatgaagaagatccaccatgccagctttttgattgcctgtaagaagcaaagggctgttatggaagctgttcgcttctgcagattgattgcaaatccgaaaatgagcaccttcaacatgcttttatccgtttgtgctcattcacaagattttgatggggccctccaagttatgatgctcctaaaggaggctgggctaaaacctgattgtaaactttacacaacactgatatcaacttgtgcgaagtgtggaaaagttgatgcaatgtttgaggtcttccatgagatggtcagtgctggaatagaaccaaatgttaacacatacggtgcactaattgatggctgtgctaaagctggacaagtggcaaaagcatttggtgcttatgggatcatgagttcaaagaaggtgaagccagatcgagttgtcttcaatgctttgatcagtgcatgcggtgaatctggagctgttgctcgagcttttgatgttttatcagaaatgacggcagaaccctccgaatctaaaggatggaagccaattcttcctgatcatgtcacagttggagcacttatgaagacatgtatccaggccggccaggctgatcgagctcgtgaagtttacaaaatgcttcaggagtacaatataaagggtagcccagaagtttacacaattgcattgagaagctgtagcttgactggtgatctaggtttcgcactgaagatctatgaagatatgaacaagattggagtaataccggatgagatgtttctgagtgctctagttgatgtagctggccatgctaggagggctgatgctgcctttgaaataatcaaagatgtaagagcaaagggatttcatgttggaatcatggcatacagttcctttatgggcgcttgttgcaatgccaaggactggaaaaaggcactgcagctatttgaggagattaagatcagcagattaactccaacagttccaatgatgaatgctctgatcacttccctatgtgatggcgatcaagttcaaaagtctattgaggtccttaacgagctaaaggaatttggtgtccgtccaaatgagataacctattctgtcttatgtgtggcttgcgaaaggaatggtgaagcagaactaggtattgatctatttgaacaattaaaagtagatggtattggccttaatcccaccattgttggttgtgttactggtttgtgtctacaaaagttttccaatgatctttcccttggcaatatcattgtcagattcaacctggggaaaccacagattgataataaatggaccacctcagcaattatggtcttccgtcaggcaattaccgctggtctgttaccctcaagtgatgttttatctcaagtgttgggatgtttgaggtttcctcacgacagttcattgaaaagtactttcattgataacatgggaataagttgtgatatgccacatcaccctaatacatattcactgttggaaggattcggtgaatatgatgttcgtgctttctcaatactggaggaagctgctttgttaggagcagtggcaagtgcttccacaaaacatagccaaattgtcattgatgcaagaaagtcaaagatgtacacagccgaggtttctcttttgatgacatttaagtccctgaagcatcgactagctgcaggtgcaaggttaccgaatgttacgattttgttacccacagaaaagaaacaagttgatcttgatgaaagagagaaaacacttaaacttgctggaagagttggtcaagcagtcggctcccttctgagaagattgggaattaaatatcaaggcgaggagtctcacggcaggatgaggatcaacggcctcacactacgaaggtggtttaatccaaaattcacgagcacaccctccactggaactccagcagaattgcttccactaccctcgagattagcaaaagggatcgctgatcagcagcgcgatatcagaagcctttctttatagcacaggtttaaccttttccatggcccaaattttggataccaagaaggcaatttaccgtacagcatcagcagacctcagaaactagctagtcaaaaagatcaggatgacgaaatattttgagagcttattgggtggaaagaaaaatgcaacacagcacacagttctgtgcatcaagttgcataataaatgtattcatttcaggatttaggatatgaagcctcttttttctctttcttacattacatgacctcaggctgtctggcatttctcaagaga

SEQ ID NO: 352 - DNA, 306 bp, Brachypodium distachyon
ggggatccccacgagctcaaatctcaatcgatcggaggaggcggagaaccggagatcggatcggcgatggcgacgttcgacccgtggccggtcttcttccgtagggagtggaagcgcaactggcccttcctcgcgggcttcgccgtcaccggcttcctcatcaccaagatgaccgccggctttactgaggaggacctcaagaactccaagttcgtccaggagcacaagcgccgagcctgacgctctcaggtgaaggaatggctgctgcagttcccagtcattataagcgtggtcggctagggtacc

SEQ ID NO: 353 - DNA, 1499 bp, Brachypodium distachyon
gccttaagactcatccgtgccgcaggtccccaatggcgtcgtcctacaactaccccaccaccaccagccctgctactactattaaccctagcttccccgccccctcggccccgccgctgtacccgacgctgaccatggccgacctcgcccccgtcgagatcccgaccaccccggacggcgcgccgccgccctcggaggacgtgctcctccgcctccccggcgcgcagctccacctcatcgaccgccgccgcagccacccgctcgccgcgggcgacctctccctgcgccgcatccgcgccggcgatgcctccctcgccgccaccgcgctgctcggccccatccagtggccgctggcccgcgacgtcgccgccgtcaagctcgacccgcgccactactccttctccctcgccgtccccgcatcccacgacgaccccagccccgacccgctccactacggcctcacgctctccgcccccgacccgcgcctcgacgccgtgctcggcgcctacaccagcttctccgtccattccgtcgctggcagcgaggcgctcgccggtggcgcccgcggcgaggtggaggcggccgcgtactggaccgctgtcgcgcccaatgtggaggagtacggcggcgccgtggccaaggcgattgcgaggggtgctgagaacgtggccaaggggataatatggtgtggcgtgatgacggtggataggctccggtgggggaatgaagtcctcaggaagaggatccagccaggtgatactgacgccgaggtcagcccggagatgctgagaaggatccaaagggttaagaaggtgacaaaaatgtctgagaaagtggcatctggaatattgtctggagtcgtgaaggttactggctatcttacaagctcgttggctaattcaaaagctggcaagaagttttttagtatgttgcctggagagattcttcttgcttcgcttgatggatttggcaaaatctccgacgcagtagaggtggctgggaaagatgtgctatccacatcctcgaccgtgacaactggtcttgtatcccacaagtacggagagaaagccgctgccgcgacgaacgaagggatggacgctgccgggcacgccattgggactgcatgggccgtgttcaagatccgtcaggcccttaacccgaagagcgccctgaagcccacgtcactcgccaagtccaccatcaaggccggagccgccgatctccgggcgaagagcagcaagagcaagtagagcctgaagccgtccttcctcgtcgcaaccggctgtgttggatccttgtcctgaccagaagaacctttgcccccagaagtcccagctgatgtgctgcttgtagatattatgtgctggaggaacctggcaaccagcagcagcttccctactgtgtcctcccctctgctgttgtgaacgttttctgttgtgtttctgagtggagtatcgttgttttcgtttgtgcagtgttagttcaacgcagaagaattc

SEQ ID NO: 354 - DNA, 1547 bp, Brachypodium distachyon
aaagtcgactctcaatcgagactgcaacaacgaacacaaatgcaaacaccaaccatgtccacgtccatggcagctcgggcaacgtcggcggcggcgaacctccctgcaccaccaccaaggcaatgctactaccacctcctgccacccgcaggtcgccgctccgtgtgggcgctctccgcgtccccgaagaagaagaacccatggctggacccgttcgacgacgggcccgacgaggacttcgactacacgggcgtctactcaggcggcaagcaagacgaggatccacggcccccagaagacccgtcaaacccctacggcttcctccggttccccatgggctacaacccggagctcgacagcctcgcctccaaggtgcgcggcgacgtgcgccgggcctgctgcgtggtgtccggcggcgtgtacgagaacgtgctcttcttccccgtcgtgcagctcctcaaggaccgctaccccggcgtcctggtcgacgtcgtggcctccgcccggggcaagcaggtctacgagatgtgcaagaacgtgcgctacgccaacgtgtatgaccccgacgacgactggcccgagcccgccgagtacacgcaccagcttggagtcctcaagaacaggtattatgacatgatcttgtccacgaaactggctggcacgggccacgcgctgttcttgttcatgtcgtcggctcgcgagaaggtgggctacgtttaccccaacgtcaatggcgccggcgccgggcttttccttactgagatgttcaagccgcccacaaccaacctctccgatgggggatataacatgtaccaggaaatgctggagtggctgggccggccgggcaagggcgtgccgcagcagccgataccgccgctcagggtgtccatctccaagaagctgaggggcattgtggaggacaagtacagccgcgctggcgtcgagaagggcaagttcgtcgtcgtccatggtatcgcctctgactccgtcgccaacatgacgtccaggggagacgatgactgcctcctcccccttgaacaatgggcagagatcgccaaagcgatcagctctcaaggcaatggactgaggcctctgtttgtgatgccacatcagaagcatagagaagagatcgaggacattgtgggcagggagaccagctacctgtttatcaccactcccgggcagctcacctgccttatcaatgactccgccggcgttgtcgcgaccaacaccgccgctgtccagctcgccaatgcccgtgacaggccatgtgtggcgctgttctcctccaaggagaaggcgaagctgttcctgccatacgcggaggataagaagagctgtactgtcgtggcgtcggcaactggcaagctggccgacattgacatcgaggctgtgaagaacgcagtgaaggagttcgagcctgctcccagcttcgcattggcacaaaaatgatcaaaacgatcatctttcttgattgtgttgtaaatagatctgcacagcgagctcatctgaccagcgggaggctaagagttcagtgcgaattcttt

SEQ ID NO: 355 - DNA, 978 bp, Brachypodium distachyon
ctcttcttttctgtccgtctcgccggcgagcgcttctcgagatgcccgccgcggcggcgcgctgcggctgcccgctcctgctccggcagcaaccggcggccggcctccgccgttccttctcctcatactccggcatgcggcgtgtctgcgcagccgcagggggtgggagcgggagcgaggggcggccgccggcgtacggcgggctgctgctcgacgccggcggcacgctgctgcagctggcgcggccggtcgcccagacgtacgccgccctcggacgtccatacggtgtgacaaagcgtgaagagtacatcaagcagggattcaagcgggccttctctgcgccatggccgaagacgctcaggtaccagggtgatgggcggccattctggaagattgtcgtggcagaagcgacagactgcactaacaatgattatttcgaagaagtatatcagtactacgctcgtggagatgcttggcgtctgccggatggagcttacagaacactgcatgatctgaaagatgcgggagttaagctagctgtcgtatccaactttgacacacggctaaggaaattgcttaaggagctcaatgtctcggatctgtttgatgccattatagtatcatcggaggttggatatgagaaacctgctccagagatcttcagaatagcgttagatcaaattggtgtggaagccagcaaagcagtacatatcggggatgatgagactgctgacaaggcgggtgctaacgctataggactcgagtgctggttgtggggagaagatgtcaagacattttctgagatacaggaccgaattctagcaaggaacccgcaatgagtgcggatttggtgttggacatcgttggacctctctgctggtgatctgcacgaattgttcatttgtttcaaacttctgttttcatgaccaggaagtcccgagggcttttgtttatctgttttatcgcacgatgttcttg

SEQ ID NO: 356 - DNA, 1676 bp, Setaria italica
gcgaagcagccatgatggcagccgagccctcgccgttgtcggccgcggctggcgacctcgaaaccctcgccctcgactcctcgtcgtccgccgcctcggcctccaccgaccccctcctccgcccgccttcctcccagaccgccgccgccgcgaaccacgacgccttcgtcatcgacgacttcctcgacgaggaggacgacttctcccccgccccggcgcccagcatcgcccgccatcccgcgccgcgccccgacgcggcgccccccgtgttcgccagaatcaccgtgtccgatccgaagaagcacgcggagcccagcggcgggggtgccgccgccggcgtgatcccgggctccgggagctacttcacctacctcatcaccacccgcctcgcgggcggcggcggcggcggggaggtctgcgtacggcggcgcttccgcgacgtggtagccctcgcggaccgcctcgccgcggcccaccggggcctgttcgtcccggcccggcccgacaagagcgtcctcgagggacaggtcatgcagcgccacgacttcgtgagccagcggtgcgccgcgctccagcgctacctctgccgcctcgccgcgcaccctgccgtcggacacagccccgacctccgtacgttcctcaccgagcctggtgccatccccgccttccagggcgaggcgccacggtactggactaccacggtgaatgctgctgctccgctagtgcaggccaaagctgggagggacttatttgggatgttcaagggtctgaagcagactgtggtgaacgggctggtcgcaaccaagcctccacctgtggagcaggagacagacacagaattcctggcgcacaaggccaggtttgaggatttacagcagcagctcaccacaacatcacagcaggctgaaacacttgtcaaagcccaagatgatcttagagaaactacaggtcacttgggaatgacactgattaagctggcaaaatttgaaagagagcaggctacatgtaattccctaagaagaagagccggtgaaatccataattttgcaaatcatgttttgaagatgagcagatcacagataaaattaaactctgaaattgtgaaacacctgggtagcatccatgaatacttggaggccatgatatcagtcaatcatgcatttacagatcgctccaatgctttacatcacgtgcaaagtttgtcagcagatttattttctttgcacacaagggcaggaagacttgaatcttcatcagcaagagatatggggcatgagtggtcgacatatcagaaggtggagggattgaaagaaacaataagatcagcagaagcagccaaaagtgacgcacttagagaatatgaaagcattaaggaaaacaacaagattgaaataaaaagatttgacaaggaaagacgccgcgatttcattgagatgctgaaaggttttgttgtaaatcaggtatcatattcagacaattttgctaacatgtggacgaaggtagcagaggaaacagaagtatatgcaaacaggggcaactgatgtacaagcctgtatagggagtatagagtagtggattttgatatatttaatttgctccgacgtccagcgacacaaccattcttgattcctccccagttttgccaccttgggttggttgtaatgccacatgagtag

SEQ ID NO: 357 - DNA, 603 bp, Setaria italica
acgataagctccaagcgaccggacgccgataaaatcgccccacccactccgcccgctccccctcttccgccgtcgcctctccagcctccactttccccatccttctccgccgtcgcggtcgcctcgcagtccgaagagcctccgactccgatggccagccgctgggtccgacccgaggtgtaccctctgttcgcggcgacgggcgtggccgtcggcatctgtggatttcagctcttcaggaacatcaccggcaacccggaagtcagggtaaacaaggcagggagggcagctggtgtccttgaaaatcatgaggaggggaggcgttacgcaatgcacggcctcaggagctttgtgcatgacaagacccctgaaatcatgccagcgattaacaagttcttcactgagccaaagtgaagcattttgcttggctgttgactgctctgcttaaatggctattgtcgattgtacccatgtcatccataaattgaagcacagccgatacctcttattgaaagtaccgtatgagtgcgattggtcatgacttcctatgtgtgcgatggtcgatgaatgttgtgattgatgatgacttcctgtgtgtgcaat

SEQ ID NO: 358 - DNA, 1668 bp, Setaria italica
acgccatacaacacggatagaggacgaccacgccggccgcagcgcgagtgtgacgacgacgacgaccaccaccaccaccgaggccatggcgcagcttccttccgggagcgtcgtcagcggggaggcggagctcgtcccgactctctcctcgctggagccggtctacggcgagggctcccagctcgacgaggcgcggctccgcttcgcccgcctcggggaccgcttccaggccgtctacggcgcccgccccgcgctcttcgcccgctccccagggagggttaatctgatcggggagcacatcgactacgagggctactccgtgctgcccatggccatccgccaggacatgatcgtcgcgatccggaagtctgacagcagccaggtgcgggtttccaatgtcgacgacaagtaccccgtctgcgtctacccggccgaccccgacaaggaaattgacataaaaaaccacaaatgggggcactatttcatgtgtggatacaagggtgtatatgaatactgcagatcaaaagggatagatctgggcaaacctgttgcgcttgatgttgttgttgatggcacagttcctcaaggatctggtctgtcaagctctgcagcatttgtctgttcggcaacaattgctatcatgggagtccttgagaaaaacttcccgaagaaagaagttgctcaattcacatgtctctctgagcgccacattggaacacagtccggaggcatggatcaggctatatcaatcatggccaagcctggatttgctgaattgatagactttaatccaatccatgcaactgatgtccaactacctcgaggtggtacatttgtaattgcccattgtttggcagagtccaagaaagcagagacagctgcaacaaactataacaaccgcgtggttgagtgtcgcttagcagcaattgttcttgccatcaaactagggatggataccaaaaaagctgtctcttctgttacaaccctctcagatgttgaggggctatgtgtttcttttgctgggaaggaaggttcatcggatcctggagtagctgtgaagaaacttctgcatgaggagccatatacagcggaagaaatagagaaaatcacaggtgaaagcctgacatctgtcttcaagagttctcaaacttccttggatgttataaaagctgcaaagcactacaagctatttcagcgtgccagtcatgtctactctgaagcatggagggtttatgccttcagggatactgtctcgtcaaaactcagtgatgaagataagcttaagaaactcggtgatcttatgaatgaaagccattatagctgcagtgtgctatatgaatgcagctgccctgagttggaggagcttgtgaaagtatgtagagatcatggagctctcggagcacgtctcacaggagctgggtgggggggctgtgctgtcgctcttgtcaaggagcccatcgtcccgcagttcattctcaatttaaaggagaagtactacaaatcaaggatcgaccggggagtgatccagcagagcgatctgggcctgtacgtgttcgcatccaagccgtcgagcggcgcggccatactcaagttgtaggcgggcggccattctttggcccgttgtgcatgaaagaataaattccggtcctcttccctgtactctaggcc

SEQ ID NO: 359 - DNA, 718 bp, Setaria italica
cagccatggtgcacgtcagcttctaccgcaactatggtaagacattcaagaagccaaggcgtccttatgagaaggagcgtcttgatgctgaactgaagctcgtcggtgagtacgggctgaggtgcaagcgtgagctgtggagggtccagtatgctctgagcaggatccgtaatgctgcgaggcacttgctcacacttgatgagaagaacccccgccgtatctttgagggtgaggcgctgctccgccgcatgaaccgctatgggctgcttgctgagggtcagaacaagcttgattacgtccttgccctcactgctgagaacttcctcgcaaggcgccttcagactcttgtcttcaaggctggcatggccaagtccatccaccatgctcgtgtcttgatcaagcaacgtcacatcagggttggcaggcaaatcgtcaacgtcccatctttcatggtgagggtggagtctgagaagcacattgacttttcactgtcaagcccgttcggtggaggccccccaggcagggtgaagaggaagaaccagaacaaggcaactggtggtggcggcgatggtggtgatgaggatgaggagtgaagatgaaccagtagcaattacctgatataatattatctagtcgtcataaacatgttggtatcttgagcacttagctgtgtggcccaatgctcagccccatgtgctgattcggtgtcacagatgtt

SEQ ID NO: 360 - DNA, 2523 bp, Setaria italica
cactccacactgtcaagagagggagggcgaagcgcctccgcgcccaccgcgatccgcccgctcacctaacgccggtcgccggtcgaacgccgccgcgatggggttcgaagggctggtggtggtttccgacccatacctgcagcgccgcttcacgcaggccgatctccgcgcgctccaggccaagtatgcggcgctgcgggacgcgtcgcccagcgggaggttgcggatacgtgacctccccgccgccatctccagcctccgcggcgccaccgtcgcggccaagggcgacgccgagaaggagaacagcgcgccggaagcaggcccaggcccgggcctcacagacgaggaatgggcctccgtgctcaaggccgtcgcgcgcgccgacgagaggccgcaacaggatgccagcttcgagctcttcctccgcgtctacgccgagatgcagcttcgcctcaaggcggcaggcgccagcgccggcgggaagaaggcgggcggcggcatcgcccgctcctcgtcctcctccgccgtcgccttcctcacggcggccaccaccacgctgctgcacaccatcagcgagtccgagaaggcatcctacgtcggccacatcaacgcatacctcgctgaggatccgttcctcaagagcgcgctccccatcgatccggccaccgatcacatcttccacatcaccaaggatggcgtcctcctatgcaagctcattaacttggccgtaccgggcaccattgacgagcgcgccatcaacaccaagagggtgctcaatctgtgggagaagaatgagaatcatacactttgcctcaactccgccaaggcgatcggctgcaccgtcgtcaacatcggcacacaggaccttgccgaagggaggcctcatcttgtcctgggcttaatttctcaaataatcaagatacaactgttggcggatgttaacctgaaaagcacacctcagttggttgaattggtcgaggacagcaaggagatggaggagcttatgagcttgtctcctgaaaagattctattaaggtggatgaactttcaactgaagaaaggaggtttccagagaacagtaacaaacttttcatcagatataaaagacagtgaagcgtatgcttgtctattgaatgtcctggcacctgaatgcagtgcaaaaccatcggcaatgtcagtaaaagacttgcttcatagagcaagattagtccttgagcatgcagataggatgggctgcaaaagatacctgactccaaaagacatagttgatggcttaccaaatctaaatcttgcctttgtagctcatatttttcagaaaagaaatgggttgtccaaacaaatgaaacaagtttcttttgtggatggactctctgatgatgctcaagtttccagggaagaaaggtcattccggctgtggattaatagccttggaatttccacttacatcaacaacgtgtttgaagaccttagaaatggatgggttctccttgaggtgcttgacaaggttgctcctggctcagttaattggaagatggcaaatcgtccgccaataaaactaccattcaagaaagttgaaaattgcaatcaagttttgaagatcggaaaagaactaaagttttccttggtgaatattgctggaaatgatattgtgcaagggaataagaaactgatattagcttttctatggcaattgatgcggtacaatattcttcaactgctgaagaatcttagatttcactcaaatggaaaagagatcacagataatgacatattggcatgggccaataaaaaagtaaaagattctggaaagcaccattctcgtatggaaagtttcaaggatagaagcctttccagcggcacctttttccttgatttactaagtgctgtggagcctcgagttgtgaattggagccttgtgactaaaggagaaaaagatgaagagaagcaaatgaatgcttcatacatcatttccgtggctaggaagcttggttgctccattttcttgttgccagaagatatattggaggtgaaccagaagatgatgctaactctgacagcaagcatcatgtactggtatttgaaaagaccaacatcacattcattggactctgaaaacgggagttcatgtgagacaagctcgaccacaacttcagacgattctgcatctgaatcatcgttcgatgacaatgcagctagatagaagtgcagggatcatgaagagaaatgatctgacctggaatactcttcatcccagcgcgacattggttttgttcttgattctttgctgtaattttaagaacaaatgcattcaacgcatagggaagcgataaagagctcagagtgttcatttgtgaggttttgtagtgtgaaaaattgattgggtgaaagatgtgtagcatcctgtaaatattgacgcaggtagcctatatttgtaaaatcatagtgacagtggattgtccaaaatccacatagtttggttttttcttgggcatttttgctttgcaacatgacaagataccggtt

SEQ ID NO: 361 - DNA, 434 bp, Setaria italica
aaaggatcctctcatctcctgccatatcgtctgcaggctcttccttccctagcttttctctcggtccctctctcttcaagctgaggaaacgcaggacaggttagctggttgcatgctccatgagcgccatggagcccaggaagtccagctatcttgttgccgtcgtcttcgcttcgctcttgctgtcctccatggcaggagggcataggaagctggtaaacaaagatgacgcagaatccatggagacgtcggaatccatgcagcagctgcagggagatgacgaagcggcggcggtggtccacgagagaattctcaagcaggtgaagatggacgactacgggcgctacgaccctaccccgaccatgtctaagcctcacttcaaggacataccaaactagagccacaacccatttgagatcatatagggtaccttt

SEQ ID NO: 362 - DNA, 1472 bp, Setaria italica
caaaggccagcatgagctcgccacctctgctcggcaaggagggcctcaaggccgcgtactgccgcgtcgtcgtgacggtgccgctcgccgcagccgccctcgtcgccgtggcgcggctcgggcccgaggagctcgccggccgggtccgggacgcgcggccggtgcacctcttcctggcagcgttcctcccggccgcggcggcgaccgtgtacctgatgctccgcccgcgcgcggtgtacctggtcgactacgcctgcttccggacggcgtccaactgccgcgtgcccttctccaccttcctggagcacgccaagcaggtgccggtgctcaacgagcgcagcatccggttcatgaccaagctgctggagcggtcggggctcggggaggagacgtgcctgccgccggcgcaccactacatcccgccctacaagtactgcaccctcgacgcggcgcgcggcgaggtggacctcgtcgtgttcggggcgctcgacgacctgttcgccaagacgggggtcagccccggcgacatcgacatcctcgtcgtgaactgcagcctcttctgcccgaccccgtccttcgtcgacatgatcatcaacaggtacaagctgcgcagcgacatccggagcacgcacctctccgggatggggtgcagcgcggggctcgtctccgtggggctcgcccggaacctcctccaggtggctcccagaggcgcgcacgcgctggtggtgtcgacggagaccatcacgcccaactactacgtgggcagcgagcgcgccatgctcctgcccaactgcctcttccggatcggcggcgcggcggcgctgctgtccaactcccccgcgaaggcccggttccggctcaggcacgtcgtgcgcacgctcaccggcgcgcaggacagcgcgtacacgtgcgtgttccaggaggaggacgacaggggaaacgtcgggatcaacctgaacaaggacctgatgaccatcgccgggaacgcgctcaaggccaacatcaccgccatcgggcccctcgtgctcccggcctctgagcagctcctgttcgcgctctccttcatcgtgcgcaaggtgctcagcgggaagttcaagccgtacatccccgacttccgcacggccttcgaccacttctgcatccacgccggcggccgcgccgtcatcgacgagctgcagcgcagcctcaacctgtcggatcagcaggtggaggcatcgcggatggcgctgcaccggttcgggaacacgtcaagcagctcgctctggtacgagctggcctacatcgaggccaagggacggatgcggaaaggtgaccgggtgtggatgattgggtttgggtccgggttcaagtgcaacagcgcggcgtgggagtgcatcgagcccgcggcgaacgcggaggggccctgggcgacgtcgattcacaggtacccggtggacatcccggacgtgctcaagcactaactggctgcgtaa

SEQ ID NO: 363 - DNA, 1982 bp, Setaria italica
aaattaacggaagcggtttctcaggagccgaggcgcgaagagaaacagagcgagcgggagatgaggagtccggtgtcggaacgcagcctcatcatcgagagctccgacgacgaggacacccactccggagccgccgtggccaccagcgggcgaagacgcgtcgtccatgacgaggaggagaagggcgctggttcggactccgactcctcgtcgtcgtcctcgtcatgcgccaccccacgccgcggcccctgctcctcctccccctacgcccagcaatggccgcagagttacaggcaatcaattgacattcttagtaacgtgcagtcacccaatctgagtttcttggggactccatctctgagcagattgtccaactctttcctcgccgtaaccgattcttttcgaagcaaaacccctgaaataatctctaactttgtcaagccacttctgagccccacgacaagtgatgagcagcagcaacacgaagatacccgaaagagttcccagtacattacgccctcaagaaaaccatctttgcaacaaatccctgaggatcagaagccattggtagctggtcatgaggtgtctccttatcgaaactgctcttacacccagggagtgatgaatggaataaatgttctatgtggtgtgggaatcctgtcaacaccttatgccattaaacaagggggctggattggacttgtgatactagctttatttgctctgcttgcatggtacactggcgtcctactgcgtcattgcctggatagcaaagagggccttgaaacataccccgatattggccatgccgcctttggcaggactggtcgcctagttatctcgataatcctgtatgtggaattgtatgcctgttgcatcgagtatttgatattggagagcgacaatttgtcaaaattgttccccactgctcacctgacccttgggagcttgacactgaactctcacgtactttttgcaatcttgactaccatcatagtaatgccaaccacctggctacgtgacctgagctgtctgagctatatttcagctggaggtgtcattgcatcaatccttgtggtcatctgcctgctctgggttggggttgttgatgacgtcggttttgagaacaaagggactgtactgaacctcccaggaattcctattgcacttggattgtatggttactgctactcagggcatggggtgttcccaaacatctatttgtctttgaagaatcgcaatcagttcccttcgattctttttacttgcattgggttgtctactgttttgtactccggtgctgcagtgatgggatacaaaatgtttggagaagccacagagtctcagttcacgctcaacttaccagacaattcagtggtttcaaaggttgctgtttggacaacggtggcaaatccaataaccaaatatgcattaaccataatcccactggctatgagtttggaagagttgctgccaacaaatcagcagaagtactcgaacataatcatgcttagatcagcgttggtggtgtcaaccctcttgattgctctatctgtgcccttctttggacttgtgatggccttggtgggttccttattcgccatgcttgtgacctatattttgccttgcgcgtgttttctggcaatccttaagacaaaagtggggtggcatcagatagcagcttgctcgttcatcatcgttgtcggggtttgctgcgcttgtgtggggacatactcatccctgtccagaataatccagaactacacataatgcagttattcctgtgatccagctgcccagcaatactatatgtgctgtatgagccaaacatatacaagacggaaattgagttgatttataataaatccgtggtatgttgtacttagtgggtcaacagtatatagtatggccgtatgggtttgaggttgtatcatacgtacgtaacagtattctttatggtgcagtaaagaaacccgctgatt

SEQ ID NO: 364 - DNA, 648 bp, Setaria italica
ccatcacattataggaggaagggggaggagaccccctagaaagaagatcagcgaggccgatcgagcgagcccaataaaccaagggagatgtttgcggctgctagcgagatgtgtgcctccatcatgccacaccatgtgatgcgaggagcctctgcagcctctcctccccctactacttccaagatgcaatcatgctgccccagcaagctcctcgggccctcggccgccatgattgccacaccgcacctcaagagtcgcctccacctacctccaagaggaagaggccggagaagctatagtcgatgagaaaagcgggggcggagagagaagggcggcggcgtgcgagggggccgcggaggaggagagagatggggaggtgacagaaagcgagagggagagagatgcatggtgcatgatgatggcgtggttgatctgctcttgtactcctctcatgtgagtcaagaggccatcatcagatcggtgcagttctcctggctccttcgtcttcttcctccagcagactagctcctctcccttcagcttcttttgtacgctgcgccatggctttggggaatcaagcgtcttggtccgaaatccgtcttctttccagctaggatctacgtacttgtgcgagagtatgtcatgtag

SEQ ID NO: 365 - DNA, 895 bp, Setaria italica
acaaagaccttcacactcgcagccccggctcagtgcttcgtcgcgaaggcttcgtctccctctcccttctcccttccacccgcattcgaccgcctcggttcgccggcgacgagatggccatcgatcacgcgacccctctgggactgaagagcagatacgccatgggaggggacgagtgcgacgacgacgcggagaaccagcggtggccgccgtggcttaagccgctgctgtccacgagcttcttcgtccaatgcagggtccacgccgacgcgcacaagagcgagtgcaacatgtactgcctcgactgcatgaacggcgcgctctgctccctctgcctcgggcaccaccgcgaccaccacgccatccagattcggaggtcgtcgtaccacgacgtgatccgggtgtcggagatacagaaggtgctggacatcaccggcgtgcagacgtacatcatcaacagcgcgcgcgtggtgttcctcaacgagcggccgcagccccgccccgggaagggcgtcaccaacacctgcgacgtctgcgagcgcagcctcctcgactgcttccgcttctgctccctcggatgcaagattgtgggaacggcccgaggataccgccccaagaagaagcacggcggcggcgatagcaagaagaagaagagggcggcgctcaaggacgtgcgctgcgactcggaggactcgtgcaccggcagcagcggcgggagcagtgacaagagcagcgtcgtgcagtgcttctcgccgtcgaccccgccgccgacctccgccagctgccgcccctggaacaagcgccgcaagggcgtcccgcaccggtcgcccttcggcagcctcatcgtcgagttctagtagcactctccagactccatcagcactgtgacaatgta

SEQ ID NO: 366 - DNA, 532 bp, Setaria italica
aaaggatccggtttcaggttcatgtgttgtgcgtgttaccaagagtgtacgcgtcgtgtgatttcagaatgaggatgctatcaaggtcttggagatctgcgtccctctttcctgtcatcgtctttgccttgttgttctcaacttcattcgcagggagacagtgcaatttcttgacggatcaagatgccctacgtcatcaaggagaggcagcaggggctgaacagaaggaagcagtagtgccactggtgcatggtcggatgctcaatgtcaagacgaatgattacggcagctatgacccttccccaaccacggacaagccgcacttcaagctcatacccaactgatcaaattacgtatcgagcttgccgcaatggagtggccgatgaggaatttagctgcttacatatgtgtgcctgacgtatagatagagaggtattcctaggcttgctaaaattattataatgacatttagtacctttttatagatgttgctcgtgctgtgttcagtagccacaaggagctgggtaccttt

SEQ ID NO: 367 - DNA, 1370 bp, Setaria italica
ggaggatgcaggccgcggccgggagcgtctcctgggtcgccgcgcagccgtccgtcctcggcaggtgcggcggcggcggcggcggcgcgcagtccgcttcggtcaaggggagggctggtggaggaggaggaggaggaggaggaggcgcgagcgtccgcggggtcggcgtggtgcggtgctccacgcgcgcgcaggagaagcggccgccgcgggtgcgcaagtccaaggaggagaggagggagatggtcgagtccttcatcaacagctaccgggttgcaaatgatgggaaatttccgtcagtcaaccttacacacaaggaagttggagggtcctattatatagttcgtgagatcgtgagggatgtcatccaagagaacagagtccttggtcctggtggcttggattctatggctctgagttttgaagattgccctgattcctcagaggtatccatgaagcatgaattgggtcaagacaatatagagagcttggcaatgtctgatgatggccaagccggtcagggttctgtgtcagagtcatccagcagcgaggaatcattttcattgcaaaacaactccatcaacactgatatactgctggggtcatctaatattttagaggctggtgttctgaaaagtatagtccaaaatgggactgcatcaggtacagcattcttggagacaaaccttgagaagcaagatgaagttccatctgggggatcaattgaggttggcctgaatagttctgaagagctaaacagtcaggaggatgcacatgaggggatgggaagtgttgctactgatattcttccctcagaagctactgatgtttatgaaacaaatggtgcacttttaagagagcatgagatgttacctaatgatagtcatggtggctcaaatgatagtgttgttgatgatggaaatctccttgcggcagccaatggtgctcttcaagaaaagcaagcatcttttcaggagcatgatccatcaaatgaaagtgtgcaaggtgatgttcagagcttagattgccagattagtactacattatctgctaatcccataaatggttttgactcagaggctgaagtcacaaccaagactatcgaagcatcggatacaaaggggctattgcacacagaagaccagcacagtgtagtacaggtagatggtagtgaatttaagaaatcaacatccggtttcacaaaggaagtggttgaggcaaccgacgccaggcatgaacaaggaatgagcaccacaactgtgatcagcaggagaacttcgaaagcgcagcagaagaaagatgacaacctattctggcttgtccttagggcatttgttgttgctatatcaaaaatctgggcaaagtgatga

SEQ ID NO: 368 - DNA, 1415 bp, Setaria italica
tctccattcgctatgctggccgcccccaccgcgcctctccatcactcccccgacgccatgagcctgtagcccagcagcggtcgccaaagaagccgccatgggcaggtccagaggcggcaagggcgccggcgactcgaagtcgttcccgtcgccggcgtcgtcctcggcgtcgtcgtcggagttcgagttcacggtcacgctgtcgccggcgtccaagcagcggtcggcggcgcagctgtgccccgccgacgagctcttctacaagggccagctcctgccgctgcagctgtcgccgcgcatctccatggtgcgcacgctgctgctgtcctcggcgtccacgtcctccgcctccgactccacatccacgtccaactcgtcccgcgactccaacggcagcacctcctcgtccttctccgccgactgcgccgcgctcctgctcccggactccgcggcatcatcgtcccgccccagctccgccaccgaggacgaccggcacctgcacccgctctccgccgccgcctcgttcgccggcctgccgccggccaagcgcaccgggaagcagtacctctcgtccttcgccacccgcttctcctccgtcttccaccgcggcggcgctccggccgccaagaagcagccgtccaagtcgctcgccaaggaggtgatcaagaagtacgccaagaaggtgaagccgctgtacgagaagctctcccagatccccaagaaccagaacaacgtcaacgtcaacgttaacggcgccagcgccggcgccaacaaccagccgcagcaggggttcaagaagccgttcaccttctccatccgcaagaagcgggccgacgacgaccacgccgtcgtcgcggccgcggcagcggtggacgccgacgtcgttagcggcaagtacgcgcactccaactccttctccgggaacctccggttcccgcgacagaagcggtgcgcggcgagctgcccgtcgtcgatgcggtcgtcgccgagccactcgggcctgctcaccttcggcggggccggcggcgctggcttccccgacgtgccggccgccgcggccgcggccgtggcgggcggcattggcgtcggaccggtttcactgtccacggcgtcgtcgatggaggagctccagagcgccatcgagggcgccatcgcgcactgcaagaacacgatgggtggcgccgtttcggtgtgcccgcgcaaggcggcgaccggcgacgagatctgcgcgttctgagcgcgggcgcgctaggattcgggcagggagctaagtaatgccgtttaatcgttagcagtacttatctgttaattttcatttcattcgtctccttctggtaagactctatgataatggtggtaaataagagtagttcgaagggttaaaatgataatcggagcctttgaatctcaccttt

SEQ ID NO: 369 - DNA, 576 bp, Setaria italica
aaaggatccgatgaatgaagagagagaactgcacaacgattccacgccgaagcgtagagcgcagcagaggacgcgagaaggggcggcgagttcttgaatcctctctctccgctgctgagcctgctcatcaacccggcatggatgcaaagaacgtaggcaatgaacaagaagctcaacaaaagcttgatgcggtgacaggcagtgttccaagacctaatcaagagaccttgaaacagttcgcagattcagacgctggaaacatcagtccagcaaatggccaggaagctgacgtgaacatggaagctgccatctccaccgaggacgtcatgcgagctggcgggtttggagcaaaagatgacattggcagcctcctcccaacagctattgattcgacagatttcgaggcctcgctgcgggacgcccgcgacttcgaaggtgagaaagaggcaccatcacatcctggactgggctggaagggggagaaagctgatgatggtagcaaaccatcagatgtgccgcagcagttaccatgatatcttaccttgtaggctagtccagcttcagcttggtaccttt

SEQ ID NO: 370 - DNA, 2563 bp, Setaria italica
gccagtttcctctggcttctattcttctccacccccgcttgctcgccgtcgtgctctcgtgggttggtcaaccccctccccaagcaattccgcgagcacctcgcgcgcgtcgccgcccacccacatggccgcgcggtcgccgcccgcggcccgctgctagacgcctcgcgcgcccgccgcggcctcccggctgctggtgctaccatgttcctcctcccgcggcagtggctgctgctcctcgcggcggtgctagcgacggcggcggccgtggcgcgggggcaggcgccgctggcgtcgcgggcggacctgggggggctctacagccttcgcgcctccctggggctgcgggcgcgggactggccgctcaagtcggacccctgcgcggcgtggtcgggcgtcgcctgccgcgccggccgcgtcgtgaacgtcaccgtcgcggggctccgccgcacgcgcctcgccgccctggccccgcgcctcgcgctcgacgggctccggaacctcaccgcgctcgagcgcttcaacgcctccgggttcccgctgcccggggagatccccgactggttcggctcgagcctcccgccctcgctcgccgtgctcgacctctcctccgccgcggtcaatgggacgctccccgccaatctcggcgcgtcggggaacctcacgatcgtgctcctgtccgggaacggcctctcgggtgccgtcccggcgccgttgctctccgacagaggacctcgcgtcctcgacctctcccgcaacaacttcaccggcgggctgcccaacgtttccgccgtcgccggcggcgcgtcgatgtttaacatctccgggaattcgctgtacggcgtggccggctatgccattgcggcgctgaggagaaggtttcaggtcgtcgacgtgtccagcaactacttggatggagctttgaacgggtccgatggagtagtgattaccacgacgaattgcttccacggcgtgccgggtcagcgcagccgtgtggattgcgaggagttttacaggaagcagggcgtgaaccttgttgatgctccagctccctcgccgttgccgtcggcttcgcctctgccacagccatcaccggaggtgaagaggaagaagcagggtatctccaaaaatgtactcattggagtccttgtagctgcgggagcattgatggttctgtttttggctgtattgctgttctgcttggtgaagatgagcagcaggggaagaagcagagggaggggagtggagataaacgaggaaggtactggcacacgctctgcgcgtaggagggacagcagtgtgaatccagtggcgtcatctccatcagcagtttctccaagagccaatggtggacctaaaaaggatgtgtctgccattgccggtgatttcagctatgaggaattggtagatgccactgggggtttcggtgacgacaagctcatcaagcatgggcattcaggagatatctatcacggtgtcttggagaatggctcacatgtcattgttaagaaggtcggttcaaagggtatcaacaagcatgctagtgaattggacttctattcgaggtactcccatgacaggattgttccgctactcgggtatttgagcaaggatgatgaggaattcctggcttacaagtatatgccaaagggagacttgaccgatgcattgcacaagaaacctgtagacactgcagatggcttgccctcgctggattggataactagactgaagattgcgactggtgtggctgaggcaatgtgcttccttcatgacgagtgtagcccaccattagttcacagagatatccaagcaagcagtgtccttcttgatgataaatacgaagtgcgacttgggagtatgagtgacatatgcgcccagcaaagtgggggaagccagaatgtcttctctcggatattgagatcgtcaaagtctctcgacaagcacacatcaggtccaccggccacttgctcctacgacgtcctctgcttcggcaaggtgctgctggagctggtgaccggcaacttcggcatcagcgggtcgaacgacgccgcctcggaggaatggctggcgaacactcttaaccagatcaacggcggcgacaaggcgagcgtcacgagcatcatcgaccccttgctcctcgtcgacgaggaccaccaggaggaggtgtgggcggcggcgatcatcgccaaggcctgcctgagcgccaagccctcgcggcggccgtcggcgcggcacgtgctccgcgccctggagagcccgctgcgggtggtgcggcagagctcatcgtcccggtccgactcggcccggctgcggagctcgtcgtcgaggagctcgtggcagtccgtgttcttacaggggaacaaccaccgggtgcagagcctggaccggcggcactcggtgaggtctcacgggagcggcggggaggcgtcgttctcgttctcgttcaagagggccgtggcggcggccccggaggtcgcgccggagccggtggcggcggcgctcgacgaggaagccgttgttgtgtagtgttactggtagcgagtaggacgccatttcttgg

SEQ ID NO: 371 - DNA, 2112 bp, Setaria italica
ttctttccgctgtagtcagtcccgactggtagcaatggctacagctccagccaatggtgattcagagagtggccctcagaggaactatcaggttgttgtggctgccactcgtgacatgggcattggtaaggatggggttttgccatggaagcttcttggtgaccttaagttcttcaaggagcttacacttgctacatctgaccctgccaagaaaaatgcagttataatgggaaggaaaacatgggagagcattcctgttaagtcaaggccattgcctggtcgtttgaatgtcatacttactcgatctggtagttttgattttgcaacagtagaaaatgttgttatctgtggaagcatgaagtctgccttagaactgctagcgtcaactccatattgcttatcaattgagaaagtttttgttatagggggtgggcaggtactgagggagtatcttaatagacctgcttgtgaggccatccatctaactgatattcagtcgagcattgagtgtgacactttcatccctcctattgacttctcagtgttccagccatggtattcatcttttccggtggtagagagcaacattaggcattcatttgtgacctttgttcgtgttagaaaatcactggcagaaactcacgagtcaaatggaaaggaatcaactgaagttgataccaagaatgacaagtttgaaacagagaatttctcttttctccccaagatgatatttgaccggcatgaggagtatcattatcttaatcttgttgaagatattataaggtctggtgctcagaaaaatgacaggacaggaacaggaacattgtcaaaatttgggtgtcagatgcggttcaacttacggaaaaattttcctctgctgacaacaaagagggtattttggcgtggtgttgtcgaagaactcctgtggttcatcagtggttcaacaaatgcaaaggttctacaagagaaaggtattcatatctgggatggcaacgcttcaagagagtatcttgacagtgttggcttggcacacagggaggaaggtgatctaggtccggtttatggatttcaatggcgacattttggtgctgaatatacagacatgcatgctgactacactggaaaaggttttgatcagctaatggatgtgatcgacaagatcaagaataatcctgatgatcggcgaataattttgtcggcatggaatccttcagatctcaagaagatggctcttcctccttgccacatgtttgcacaattttacgttgagaatggggagctatcctgccagatgtatcaacgctctgcagacatgggacttggtgttccattcaacattgcatcgtactctcttctcacgtacatgattgctcaagtttgtgatctttctcctggggattttgtccatgttataggggatgcacatgtctacagaactcatgttcgagctttggaggagcaaattcagaagatgcctaagccattcccaattttgaagataaatccttcaaagaaggatatagattcttttgtggcatcagacttcaagctggttggctatgatcctcaccagaagatagagatgaaaatggcaatataatggtggctcagctggagccccagtctatgagcttggcgaaattattcggactgctactatattaaaattaaccggacatcgcactagcttgtttttggtgatggtgccgaatgttcgcgattgtactctggcttcgtatctgaactctacaaaacctgctccccttttatctggagccggtgttgatggctcgttgcgagtgagagctgctttttgggtaacgccctgtcgcaagggtcgactggcgcgtgccccgcgagacgatgtattacctcgtgagatatacccaagtcactgaattcgtctacttgctaatactcggtactgtttgatatgtacacgtgtgctgtctggtttttttccctttcgacgtcagatatcgacctgcatgctttaaacatgcgttctgctgcgtttgttgtgcattggctatttggcctccgttttcagttttttttttctagtcgggttttccaggctcagacacgtacaccacactcttgcttggtacc

SEQ ID NO: 372 - DNA, 871 bp, Setaria italica
ccaaaccctaaccctctttccctccttcccctccggcgccgccaccccgcgtcgccgctgccgccgctgagatgggccgcgtgatccgcgcgcagcgtaagggtgcggggagcgtgttcaagtcccacacccaccaccgcaagggccccgcccggttccggtccctcgacttcggcgagcgcaatggttacctcaagggcgtcgtcaccgacgtcatccacgacccgggccgcggcgcgccgctggccaaggtcaccttccgccacccgttccgctacaagcaccagaaggagctcttcgtcgccgccgagggcatctacacgggccagttcatctactgcgggcgccgcgccacgctctccatcggcaacgtgctgccgctcagggggatccccgagggtgccgtcgtctgcaacgtcgagcaccacgtcggggaccgcggcgtcttcgccagggcgtccggggactacgccatcgtcatcagccacaacccggacaacgggacatcaaggatcaagctcccctctggtgctaagaagattgtcccgagcagctgccgtgccatgattgggcaggttgctggtggtggcaggactgagaagccaatgctcaaggctggcaatgcctaccacaagtaccgcgtgaagaggaactgctggcctaaggtgcgtggtgtggccatgaaccctgttgagcatcctcacggaggaggtaaccaccagcacattggtcatgcctccaccgtccgccgtgacgctcctcctggccagaaggttggtctaattgctgcaaggagaactggtcgtcttagaggccaagctgctgctactgctgccaagtctgataaggccacttaaatcagttagttttg

SEQ ID NO: 373 - DNA, 819 bp, Setaria italica
gtgttccgtgttccaactccggcgactccaccaccacccgtcgtccgagcagccagtccactccggccaccgcgatgtcgaggcgcggcgattgggtctacgagaacaacggcgggacctgcgtggccatcgccggcgctgattactgcgtcgtcgcagccgacacccgcctctccgtcggatacagcatcctcacgcgcgaccactccaagatctgcgacctggctgacaaatgtgtactagcatcttctggctttcaaggtgatattaaggctctacacaagaacctagctgccagagaattgctataccaacaccagcacaataaaaggatgagctgtcctgccatggcacagctgctctccaataccctgtactacaagcggttcttcccgtattatgccttcaatgtgcttggtgggcttgacagtgaggggaaaggatgcgtgttcacctatgatgctgttggttcctatgagaggactggttacagtgctcagggaacaggatcttctttgatcatgccagtcttggacaatcaacttaaatcacctagccctttattactccctgccagagatgctgtcacgcctttgtcggaatcagaggccatcgatctagtcaaggatgtatttgcatctgcaactgagagagacatctacactggagacaagttggaaatcgtagtcattaacaaagctgggaccaagcgtgagtacattgagctgaggaaggactaaagctgttacttgtgctgcagctgccatttgcttccaacgtgttccctggacttgggatgtatgcctaaagctgtcgctt

SEQ ID NO: 374 - DNA, 735 bp, Setaria italica
ggagagaagactcgaaccagcggggggcctggctcgggggcagcctgagccccgccgcggcgggatcggaggaggaagaaggggaggcgggcatgtgcgatctggtggcccgcacgggccggcacctgcagcgctacgaggacggccgtcgccttgtggccgggtgcataccattcagatatagagacattaaagatgaacaaaagaaacttgttgaagttctcatgatcaactcccagagtggaccaggtcttctatttccaaagggaggatgggagaatgatgaaactgtggaagaggcagctgcacgagaagctatcgaagaagctggagttcgaggagatttagtgaaactgttgggcttctacgatttcaagagcaagcaacctgaaggtatgtgcagagctgctgtctttgcactgcacgtgaaggaagagctggcctcctggcctgaacagagtacccggcagaggagttggctcacggtacctgaggcggcagagcggagtcgtcacccatggatgcaagaagcccttgtgacaggcttctctgcctggcttgagaactggagcaacggtggtggctgtgtggaccgaagcgaaagatgacgacacctgaagcatcaggaggcatctgctatttccttttccctttttacctttgcttgggttaaacttccataacctgacgtaactgagggctccctgatgctcggtagtttgttggttcacccac

SEQ ID NO: 375 - DNA, 462 bp, Setaria italica
ctgacctagatcggcactctgcctctgccggtttcgtcgcaatggggttattcaggggcagcttcactctcttggtgggaatgggatgcggtgtctatatagctcagaactacaacgttccgaacgtcaagaagctattcaacacctacgtttttctggcaaagcacatcgaggaaacctaccggaagccgaagaaagacgacgattgatccttttacattggttttccctgtttatgccctgggaaagtgaaagtacagctaacgtgatacgggaaaaatgcttttttgaaatggtgaagtcaattttggtgatcggtgagttttgaactatggtggattatcttggttagttgtggaattcagttgctgtaaaagcttttgctcagtttagaccatgtatatctagacgagcactcccttttggtcgtgttcctgtgcctgggaaatgcactgaactttg

SEQ ID NO: 376 - DNA, 1605 bp, Setaria italica
cgcatatgtcaggtctcgccttgtgcgaggttgccgccaagtcgccgtgctggtcggaatgctctggatcgaggctacttgctgcatcccgcgttcggaggggagccgtttcctgccgctgggagaagccagggaccttttccttgctgtgggcatctccttcctaccgcagaaactcaaggttcgttcgcatgaccgaaacagttagatgcagggtgtgtgtaatgtcgtcaacgtggccgatgcacatttgagcagacacttagcgagatgattatgcttatatgctaattctcgtggtcaggtacagattgttagggtgctctgtgtttttagctttcgattggaatcctagcaatcagtctctctcatgtctttcactgttggaaagctatgcagttcggatacaccatacggcaggactcaattttaaagtcaaattactgagtctagggaatgtatgtaaacacaccaaggaaccaaatctaggttccaaagttggaatccaatctgtgcattgctctgtgcctgcacactgcatacatctgagtttttacattattttcttagtttggcatatctgtagttgtacacaccttcactagaaagattcaaaactattcatgccttaacataactagtagcactaggtgtgtctgcttccggcattttgctcatagataatcctaaatatgccatctcagtcagttcactgttaatcgtatggtttgagcagcaattgctcacccctttaatcatgtgctctcattttcttcagttatacatcgtcctttgtcaatctgccgacctgtctagaaaaaaaaactatcatctttctttcaacaatgccttagtacatttacataaaaatgtttcattctttgtgtaggcagatgcaatgggccatcaggactatgtcagatgatagcagtggccaaccaggcaatagcactcgccttttcagtgcaattcaatctttctggaacaagttttctgcaaagctgaagaaagcaaggaaagggctagcaacgaagatcatgttctttctgattggattttattgtgctacggcatttgctactgtcattgggcaaacaggtgactgggatatattgtcagccggacttgctgttgccattgtggagggtattggcgcactgatgtacagcgcttcctttggatttcttggtaggatcaggaacatggttaccatgttcaattactggaaagctgggcttacacttgggttgttcttagattcttttaaatatgaagtggatgggcttcttgattcatgtaacccattcaacttcgagattaatatattcactggcctctggtaaaattctgttccatgttttgatattatttctgccaatggttttccaactcaaccaagagacaacctctttgtaaggatggaatccaaatacccacaaaccatcagtgtacccgtcgcgcgtcgtgtcctcaggagtggtgctatctagagtaaaatcgacttcatcaaattgctgttttactggtgctgcagcggtttctcctctttccatcaagcacatgcccatttcatcaagacctaatttgcgatcctcactgtagttg

SEQ ID NO: 377 - DNA, 763 bp, Setaria italica
cttctccacgtgaccacacgcattcactgtgccccgccgtctcagcctcatgtctctgctcacttcccccacgccgttcggcgtggccgccgtccaccgtcgcgctgcggcgcttccccttctccccgcgagcggtcgagctgccctgcacgtggccctcgctcgccgcggcggggtctcgtcccgcacgcagcggcgcctcgaggagcgcggcggaaagaagcgccgcggcggggtcgcggcgcccgacgtggacgaggacgcagcagaggcgggggcggccgagtgggaaggggagccgctggggttcgaggtgtcgacggagcccatgccggaggtgccggacccggagacgcccgacttctgggaggggccccagtgggaggccctcggcttcttcgtccagtacatgtgggcgttcggcgtcgtgttcggcctcattgcttgtggtgtcgcggtggctacctacaatgatggcgcaacagatttcaaagacactcctgcctacaaggaatcacaaacacaggagttccctgaggagtctgaatcatcaagcgctgatgtgtttgaaggcaatccgactgaggtagcaccagctcttgagtaggactgtggaggaaacacgggtgagagaagacgatgtctctcttttatttgaggtatagcctatagggccttacctgtaaagtagccggtaagacatgtaaggtttggttgaaatcataatgctcaaaaaaactggctggtgactattgagcactga

SEQ ID NO: 378 - DNA, 335 bp, Setaria italica
tatggatcctgaaggacaaaatggcatccatgaagctgctctccctcacctgcatcctcctcctctccgggcttgtcgtgttcggcgagatcggaggggtggcggcggcggcggagccgtgcccggtggtgtgcatccagggcgggtacatcacctgcgacaactacccctaccagaagctggacggctgcgactgcgagtgcgcgcccaaggacggaatcaactgcgtgctccaccacctggtcaccggcgacacgttcaaatgcccagcgcaggcgtaggctttggctggagcctcgcaggggtgatacaagctcacccttgctggtaccttt

SEQ ID NO: 379 - DNA, 1583 bp, Setaria italica
cgactcatcgagtcattgtttgtcctcatccatccaaaattccaaatcgcaaaaaatccccttcaccatgaagctccgattgcggtctatggaggcgcgcggcggcgccgccgccgtcgagacccaccgcgtggatctgccgcccacggccacgctgggcgacgtgaagaccctcctcgccgcgaagctctccgcgttgcccgtccccgccgagtccgtgcgcctctccctcaaccgcagcgaggagcttgtctcgcccgaccccgccgccacgctccccgccctcggcctcgcgtccggcgacctcgtcttcttcgccctgtctcctctcacagccctcgcgccgccggctcaggccctgccccggaaccctagcccgggttctggctccgttccgaccgcgatggctgtcgacggcggcaaaggatcagagaagcccagcaccggaggctcctcgctgcaggcgcgagctgtggtcgtgaaccctagcgttccagccgcatccagtcctgcggatgtggtgatggcggagaccgtcgatgccacgaagggctggtcgagttttgtgcttagggatctcaagcgggagatggggaacgtcgttggcgcagagggaaccgctggaggtcgtctggttgcagccctacatgcagctttgcttgagttcggcttccacatcactaatccgatggggtcacgcctctctctgccaccggactggccgccagttgcttcgaagccactggccatcaagtataccataccggagctttcaccgatgttacatgtggccgaggaggggaaggtggcagtgcttaacttctccttgatgccaaatttcgtgatagtatacggttatgtgcctggggcgcagtctgaggtgcgccgattgtgcttggagctgccaaggcttgagcctttgctgtatctggatagtgatcagctgagtgcagtgcaggagagggggattcttgatctgtggacagtgctgaaggatgagatgtgcctgccactgatgatatctttatgccagctgaatggtttgcgcttgcccccatgcttgatggctctgcctgctgatctgaagagtaaggtcttggatcttttacctggggacgatcttgcaagggttgagtgcacttgcaaggaaatgagaaaccttgcagcagatgatagtctttggaagaagtttgtacagttcagaaattctggtgagggtcctagagggtccatgagcgcgaaggccatatttgcagaagcatggcaggccaataagaagcggcagaagaggccccatccaaccttttggaactatggctggggaaacaatccttacagccacccacttaggctgccattgatcggtggggactcagacaggctaccgtttattgggaatcagggttctgttgggcgtaactttggaaatcaacgaaggaacatcgtgccaaactgcattcttgatggccaccgccataacttcctttgaagccatttcgggttttacttgtatgctaaaagtattttgtaagaagcggtgcgtagacggatagaccgtcttgttcatatctccaagttgcacg

SEQ ID NO: 380 - DNA, 1985 bp, Zea mays
gggcaatggggatgggcagcgacgccgccgcgctgttccccttctccaccagcaccaccgccacgtcgccgcggctctgcggcgccaccgccgtcagccacaggaggatattctcagacgtcgctgaggacgtgacggtgtcggtggacggccagtcgttcctgctgcacaagttccctctggtgtcccggtgcgggcggatacgcaagatgttggcggactcctccagctccaacagcaaggacgcagacggccaccagaagctggagctggcgaacgtgccggggggagcctacgcgttcgagctggccgccaagttctgctacggcacaaacttcgagataaccgcggcgaacgtggcgcagctgcggtgcgtggcggagtacctggagatgacggaggaccagcacgcggacaacctggtggcgcgggcggaggcgtacctggccgaggtggcgctgcggagcctggacggggcgctggaggtgctgcgcaggtgcgacgacggcgggcccgtggcggagcaggtcgggctggtggcccgctgcgtcgacgccgtcgccgccagcgcgggcaaggagcagctggtctccggcctggcggcgcacctggagacgtgcgactgcgccgccgccgcgcgctgccgggaggactggtgggtggaggacctctccttgctccggatcgaccactaccgccgcgtcatcgccgcgatgcggcggagcggggtccggccggagaccatcggcgcgtccgtggcgcactacgcgcagacgtggctcaagggcgtggacgtggagcagcggcggcgccagcgcgcctgctgggacggatcgggcccgttcgtcggcgacggccagcggatggtcgtcgagacgctcgtcgacgtgcttgccacggagaacgtcgcggccgtcacgctctccttcctgttcggcatgctgcgggtcgccgtcgaggtcgacgccagcctcgactgccggatcgagctcgagcgccgggtcgggatgcgcctggagatggcggcgctcgacgacctgctcgtccccgccgcgcagaccagcgactccatgttcgacgtcgacaccgtccaccgcatactgctcagcttcttgcagaggattgatgaggatagctcgggggacctgtcgtctcccccctgcgggtacgactccgacggcctcaagtctcccagccacggatcggtgctcaaggtcgggaggctcatggacggctatctcgcggaggtggcgccggatccgtatctcaagctgcagaagttcatggcccttattgagctgctcccggattatgcgcgcattgttgatgatggcctctatcgcgccatcgacatatacctcaaggcgcatccatctctgacggagtcggagtgcaagcggctgtgcaagctgatcgactgccagaagctgtcgcaggacgcgtcgagccacgcggcgcagaacgaccggctgccgatccagatggtggtgcgcgtgctctacttcgagcagctccgcctcaagtcgtccttctcgggcggcgggtccgggtgcgtcggcttgggcggcgccgacgggtccttctcgcagcggttcgtgtgcagcagcagcggcgtgccgagctcgtgcgtgtccccgcagcgggacaactacgcgtcgctgcggcgggagaaccgggagctgaagctggagatctcgcggatgcgggtgcggctgacggagctggagcgggagcaggggctgatgaagcagcaggggaggatgcgcggcggggacggcggtggcggcggcgggcggggcggtggcggcgagcacggccgcgccttccttgcgtcgctgtcgaggggcatcggccgcatcaccatgttcggcggcgggcctgcggcggccgacaggcggcgcaagaagagcggcggccggagctcccagtgctccgacggcaaggcccgcaggcggcagaaggcgtccttcgcctatgactgatga

SEQ ID NO: 381 - DNA, 541 bp, Zea mays
tttcctcggagctcagttccccaattcgccattttgatgaggagctcttcccactgtgagagctactgcgctcctcccctgtgctacctcccctgcctccccaaatccaaagacgttgcagtcggtgacccggagtccgggtccccgagccctgccgctgtcgccgaggacaagccgcccgtggtccagaagatcgaggaatctgtggcggcaaccggcggcgatggcgtcggtgatggtgacaagtgctatcgggaggtggcggtggctcccaagagttgcttgaagagggctaattgcgaggacagcagtaagaatgcggtgaaaggcaatgtgaagtggaaggatttgctggggaaggatctcacgctcacgcaggtcaaggaattcgagccaagcgaatctggagactcagacgacgaagagtacgctggcgcctgcgcctgcgtaatccaatgaggccagggatctttagtgtaaattctgtgaagaaaaaaaatcaaaacaaacaaacagaacgctctcagtcagccattagtcc

SEQ ID NO: 382 - DNA, 550 bp, Zea mays
aaaggatccactccaagagtacccaatcaccgagccatggccatctcagtcactgccgtggccgccttgtccgctttctcggctcaaagaagcctcccgcagccgtaccgccagagggtcgtaacgttcatcgtcgtccggccggtgcgcgcgcaccgccggtttgtgggcgtggcggccagctcgccgcccacgccgccggatctcgcaaagaaggtgtccgagagcatcaagcaggcccaggagacgtgcgcagatgacccggtgagcggcgagtgcgtggcggcgtgggacgaggtggaggagctcagcgcggccgccagccacttgcgcgaccggcagaagggcgccgacccgctcgaggagtactgcaaggacaaccccgagaccgacgagtgccgcacgtacgaggactgaaccacgcgcgcgcgaggttggatcgctgtcacttgatctagctagcagcttagctcggcgtgatggcgacatgtgtagacatgcaatggatcgggtatgatccttcgttgattcagtctggcttggtaccttt

SEQ ID NO: 383 - DNA, 1800 bp, Zea mays
gcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgctccgggaaggtgctcaggaacgattttcagtctaaagagctccccaacacccgcatcgagcccgaccgccggtggttcggcaatactcgcgttgtgggccagccacagcttgaaatgttccgggaggaactccagagtcggctttccgacaacttcagtgtcatcctgaaagaacggaagctgccactatcgctcctgcaagatcatcaaaagcaagcgaaggcacatctgcttgaagttgaaccttttgagcatgcttttgggccaaagggcaagaggaaacgtccgaaactaactgctcttgactacgaatctttgctgaagagagctgatgattcccaagatgtgtttgagcaaaagtatgcttcatcaaagttgccaagggaggaagaagaagatggcttacgtgatctagtgaggcatacaatgtttgagaagggacagagcaaaagaatctggggtgaactatacaaagttattgactcttcggacgttgttgtgcaggtgttggacgccagggatccaatgggcactcgatgctaccatctagagagacatctaaaagagaactgcaagcacaaacacttggttttcttgctaaataagtgtgatctaatccctgcttgggctacaaaaggatggttaaggaccctttcgaaggactatcccaccctagcattccatgcaagcatcaacaagtcatttggcaaaggatctcttctgtcagtattgaggcaatttgctcgtttgaagaatgacaaacaagctatttctgtcgggtttgttgggtaccccaatgttgggaagtcatcaattattaacacactacggtcgaagagtgtctgcaaggttgctccaatacctggagagacaaaagtgtggcagtacatcactctcactaaaaagatatttttgattgattgtcccggtgttgtatatcaaaacaatgattcagaaactgatatagttctgaagggtgtggtccgggtgacaaatttggcggatgctgctgagcacattggtgaagttcttaggcgtgttaaaaaggagcatctccaaagagcgtacaaaattcaagattggtctgatgataacgattttcttgtccagctgtgcaggaccactggaaaacttctcaagggcggggagcctgatctgacaacagctgccaagatgatacttcatgactggcagaggggtaaaatccccttctttgtaccccctccgcagcaaagcgacggcggtgcatctgaaagtgctgaacaacctattgggattaccaaagaggacggagtaagcagcgacaggactgccgcagccatgaaagccattgcaggaataatctcgtcacagcagaacatgaatgtgccctgccataaggaaaacaatgcagacaatgaagacactgaaaatgcagataacgaagacattgagagttcagataacgaagacaatgatgacatcgagcctgcagagcgatctgagtgatctttgggtacagatgtggattattagagttgatatgtcaaggctaatgaatttgtcagccccaggtgttgtgtagctacttgaccatatcactggcg

SEQ ID NO: 384 - DNA, 1557 bp, Zea mays
agcaggcgaggcagagatggcgctgcgacgggcgctcctcagatcggtcaacttctcccccgacagcaaggctgcaattgagtacttttattctttctcaagggcacagtctgcttgttctctcaatggtgctggtctttgtcctgctagtagatcatttagcacccaggctgccactacgtcaagcacaccacagcctccacctccaccaccccctccagagaagactcactttggtggtctcaaagatgaggatcgcattttcaccaacctctatggtctgcatgacccttttctgaaaggcgcggtgaagagaggtgactggtataggaccaaggatttggtgattaagggggcagactggatagttaatgaaatgaagaaatcaggtcttcggggtcgtggaggtgcaggttttccctctggtctgaaatggtcctttatgcccaaggtttctgatggacgcccttcttatcttgttgttaatgctgatgagagtgagcctggaacttgcaaagatagagaaatcatgcgccaagacccccacaagcttctggaaggatgccttattgctggagttggaatgagggcatcagctgcttacatctacattcgaggtgaatacgtgaatgagcgtctcaacctcgagaaagctcggcaggaagcatatgcagctggacttctcggtaagaatgcttgtggatctggttatgattttgatgtgcatattcattttggtgctggtgcgtacatctgtggtgaagagactgccctattagagagccttgaagggaagcagggcaaacctaggctgaagccacctttcccagccaatgctgggctttacggctgccccacaactgtgaccaatgttgaaactgtggctgtatccccaacaattcttaggcgtggtccagaatggttcgcaagctttgggcgcaagaacaactccggaaccaaactctactgcatctcaggtcatgtgaacaagccttgcaccgtggaagaggaaatgagcatacctctgaaggagttgctcgagaggcactgtggaggtgtgagaggaggatgggacaacctgcttgcagtaattcccggcggttcatccgttccccttttaccaaagcacatatgtgacgatgtgttgatggactacgacgcgctgaaggctgtgcagtctggattgggtaccgcagctgtcatcgtgatggacaaatctacggacgttgtcgacgcgattgccaggctgtcctacttctacaaacacgagagctgtgggcagtgcacgccctgccgagagggcacgccctggctctggatgatcatggagaggctcaaggttggtgacgcgaagctagaggaaatcgacatgcttcaggaggtcacgaagcaaatcgaagggcatactatctgtgccctcggggacgctgcggcgtggcctgtgcagggacttatcaggcacttcaggccggagttggagaggaggatccgcgagcgagctgaaagggagctgttggcggcttctgcatgatgtgccagccgcatgtactagttttc

SEQ ID NO: 385 - DNA, 1436 bp, Zea mays
taacaaaggatttggaacccagccctctgttctccaccaccgcttcgaagatgccgcaggtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgctggcaccagtgaccgctgcagcaatggaagagtgggtgcttgatgaatatgctgccaagcataaggttgccattgataagcttctacagctcagggtctttgttgaagtgcgcgacagacgacgggacgtgagctacaagatgaatcagaagttccagggaaacatgcagaagtatttggttgatggtggaagtttaccaagggaacctttaccattaagtgtcactggtcgattgcccacaccagcagatctggaagcctatgctcttgatcaatgggagtgcttcttgttgcaattgatcaattcatctcaagtcgaaaaagggtcaagttttagctcctccatgatgaagacgtttcagcgtggtcttctgagttcaagggatggtgaagcttcaaagttgactgaaaatggcttccaatttcttctgatggaaacaaatgcacaactttggtacataatgagagaatacatttcatctgctgaggaacgtggagtggaccctacggagctgatatcatttctcttggaacttagctttcataaattgggagcggcttatagcttgaacactctgactgatgtccagaggattgccatcagggatcttgcagaattaggactagtcaaacagcagcagggtcgaaaggatagctggttcattcctacccaattggctactaatctttcagcaagcttgtcagattcgtcatctaacaaagagggatttgtggttgtggagacaaactttcgaatgtatgcatactctacttccaagttgcactgtgaaattctacgcctttttgcaagggtggagtatcaacttccaaacctcatcgtaggagctgttacaaaagaaagtatctatggtgcttttgaaaatgggataactgctgagcagataatttcatttcttaggcaaaatgctcaccctcgtgttgctgacaagatacccgctgtcccggagaatgtcacagatcagattaggttgtgggaaactgacctcaacagggttgagatgattccatcgcatttgtacgaagattttcctagcaaggaatggtttgaacaatgctgtgattatgcaagggataatgggtacttgctgtgggaggaccccaagagaatgagactaattgtacgaggggagttccaccccgaaatgagggagttccttcgcaggcaaagatgaggaacgaccttgtacttgacggaccattag

SEQ ID NO: 386 - DNA, 425 bp, Zea mays
aaaggatccgagttggagggaaggaacgggaggcagcttcaaggaggaggctggcggccgagcgtccgtgcggcatggggagggacgagctgctgcggcggagcctcgtggcgctggcggcggccgtggcgctcacgggcttggccacggcgtcgctgcgcaaggcggcggccacgtacggcttcggcatcctcgccatcgccggcgtgctgctcccggactgggagttcttcgaccgggactactcccagtggctcacccccatgcccgcctcccgacgcacggccgcggccgcggccgccgaccgggagcacgacgtctggaaattcaagccctatcctctgagggtggccatgctgacgaccatctacgggttcggtcttcacaagtggtggacgtacgtatctagctagtaaggtacctaa

SEQ ID NO: 387 - DNA, 1226 bp, Zea mays
taagtagcgtgcaaacttcgaccgggaccggcgatatccgccatggccaccatcactgccgccgctcgctggagcttccccgcccgtctccagttcctcaccagccgccgcttttgcttccccgcctcctctgccgcgccgcccacttctgtagcggggttcagttgggccgacgccctccgcgtcgctggggacggcgggcgcggcgacgagtccgacctctccgggtacttccggaaggtcaagagctgcaaccgcggaatggacaaaaaagggcagttcgtggagttctctgtggaggatcaggtcgtggggtacatccacaagggatttatcgaacacatcagagactttcatgatgtttttaccattgtcatggatgacaatggcagcaacactgtggagcatgtgtctctccagtcatcactaaggactccagaagaccgaacacatgctattggaagtgtcattaaaagccttggagaattgattccaggtattcgaaatgagctctacccagtgacgtcatcttatggcatgcctgtgtacttctctctggaacgtgctgctgctccttactttggtataaaagcttatggagttcatatgaatgggtatgttgagaaggatggtcagaaatttctttggattggtaaacggagtgatgtgaagcaaacatatccaggaatgcttgatcatcttgttgcgggtggcctgccatacggaatgtcctgcaaagagaatatcatcaaggaatgtgaggaggaagctggaatcacaagatccatatcaacaaatgctacttctgttggagcggtttcttatatggatattgaaggctttagatacaaaagggatgttctcttctgctatgacctccaacttcctgctgattttgttcctaataatgaagatggtgaggttgatagcttcagactagtccctgttatacatgctgcaaacattataaggaggacagattttttcaagccgaactgcaaccttgtgatcatcgacttccttttccgtcatgggtacataaacccagattctcgtggttacttagatctgctgcaaagcttgaggagtggtgattgttcctaactctcttttgctgtccacatttataatcattgttcaatttaatgaaacaaaaaaaatcatggagtagtctggtattatggttgatcataatcataattatgcctgggactccattgtcattt

SEQ ID NO: 388 - DNA, 956 bp, Zea mays
ccctcctgtgctttgagattcgcgcctcgcgcctgccgacctcgtgcctcccgcggactcgccggcgaacgcctcttggagatgccacccgccgcggcggcgctcctccggtgcgctccggcggtcccattcgcggcccgcagtagcgctgtttcccgctcaggcatggcgcggcgtctggtggcagcgagcgctgcggccggcaggctggcaccggcgtaccgcgggctgctgctcgacgccggtggcacgctgctgcaggttgcgcggccggtagccgagacgtatgcctccatcggccgacgttacggtgtgacgaagactaagaagagaatcatggaggggttcaagcgggcattctccgcgccatggccgaagacactcaggtaccagggagatgggcggccattctggagaattgtcgtggcagaagcgaccgactgcactgatggtgattatttcgaagaagtgtatcagtattatgcgcatggagatgcttggcgattgcctactggagcagacgcagcactgcgtgagctgaaggatgctggagttaagctcgctgttgtatctaacttcgataccaggctacggaaattgcttaaagaccttaatgtctccgagatgtttgatgccattgtggtgtcatccgaggtcggatatgagaaaccttccccagagatcttcaagatagcattggatcaaattggcgtggaagccagcaaggcaatccatgttggagatgatgaaactgcagacatggcaggtgccaatgctacaggacttgagtgctggctgtggggtaaggatgtgacgacgttttcggaaatacaggagcggattctgacaacagatgatcctcaatgagtgaatttggaatgttgcaaaaaaatgatagttgtttcttttttccctcagttccttctttttggtttccttccaactcgtgtgtttag

SEQ ID NO: 389 - DNA, 275 bp, Zea mays
ttactccgaagattctcaagacgcccctgatggctccccgcgtcgcctccgctctgctcttcgtcgtggccgtcctcgtggcctccgcggcggcgcaggagtccatggcgcccgcgtctgctccggcgccgggaccggtcgctggcgcggcctccgctccggcctccgctgtggccgtggtgtcgtccgcactgctgtccctccttatgacggccctgatgcagtagaagtatcatactagatttgagcgggaatttggttcagtgttgctatag

SEQ ID NO: 390 - DNA, 1567 bp, Zea mays
tcatgagttctagaagggaagtcgcgatctctgggtgaggtgtccgtttcctcccgttgctggatccgctgactgaccgatcggcagagccgccatggcgtcgtcgtgcatcccggccggcggcatccggctgccggacctggagatggtcaaggccgcgccgccggctcactccgcggcgtcctccacgctctcggaggcgtccagcgcgtccgcagtctcctcgtcggccacctcgtcgtcggtggcgtcgctgtcgctcaagcgcccgcggacgccgcggaagcggtccagccagacgtacaacgaggcggcggcgctgctcgcgtccatgtacccctccgtcttccccgtcgccaggggcggcgccgcgccgcgccgcctcctcggcctcgcctccgcgctcgccgacgactcgtcctgctccgacctcctcccgccgttcccagtcgccggcggccacgccgccttcctcctccgtgacctgccgccgccgtctctgcctctgacgccgcggatccccgccgccgagagctgcccgtcgcccgctgccgtcagcagcgtcttcagcgagttccgcgacccggccccgtctccagcgacccctgacgacgctgcggcggcgcctgacgagcccagggatcttggcttcgacgatgacgacggtttcgacgccgattctattctgtgcggcgtcgaccagagcgcggccgagggcatcgatggcatcatgggtaagctctctatggaaaacaacggggcgtccgtatcaggctcaagcgttgactccaacatgcccggatccaagatgcacccctacctcaggaaccttatggtgctcgggctcagcttccggcaggatcagaatatcatcatcaatcaagcgctgaagcggcatagtgtcgatcctgaatggtggatgtgccctgccatacctgtgaaagacatcaccccggcaccaccgccttcagtggcaatggccaaggtgacagacaagaagaagactaagaagaagtcactggggacaatatacgaggaggggagtcctgagcctgccaatggcgatgacgatggagctttggcactgccagagacaggattggggcttagcttgaatactgacggggtgctcaaggcgtggtgtggcagaggctctgcgtttgctgatggcaatgggcctgacttgccattgtcccctgctcatgtggtagttaaacatgaagacaatgatctcttcccaaagaatggtaccggcgctgttatcagggaaggcaacattctgaagatgcagcgcaagcagaagccatgcactcccctcccctccaacaagcagagtcggtactaccggcctcgggtcaaggggaggtttgtcagcaaggcttgtttcctccagcgacagcaagcgttagagaaggagagctagagaaagatggatcctgctccaaggcgcatttctggggctctcttggagaagcagcagagcttctccgttttcatctctgcggcggtacagtgcggcagatgtagagatgcctgtagagtggtgcttgtgaacctcaattcttag

SEQ ID NO: 391 - DNA, 610 bp, Zea mays
aaacacttcatcccgaagtcaccgagctgagctccaaagaatctagcagctaggagcaggccgtgtatacgccatccaccacggcaacatgtgctccggctcctggtcctggagcagcagcaagaagcgcaagcgcccgtctcttgttgtcgtcaacctcaagcggcgccagctgcagaagacgccgccgccgacgccacctcgttcctcagttgctatcaggaggaagaggctgagactgaggaggttgcgagccggagcagaggccatggagatggtgaacctgaagctctacctggagaaccggtgcatcatcgcggagaacgagaagctgcgggagagggccagcgcgctccgccgcgagaacctcgcgctgctccaggacctgtccaagacgccggccgtgccagaggcaggagcgggagcgggagctggagctgcgtgagattattgcttcctcttgctgcctgctgagcatggagtagctagcttcgcttgcgttccctcgctggtgcttgtgctagttgcgtgggcaggacagcggactcctaggtatctatttgcttggctgctccgccatgtcggtgctctgctgtctgctcatacatag

SEQ ID NO: 392 - DNA, 969 bp, Zea mays
cacgaatgatgtattgtatgcaattcggcccggagcgtcactaaatcctggatccgcattggccgcagggccagtggccagtgtccagcctgccagctcagcccggcggcaagcgcccagcggctggctcgggcagcggccagtggcgagcagccgactcgtttcttcggcgttctccgccactgccccccagctatgcaccctgttccagtcccctcccagccctttaccgcaactcctgcaaaaaaacttgtttcaaggagcactgctgtgaggaaggccatccattttgtcaacctgtggacagctggaaggtctagtggaaacctggctatgaactccgtaccaaaacccgcccctgggtccgaaacatctgggagggaggattttgctgtgggggataaggatgctgtggtcattgttgatcatgggtcaagacgccaagaatccaatctcatgctaaatgactttgttgagatgttccgggcgaagactagctataggattgttgagcctgctcatatggagctagcggagcctactataaaggatgcttttggaaaatgtgtgcaacaaggagcatcccgagttattatcagtccatatttcctttcccctggacgacactggaagcaagacattcctgctttagcagcagtggcatcaaaggagcactcaaatataccctatattgtcactgcccctcttgggctgcatgagcttatggtggatatcatgaatgatcgcatcaagtactgcctgcgacatgttgcgggtgatgtcgatgagtgtacagtgtgtgccggaactggaaagtgccgcatgtactcctgatggagcatacctgggaattgtttctggagaatacgagatctgacgagtgtatatctaggtccgctgtgtaccgtgaaaccaaaagcttgtacagttcattctgaacagatcgtcagaattagacaagtgccatag

SEQ ID NO: 393 - DNA, 722 bp, Zea mays
ggactctggagtctgttgtctgcgtgtgtgcggctggttctctctgccaccgcacgagtcgcagcagagagggaaaaaccctagcagcctcccttcgtcccaactcccaaccccgcgaccccatggccgcatctaacggcggcggcggccccggcccgatctccgcagaggcggaggcggcgcttggagaggctatcaagctggtgttcgggcggtggacggcgctgcagatggcggtggagaaccagtggggcggccgcgactcccgcgccaaggccgaccagttgggcgagtccatcctattctggttctgccgcactaagggtccatattatttcgaagacttggttgatatgatgtatgacaaaatttctgaatcttttaatgcctactttgaggataatagtattgaggaggttgctgaacagtttttgatcatacatgaagaatgcctgcaaaacaactattcgtctatagagaagctaaggaattctcatgttccggggaatgctgtttctcaaagtagacagatagtgggcgatgaagatgatgacagtgatagctcagatgacggtgatgacacatcgatggtggctgatgaagaggctgggccagaagagatggcagtggacaggccaaggccccccaagcctactccagacgccgatgggtggactgttgtgcctcctaggcgtggtggtcgcagcaagaaatagagttaa

SEQ ID NO: 394 - DNA, 3350 bp, Zea mays
gagagtgggaaggggaagccggaggatgccagcggccaagtacctcggcccgggggcgttggcggaagacaggcgccaggacctccaccgccaggtcggctgcgtcaccgggatcttgcaggccttcgaccgccgccaccctcttgcctcctcctcccacaagaggttgcttcccccaacaggtcatgcagtatccagtaacccaagcaaagagggcgattgcacaagatattcaccccagattgttctggtgaactcgagtaaaacatgggctgatagccaaagagcaccagcaacagaactgtctcaaacctcatattcatcatcaccctcttcgtcattgtcgtcccttgatggcaacaaatcaacacaacaggacctatcatccactgaccgaatgctatttccagagaggccgttcaagagctcgccgaagctcaagagttattttgacagtgacaccgggctcgactaccctgatgatgcgcttacgaagtccaaggacatgcccatagttcaagccagcctgccaactcttggtataagaaatcttgtgaaggattcaatctatatgaatagccgtgaattgtcagtcagaatttgcactgaagaagtaacagatcacccatccaactgtggagatcaacctagggaattgaatgggcctccccgtgacagcacacaagaaaaaagcaagggtcttgtggacatcaatgaatcgcttcgagtgctagccaagctcagggaagcctcatggactccagctgaatctgtccatcatgcaacactttcatatgatgctcctcggttctcatacgatgggaaggaggctgcatcgaaactgagggaggtaccaaggttgtcactggacatcaaggaaagtcaccttcggaatggtgaaattgactctagatcgaacccaagcttgagttctacagacagaagcagcaacactgttattgggtccaatgcagcttttgagatccagcagaaacagcctgcctgcaagcggcttcctagcgttgttgcgaagctcatgggtttggaagagttgcctgagcataatcaaagtatagcatcatcacatgcatgcaaaaccgttcaagggagcaagcaagaggccatgttgaaccccttgagcatctcatctcacaacgagcatgctcttcgacaacaaaggaatcatgattcaactgttagaaatttacccaactctaagtttcctgtcgaaactgcaccatggaagcaacaagaaaggattgtccttcctcgcaaactgccaaagggatcaaaaggagcccacggaagagaacaacctgctgcatcagtcatcagtgacatagagaagcggctcaaggatcttgattttcgacaatcgtacaaggaccttagagcgcttaaacatattttggattccatgcaagcaaaaggactattggaaaacaagaatagggaggaaatatctatgccaaagttatctgatggaaaccacaatggccaagagatagccagtgtgaacatgagagtgaacagtaacaccaacaacgtgtgtatgcctgaagagagcaacgctgaaagctctttcaaatcacctattgtgatcatgaaaccttcaaaatgtgcaaaccttttcaacgaagttgattcttctgtcttccccttagggggttcatctgatcccccacaaccacaaacaagcaatagcacctatagaaggaaagcttcaacgagaaatagaacagctaaagagccacatgcaaaatttagttcaaaggtgcctacttctcaaccccttgtttcttatgacaggagatcatatgtaaggaatgacgatagcagcaacaaccaaaaatctagttcactactggttactgagagctcatccagaagacagcagctaccaagggacagtagcataagtatgaaaaagaataaacattccactaccccaaggttacaacagagaaaacttggttcagagcggagggctagaccacctattccttgtgctgagtctaacaaaagccaaaggcaatctggagataggaataatgcagaaacagtgtcaccccgaagcaaattcagaaggaaacttttgtgtccacaagaaggtgatgatggcatgcccagtggattgaacaacaggacaaggagcctgaaccagcatggcaatgatatgtccacaaggtcagatggcagtataactgttgcttcagagctggatattataagcaatgacagatctacggaagttgatatttctaattttgatcaaggcattggaactccatccggaaggaacccacaaaaagtgaaaacctcatatgatgcaagcaaggacgtgccatctgtagacccttcagctggtatttcggaacggcccagtccagtgtctgtgttggactcttcatttgatcatgaggatttgttcccgagcagcaggaatccaaattcacttgctgttgatgacgagcgtcaaacattaggtgaaccctggaaaccttctgttacaaagccaacagaggtgggcatgcagtccaagaacaataagctcgctaatgtcgtgagcctgcttcagaagctccagcagcttagcgtgagcaaggatgaggacgcacctccggtcgaccatatggctttcctgtgcgagacagaaagcccggaccaccgttacgtgtctgagatactgctggcctcgggtcttctgatgaaagagctaggttcaggacaggcaggcctccagctccagctccactcctctggctacccgatcaaccctgacttgttccacgtgctggagcaaagaaaggcaggatgggccagcatacctgacggcatccaccagagcaggagcggcgccaagtctgatcccaagagagcgcaccggaagctggtgtttgacaccgcgaacgagcttctcctccagaagtttgagaaggaaaccacagtttacgcggtcagttcctccaccggagcgaaggatcatccacctgcaaaggctcttagcgggcagcaactgctgaagtttgtatcttcagaaatcgaaggcatgggtacggagcgatcgtccacctgccagatggaaggcggcgtgatacctgacgcagagatcctgcagaggctgcagggatggacgagcttcagcagggagctccctgggatggtgctggagatcgagaggtcggtattcaaggagctggtggacgaggtggtgcatggggagtctgccgacggcccggagatgaaggcggcaggcaggcggagaaggcggcggctctttgcttgatatggtttgtgtgaccatcaccatgcaccgggtgggttgtccaagtagatgggcctgatcatgc

SEQ ID NO: 395 - DNA, 431 bp, Zea mays
cctcacattctcctgccatatctgctgcccgctgctccccccctctctcttcaagctagctagtagctggctgcatgctcctcgcgcgagccatggtgatggagcacaggaagaagtcgaattatcttgttgccctcgtcttggcttcgctcttgctctccgccatggcaggagggcatcggaagaagcttctgaacaaagacgacgcatcagaatcaatggagacattggaatccacgcagcagctgcaggaagacgacgaaatggctgtggtggtccacgagagaattctcaggcaggcgaagatgaacgactacgggagctacgactcttcgccgaccatggctaagcctcacttcaaggacatacctaactagccagccccactagctactatatacattgaggtgttgcttgctagtcgagtctag

SEQ ID NO: 396 - DNA, 413 bp, Zea mays
aaaggatccaaagaaaggcctgcttcttcacctcgcgctccaggttcatgttttgagcgtgtacagtgcatgtggtttcagaaatggggacgctggcgtgcccatggagatctggccacctctttgctttcatcaccttcgccgtgctgttcttctcgacttcatttgccgggagacagtacagtttcttgatggatcaagatgccctacgtcaacaagaaggagagggagcacgaactgagcagaaggaagcgctagtgccactggtgcaagctcggcggctcagcgtcaagacgaacgattacagcagctatgacccttccccgtccatggacaagccacactccaagctcataccgaactgatcaatcatgtacccgtccaggttgcagcagtcgagttagggtaccttt

SEQ ID NO: 397 - DNA, 1117 bp, Zea mays
gaggtagaccgaacaactccaggtcgcgggagcggccatttctctggggcgggaccgcgggagagctctagctcttgcagcagtagaactctactgcagccagagttaagagaaatggataaggatggcagctccgagagaagtcgcccagatcatggtgatgtgaagatgctcaagttcaaaccaaaggtgcctcgacagaagcaaaagccaaagcaacaagaccctaagccaattgatgaagatgtgatgaagatattgaggactcgccaagtggctgcaaaaagtgcaccaaacacagaagatgagtgctcaccacagaagaccctctcgacgccaccttctgcagatgttgtttgcttgtcaccagcgcaactcggagtgcaaaaacaaaatcaattgccactccaaattcctagatccttccctgttcctgttaattcaggattggtttatgaagaagagagtagtgatgacgacgacgataatgatagtgacaatgttgggttgctggagactcagccagattcaattgaaagtgaagctttaacatgtccggccgaggagcttgatttgcttcaagaaggtagcaaagaaagaatgttcttcttccagttcccaaactctcttcctttacccaaaaggtcgtccagtgccggcaaggaggtgatggaaggatccaacctgcagcagctgcctcagggttatttgggcaaaatgctagtatacaagagcggcaagatcaaaatgaagttaggagacatcatctttgatgtgaacccaggagtagaaagtaggatgctgcagcgtgcagtagctctcaacactcgagacaaacactgttgcttgcttggagagattgagaatcgtcatgttattgtgactcccaatgttgattctttgttgaacgacaagtagggaccaactgtagcagctttgtcacagattgtgtgtagacctgtagatatgcagggttagtgacatctgtagaaattatatcagctctgtcaaatgatgtataggattttagttgtgtagtgttgtgaacgttttattgtgattgcagtgctatgttagttttagaactgcatgcagctccctgtggatgaatgtttgt

SEQ ID NO: 398 - DNA, 566 bp, Zea mays
aaaggatccgcgtcttgtctcgctgtaccggccgatctccccattctcccctcttcgccggtcccaccaccgcgccgatcctgatggcctccgccgcctcatcggccgtcggcgctggcaaatcgctgttccaggggctccgcaggttcctcaagaagccgtgggagatcacaggcccctgcgcctctcccgagtaccgcagcgcgctgcctggcgcgctcgagtaccgcgtcaagtgcccggccaccgtgcgcgacgaccgcgacaaggccatcgtgcccacatccgatccggagacagtctacgatatcaagtacttcacccgcgaccgccgccggagccgcccgcccgtgcggcgcaccctactccgcaagcccgatctcgagagctacatggccaccaagcagttcgaccccaccaatgacttccccgtaccatacgtcaacaccaccgtcgaggaggatgacaacactgtcggcggtggctaccagaagtgactcaggaaagcttgctggttaatttggtaggtatcctttgattggacttcatcagaagcgggtaccttt

SEQ ID NO: 399 - DNA, 1579 bp, Zea mays
cgtaaaaccctagctcttgcgccccctcctctccaccgcgccggcgagccgtggaggcgcggagctaaggatgccgcggaccaccgtggtggagagccccggctgcccgccgctccgcgccctcaccaccgacatcctcggccttgtcaaagtcgtcgaggcccacgcgaggccggcgggtgccgccaaggtcgtggagacgtggggcgcacccgacgcctcctgcgccatcgtcgctgcctccctcgccgatcgtgccaccgaccccgttttggctgtggcgaggaagaacggcgtggttgagttgctgaatcccctgaacggagatactttggctgctgtcaaggcagtggggccagcaccaaatgatggtggcgctgaaggtgatcccctcactgcattgcaccttttcacaagacaggcttcggactcgatcttaggaacgtttcttgcttgcactgagcaggggaaagcttctataaggtccattacgaaagaaaatgcagcttcgggctcacatattgagccatctgctacatgggatgtgtgcggtggggccaatgtgcaattttgctcagttgatcatggtgaaaactatgtgatgtttggagggaaaggtatagaagtgagtttgtgggatattacatcttgtagtaagacatggtctgctaaatctccccgaacaaatagtcttggtatattcactcggccttggttcactgctgggaccttcttgtgcaaggatgatcatcgtaaaattgtagcctgcacaaatagtcatcaggtccgcttatatgatactgcattgcaaagaaggcctgccatctctgttgagtttaaggagtcaccaatcaaggcagttgctgctgatccgaatgggcatgatgtctatattggcacagggacaggggaccttgcttcctttgacatgagaactgggaaattgcttggatgctattttggcaaatgcagtggaagtattagatccattgttaggcatccagatctacctttgatagcatcttgcggactggatagctacttgcgtatttgggacacaaacacaagacagttgctatctgctgtctttctgaagcaacatcttacaactgtggtccttgattcacatttttctgttgaagagcctggagagatgaaatccaagcaactggagtcttcagtggagactgagactgaagtccgaaaagaaaagaagaaaaagagtaaggcaattacagaggatgagactgaggcacaaatccgaaaagaaaagaagagtagaacaattgaagaggaagaacaagctggattggtcgaccatagcgatattaatgatgaagtatatgccagaaaagaaaagaagaaaaagaagagtagaggtattgaagggggcaaggagcgagacagcgacggggaaatttgcagtcccaagagaagaaaatctggagaaagaagcaaatgcctgaagaagaggagcaagaaacagctggttgcctagtacaagtatcatttctcattacccgccttcttgattttgcagaattacacaattttgtgtggtagtttgttcggaatttag

SEQ ID NO: 400 - DNA, 511 bp, Zea mays
aaaggatcctggttcgctaggtttactctcccctcctcttccacggccgcgcctgcgacacccatccgccgccacgccatggccaagtacaacgtggtgcagaagaacaagcgccagtgcaatcaggaccgcaagcgcgccgcgcatggggagcccgggaccggcaagctcaagcagcggaccgcgcccgtctccatgtccggcaagcggaagaagaagctcgagcgccgcctcaaccggaagcagaaagaggctgcgatgattaaggcgctggagaacaacatgggggatgtcgacatgatctcagttgaagggtcttcagaagctgcaaagggcaagtcccaagtgaagttcagtgtgaagaaaaactcaagaatacagataaagagattaaagggcaaaggcaggaagaaagccaaaaattcaaaaccacctgccaaggagagagttgatgccatggtagaatgacagttgatgccatggtagcatgacggacaagactggtacctat

SEQ ID NO: 401 - DNA, 978 bp, Zea mays
tagtttctggcagccttcttcctcctcgctctctacccgaggagagaggagaggagagaaatccggaggcaaagcttcagggtttgtataaagggattctagatctaatcgactaaccagagagaaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagggagaggagagcggcctgtcggcggcgtccccgctgttctgcggctcgccgccgcggcgggcgtcgaacccggtggtccacgacagccggttcggcgtggactgcccgcccctgcccgtgcccatgccggtggcggcggcggccgtgcaccggccgtcggcggcgccgcccatgtcgccgcgcggcggcaacgggtgcgcccgcgcccggttcgcgttccagcccgccgcggtccgcgtcgagggttttgactgcctcgaccgcggccgcggcggccgtggccacggcatcaccgccatggcctagatgcacatacaaacgaacaccaagtaacccactcgcatccccctcttctttcgccccctcctccatccatggtgcgaagaaagtgtaaccatccaagcactttgtcggaggagagagggagagagaggatcaatcaattcgtcctaaatttaaccctcctaaaaaccacttatattactacttttatttatataaatccgtccccatcccaaccatccaccagcccgcccgccccgcctgatccgtcccagcgattgctatgagtttaggtgattttaccacagatcttcctcttttttttgtatgtaaataaagtttgaggtccaggctcgtcatgtaaatt

SEQ ID NO: 402 - DNA, 673 bp, Zea mays
tgccgagaatagatggggttcgtgtccttcgtcgggcgggtgctcttcgtcgccgctttcctcctctccgcctaccaggagtttaatgaatttggcgctgatggtgggccagcagctaaggcccttcagcccaagttcaatgtgtttgtaaaaaatatctctgcacatctgggagtagctgtcccgcacattgagttgaagcatgtgattgctgctacaattgctcttaagggacttggaagtctcctttttattttgagcagctccctcggtgcttatctcctgctgctgtacctcgctttgatcactcctatcgttcacgacttctacaactacgacacggagaaggaagaattcgcgcggctgtttgcgaagttcacccaggacgtggcgctggttggagctctcctcgtcttcctgggcatgaagaactccatcccgaagcggcagggcaagaagaaggctcacaaggcgaagacgaactagtaagaggctgctcgctctttagatggttgcgcgccggcctcaggcgggtgtcaggagacgacaggccccctagtgcgaagcagtcgtcgatgcgcatcgagctgtcggctgcgcttttacatgtatcggatattcagattccattccattttgcggggcgcggcccgaacgaaggtgtgactagtga

SEQ ID NO: 403 - DNA, 820 bp, Zea mays
gcgctatccactcgtctctccgtccgcatggccacttatctgaacgcaccgccggcagccaccacgacgactgcaagctgccgccatgccttctccggtggcagccttcgtctactccggccgagccgaccgacgctgcacgtgacgtgccaagccgccgtctcctcctcctcctcctcccagccgccgtcgtccccgtccaggaggtcagcctgcctcctcggcatcgcgtgcgccgtcctgctccgcccacgtgccgcctccgcggccgaaactgacgaagagccggccaacaacggctggtggctgaccgagttccccttgcccgtgcccaagatcgtcaacaaggagatcaacaacgcggagacgggcacgcgctccttcctcaagaacggcatctacatggcggacatcgggcccagcttcgcggcgcacgcgtaccggctgcgcagcacggccttcgacctgctggcgctggaggacctgctgggcaaggacgcctccaactacgtcaacaagtacctccgcctcaagtccaccttcatgtactacgacttcgacaagctcatctccgccgccgaagacaagccgcccttcgtcgacctcgccaaccgcctcttcgacagcttcgagacgctccaggaggccgtcacagccaaggacgacgccaggatcggcgaccgctacgccgagacaaagctcatcctccaggagctcatggccaagatggcctagcagaaccacaatttttcattcatatatcatgatgtgtaaatgaatacttgaaactcacaaggggtattgcagaattcccagagca

SEQ ID NO: 404 - DNA, 802 bp, Zea mays
aaactcgagctgtggatcggaaatggcaatcgacgatgaatcgccgctcagagtcaacaccagaggcggcgccatgggaggaggggagcgtgacggcgcggagaaccagcggtggccgccgtggctgaagccgctgctggggacgagcttcttcggccaatgcaagctgcacgcggacgcgcacaagagcgagtgcaacatgtactgcctcgactgcatgaacggcgcgctctgctcccagtgcctcgcctaccaccgcgaccaccacgccatccagatacggaggtcctcctaccacgacgtgatccgggtgtcggagatccagaaggtgctggacatcagcggcgtgcagacctacatcatcaacagcgcgcgcgtggtgttcctgaacgagcggccgcagccgaggcccggcaagggcgtcaccaacacctgcgaggtctgcgagcgcagcctcctcgacaccttccgcttctgctccctcggctgcaagatcgtcaggacctccggcgacttccgcatccggaagaagcacgccatcgtcgcaaagaagaagagggagaagaagcatgcgccgccgcagcagcagcagcacaggggcgcggcggactcggcggacgacgacgactcgtccaccagcaccagcggcggcagcgacaagagcagcgtggtgcagagcttcaccccgtcgaccccgccggcgacgaccgccaacagcttccgagccgggaagcggcgcaagggcgtgccgcaccggtcgccgttcggcagcctcgtggtggagttctagtaagaattcaaa

SEQ ID NO: 405 - DNA, 1682 bp, Zea mays
ggatcccgtaggcctgacgtcaccaaaggatcccgtaggcctgacgtcacccacgccctcgcctcgcacggggcggcgcggcggccggcggagggaatggcgaggcgaagcagaggcagcggcagcgtcacggacgcggcgtcgaaggcggacgcggcggcgatgcggatggtgtcccgcaggggcgccgtgcggctggtgctcgtgtcggccaccgcctgggccatgctcgggctcgtcgcgctcgccttccacctccggccatgcagctcccgcgtcgcattcctctcagctctttgcaaaaaagacagtaaagttctctctgtgttggactcgatggggctctcatccaaaccactccaccgctgcccgatacctgttgcggatgatccaaatgttgttgtcataccaaagaggactcccaacacaattgtgaagaagttggcatatataactgttgacaaacaggataaagatccctcaccgctgtttggaggacgtcaaaactggaaacagagggaggagagctttaaactgaactctaccatgaaggttcactgcggatttatgaaaaatagtggtgcagatatggatatcattgatgtcaagtacatacagaaatgcaaattcgtggttgcctctggtattttcgatggttacgacatccctcaccagccatccaatatcagccgccggtctcagaagctgttctgcttcctgatggtggtggacgaagtatctcttgattttatccaaaagaacaccaccgtcaagatcgacagcgctggagggaaatgggttggcatatggcgacttctaacagtgcaccgcctcccattcgacgaacctagaaggaacgggaaaatacccaagatcttgacgcacagactattccctcaagcttggtatagcatttggattgacgggaaaatggagctcatagttgatccgctgcttattctcgagaggtacctctggcgtggaaaatacacattcgcggtggctgtccacaagcatcataggagcatctacgaggagggcgacgcgatcaagcgacggaagcgctacgcccgccctttggttgatcttcagatgaagatgtactattacgaggggatggagccttggagcccgaagaaaaagatgcctggcgatgtgccggagggagccgtgctgatccgggaacacacagcgacgaccaacctgttcagctgcctctggttcaacgaggtgaacctcttcaccccacgcgaccagatcagcttcggctacgtggcgcgcaggctcggcgacgctctcgagctcttcatgttccccaactgcgagtacaactcgctgttcgtcctgcacaggcacacgagggagcactcgtctaaggtcgagtgggccaaaacggtcgacgagatcgtggagaaggggctgagggagagtagaggagggttggggctgtggactccgtaccctgcggacctcagctccgtggaactccctgctgtaagaagaacttcgccggcaggataaggctaggctgtcaaagaccacaaagctcccagcctagcctgccgatcctgtgatctttgattcgttcatggttgtacagagtagaactccactgtttgtttgttttttttggcgtagattctgtaggctgacgcttggagtttgttgcttccagtgaattc

SEQ ID NO: 406 - DNA, 1032 bp, Zea mays
aaaggatcccacgcagtaacttgaatccctcagttccagcgcgtggtccgccaggtccactttccgtctttcctctggcgctcacgatccttttccctgcgtacgccgagctcacgcaggacaggagggagcggaggagatagacaaacagaaagagcccgtgtgcgtgacgcacggacgccgtgactccgccgcaaagagagggagagtccacgctctgaagaagcaacggcgacgcccccgacgacgagcacagctgcacagcaaactagcagcgccctcgtcagttccgtctcgttcccaacctctcccggattcgattcgattgacccgtccgctccaaatcgaatctaatcagcagttttggagttgcggaagggagaaagagagaggagaggggcatggatcaggtgctcaacaaggtggggagctactggttcagcaaaagggccagcaaggaaatcgactccatcggcgacgacatcagctcgatctcaagcagcattggagggtcagccaaatggatggtgaacaaaattaaagggaagatgcagaaagcactgccagatctcctcaaggaatatgacatgccagcagggctcttcccacgggacacgactaactatgagttcaatgaagagacaaagaagctgacagtgtacatcccgtcagcctgtgatgttggttacaaggactcgtcagtgctgcggttcttcacctgtgtgaccggctaccttgagaaggggaagttttccgacatcgagggcatgaagaccaaagtgctggtctggaccaaggtgactgccatcaagaccgagggcccaaaggtccatttcactgcaggcgtgaagaagactcggagtcgtgatgcctatgaggtcgtcagagatggtatcaccatagacaagttctagagcatatacctggcatgaaaaatgtgacgcggttattcatatatgcttctctcctctcagttggtacaccgaaattcatacaatatcgtgggctaattctgcatttgtaggtaccttt

SEQ ID NO: 407 - DNA, 1360 bp, Zea mays
ccaaagatcacgaaagcgacgcgcacaccccaagaaagggcggctccccactccgcctcgccgcacccctttcggcctttcttcctcccccacctcttgctcgcgtcccagctcccaacaccagtacaccacgcgccggctgcgagcgatgcccgcgatcccaacggcccccgccccctgccccgtgcgcttcctcctcgcccgccgccacagcctccacatctcctacccgtcgccttgctctaaccaccagcggctcccgccccgcctcctgcgcctgcccgctcgcccccgggccgctcccatgtcggccgaggcgcgggcacccgcgtctccggtggcgccgccggcgcaccccacttacgacctcagggccgtcatcgcgctcgccctcgcagaggacgccggcgaccgaggggatgtatcctgtttagccaccataccttctgatgtcgaagccgaagccacatttattgctaaagcagatggtgtcattgctggaataagcctagcagatatgatatttaaccaggttgatccatctttgaaggtcgaatggtttgaaagtgatggcaattttgtccacaaaggactgcagtttggaagagtatatgggtgtgcccgcagcatcatcgttgctgaaagggttgtgctaaatttcatgcagcggatgagtggcattgcgaccctaacaaaggctatgtctgatgctgcccgtccagcatgcatattggaaacaaggaaaactgctccaggtttacgtctgattgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggtcgagacaaggacaatcgaagaagtgaaagatttgttgaagtacgctgctgagaacaaaacttcattgacccgtataatgttggacaatatggttgttcctcttggaaatggagatttagacgtttcaatgcttaaagatgcagttcggttgataaacggtagatttgagactgaggcgtctggaaatgtgacagttgatacagtgaagaaaatcggagaaacgggagtcacctatatttcaagtggagcattaacgcactctgtgacggcgcttgacatctctctcaagatagacaccgagctggctcttcaggttggaagacgcacaaatcgtgcttgactcccacagcattacgttgtggacgcaacgcacgcaagcaggatgacagagggaccagcgtggcaaaccagcttaaatagctag

SEQ ID NO: 408 - DNA, 1508 bp, Zea mays
ggccgatgcaggccgcgcccgggagcgtctcttgggccgcctcgcagccgtccgtcctcggccggtgcggcggcggtgcaccgtccgcttcactcaagtggagagctggcggcgtcggaggaggggaatgcagggtccggggccgggacgtcgtcgtgccgcgctcctgcgcgcgcgcgcaggagaagcgcctgccgcgggtgcggaaatccaaggaggagaggagggagatggtggagtccttcatcaaaagctaccgagtttcaaatgaaggaaaattcccatcaattaatctgacacataaggaagttggaggatcatattatatagttcgtgaaatcatgagggatatcatccaagagaatagagtccttggtcctggtggattggatgctatgacacttagttttgaagattgcgctgattcttcaaagtcatccatgaagcttgaactgggtcaagacagtatagagatcttagatatgtctggtagtgaagtcagtaagagtcatgtacctgaaatatccagcactgatgaatcgtttccattgcaaggtaatgccatcagcaatcatagactgctgggttcatctaatatcttagaggttggtgttctgaatagtgtggtccaaaatggaagtgtggcagatgcaatattcatggaaacaaaccttgcgaaacaagatgaagttccatctagagggtccattgagtttgacttgaatacttctgaagagcaagctcgcttatttgctcaggtctctgattcagatgaagaagtaacactaaacaatcaggcggatgcacaggacgggacgaccaatagtggcactgatagagttattcttcccttagaatctttcgctgtttatgaaaacaatgcttcacttctaagagatcatgagacattgcctgatgataatcatgatggatcaactgatagggttgcggatgacgcaagtctccttgcggcgaccaatggtgttcaagcaaagcaagcttctttacatgagcatgatgcatcaactagaagtgtattgattgacaatgctcagagcttagatggtcagtttagtactactgtgtctactgatcctataaatggttttaaattggagactgaaattgcaaccaagacagttgaaacatctcaagtacacaggctgcaagatgagtttgagcaaccattagttgatgctagctatgatgggcaagaaaactctgatagcccagtttctcatccagcattagatacaaaggggctgttgcacacagaagatcagctcaatgtggtacaggtagatgaaactgaattcaagaactcaacatctgggatcacaaaggaagaggtccatgcagccgatttcaggcatgaacaaggaattaacaccacaatggcgatcagcaggagaactttaaaagctcagcagaagaaagatgacaacctattctggcttgtccttagggcatttgttgttgctatatcgaaaatttgggcaaaatgatga

SEQ ID NO: 409 - DNA, 3241 bp, Zea mays
attcgctgcggaggtagacggccatgacgaccaacaccaagcgcgcctacaagctccaggagtttgtggcgcactcgtccaatgttaactgcctcaagattgggaggaagacctcgcgggttcttgtcacaggaggagaggaccataaggtcaatctttgggctattgggaagcccaattcaatactgagcttatcaggtcacacaagtgctgtggagtcggttggttttgattccacggaagtgtttgtggctgcaggagcagccagtggaacaataaagctatgggatttggaggaggcaaagattgtccgcactcttactggacatagatcaaactgcatgtcagttgattttcatccgtttggggaattctttgcctctgggtcactggacactaatctgaagatatgggatataagaaggaagaattgcatccatacatacaaaggtcacacacgaggggtgaacactattagatttacacccgatgggcggtgggttgtgtctggtggcgaagataatatagtaaagctctgggatctgacagctggaaagttgttacatgaattcaagtgtcatgagggtcagatccagtgcatagatttccacccgcacgagttccttctagcgacaggttcagctgataaaactgtcaaattctgggatttggagacatttgaattgattggatctacaggacctgagacaacaggtgtccgatccatgacattcaatcctgatggaagatctttgttatgtgggctgcacgaaagcttaaaggttttctcttgggagccaataagatgccatgatactgtggacgtgggatggtctagacttgccgatttgaatgtccatgagggaaaacttcttggttgttctttcaatcaaagttgtgttggaatatgggttgttgatctgacgcgtcttgagccatatacaatgggtacttcaacaaaagtaaatggtcattctgaattgaagactgtttctagcggcactttgcctttacaaaatgatagtggttcaagggctaacatagggcgatcatcagtcttgcaaaatacagagaacaaccttaaaactacttcaggaagactgtcggcttcacagaactcagattctgcacccaaagaaactaactcggcaccttcaagcgggttgatcccaagcacaccacatagggctggagttggctcccataatagatctgttggaaattcagcttttcaatctggtggtaccaccttgaagagaagttcgttgaggaataacagtgcctctaatgttcacaatttcagtaaagctgatgtagtgcctgtcattgttcccagaactagctcaggaggggagttggctactgattctagaagcgatgctgctgatgtggcacccgttcttccgaaggtaaccagaagggttgaacctgctaccgattctagaaaagaaagtaatgatgtggaacttgttgttcctagagcaagctcaagaatggaaatagccgatttagcacccatttctagttccaagtcaggcagaaggttggagtctgcccctgattcgaaagaagaaagtgctgatacagcacctgttgttgtttccaatcccagggctaatgtaagaatggaaatagtctctgattctgcgcccgctctttcaaagtcaaacagaaagctagattctggcactaactcaaagaaagaaagtgctgatgcagtcattgtacccagaacaaattctagaatggaaatgatttctgattctaggagagaaccctctgctggaagaatatcaccattcagaatccagtcaagatatgctgagccacggaagctagcccatgccagaactgattcaaacaaagttgatagcagaagtaaaattactgaaacagaagacttcaattgccaaatatttcttccccgtagaaacagtgtttttcaaacaataagttctgaagaacctcgtgaagatgtaaagtgtggtccagttgacagggtgggattttcaaattcatcagaaccaaatgcgagtgtccgcaatgagaattatgttcctagaatgcgcaaaccaggagacaactgctatatcgaagtttcaagagcaggaagagcaaggtcaagtgtctctaattgggaagggagggatcagccccctagtcatgaagaaccaacaacaagcagttctacactggctcctaccggccatccatattcatctagaggaagcaatcaagcttctgaagctccaatcatagctagtgatgaagatgttctatctcttatcatggagcgacatgatctatttttaagctcaactaagtctcggctgatgaaattgcagattattcatcaaatgtgggaaagaaatgacatcaggggtgtgctctctgcgatggacaggatgggtgatcatgctgtctgtgctgatatggctagcgttctcatggagaaaagtgaaacaatcacactagatttatgtacctctatcctgcctgtcgtcaccgatcttctggagagcaaaattgacagacacttagtcgtcgcattggaattgttggtgaagcttgtaaggacttttggtccaatgatacattcaacagtatcgtcaggtccttgtgttggtgtagaccttgaggcagagcaaaggagggagcgctgcaacttatgcttcatcgaattggagaaggccaaaaataagcttccatctctaacaagaagaaaaggggcggttgcaaatgctgcacaagaacttgctcttgtcttccaggaaatcatgagttgactgacgacacactagatatacacaattagatgggacatgcttcggcctctgatggcaacaagattggatatcagctgccatggagggtgctagctattcagtcttagcgacgtcatcaagctccaaggccacagcaccaacaaatgcattttgttgctgctgttcgtgccttttgtacacatgctaacacataatccatgtcatttgtgaagagaagctgccatggacagtgacttcatccacaatattatgtggatggcggcagctggagatgttaggccccgatcgaatggtgatcagcagatgagacttgcttgggcttttctggcactcgtagttctttgctgtctgtaacatctttctcatgtatcgttatcatgtgcatgtgcaacagtcaagtggttgcatttggtagtttatggttgtgctgtgtgttggtcgatttagtggtcgtt

SEQ ID NO: 410 - DNA, 601 bp, Zea mays
atagtcgaagcgtagatcgcagcggagcagaggcatggatggaaagagctttagcaacgaacagcaagcccaacaaaagaacccagacgcagtgacaaacagtgttccgagccaaggccaggagcccttgaacacgtttccagattcagacgatggaaacacaaacaccggtccgttgaatggccacgcagcagctcatgtgaacatggaagctgccatctccacggaggacgtcatacgggctggcgggttcggagcgaaggacgacatcggcagcctcctcccgacggcaattgattccaccgattttgaggcctcgctgcgggatgcccgtggtttcgagggcgagaaagcggcgccgtcgcatcctggactagggtggaagggggagaaagctgatggtggaaccaaactggcagatgtggcgaagcagtgatcgcgctttcctcttctgtagcccagctccagccttcagaaaaccttgttttctgccacgtgtgtctggagagctgccctgcgtatgaactttctttgtcacagtgttttgtgtgacacataacattctgtgtatgaacatgaggatgtcggttctatgctgtct

SEQ ID NO: 411 - DNA, 1583 bp, Zea mays
cacaacctgtgtacctgactaaccccgtgacgtcggagggtggaggctttgcctaaaccctctcgttgctggccccttaacctcgccctaacccggccatggtgacctcggatccggacgggaacggaggcgcgccggacgtctccgagcttttctgccactacaactccctctacttccgcgattccctcggttcgtgcgctgtctcatggaccgaggacccactacctgattgtgatgtaagcacatgtgactattatccgggaggtggtggctgtataatactgctttccaaatcattatgcgggtctcataatggatctgatctgaagaatgctttgcttcatgagatgattcatgcctatatttgcatcaaagacaataacagtaaccatagtgatcatggtgcaaaatttcagaaactgatgaatacaatcaatttgagttctgtagctgatccccatcgaccagttgatggctacagcataactctgctccatgagatccataagaaatattatcactacaaatgtcaaagctgtgcagattttatcaagtcaaccaatatgagaggaccttctggtgatgactgcattgagagaaaaggtgtagatgacccatgtcataattctaactgtcactggcatagacacaagcagcagtgttcgggtaattattgtagagttcaagaatcatcaccaggaggtccagaactaaaatgtttggaagctgtagaagcatacaatgagggcaaggttgaagaacctgcctgtacaagttggcacaccacacatacatcaaataagagcagaagaagcaataaaaacgagcgggaagatgcctctgtggagttccttcatgttgcagataatgcagttgtctgttcaggactggattcctcttcaaaagacaggtccaataagaaaatcaaaatttcaaaggatgttaactctgaccttggaaggacagaaactgttcaggaagcaccaaaacgcagaagaacagctgtactagataaccaagagtgcagcagacggaagaaaaggaaacaaagcaatcggtgtggttcctattcggtaataattgaatggttgaactactattgtcttagtgagtccgatgaagatgaggtgccattgatcaataagcgaacagaaagaaggcgccgacaaagattacatgaaatgtatctagccagggaatccaatgatgttgagtttggcagctcaacttctcatacggttggttcttgctcactggctcccaaggacaataacaaaggtgaaattgtaccatcttctcaacctgaagaaagatcctgctcaagtcatcctgtgagtagcaacggagttgctggaaatcaagctggtcatgaacatatgtcttctccaacggattcaccaattagaggtgaaattgtagacatttcagatggttgagtgcaagagttccgcgttagttccttgtagctggatcctggatgaaataatatacagtgtaatggctataaagaccctgggttttcctatgcaccttgcaactgctagacatgcgcacactgccaagcagcctttgtactgttt

SEQ ID NO: 412 - DNA, 917 bp, Zea mays
gagcacatagagtggagtggtggacagaccatggagctctgcgtctctacacccccatcctccgtccgcgccaccgccgcgcccatattcttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtcacggacaagcccgatacgcctgccgacgacaaggccgaggaggttagcgccgcgcctagtggctccgcggaggcgcctatggcagagctagtgccgtcagaggcgtccccgtccccagatgatggcggcctggatgagattctaagcaagttgaacattgaagtgtctccaactttactcctcactggatttggtgcttttattgctttatggatcctatcttctgttgttgctgcagttgattcagtccccctgctcccaaaattgctggaattaataggaactgcttacacaatttggttcatcgcacggtatctccttttcaaggaaagcagagatgacctgtttgcaaagttcgaagatctcaaacagaggattatttgatctatcgtcgaccttttgccacgtgtttaggctttacagccagcttattattaggtttttttctccctttcgtttgaaatattactggatgggtaaagaaggtcatgtatctaaattgtctcctcagggcttgttcggttctaccccagtctatatggattgaggggattgagatggtttcaatccctagtaagtcaaaatctccctcaatccgtatcaatcacctccaatccatatagattgaaaataaccgaacaagccctcatggggtctgttatcagaccccaagttcg

SEQ ID NO: 413 - DNA, 2604 bp, Zea mays
tcaaacttctcgatcaggttcctcttcttcttcggcgcgcccgtctcggtggacgccacaggaattggctcctgacttttttccacaggtggtttcgctgggcccgatgcccgacgttatggccgcagccctaaccggcttctcgcctcgcggggtgattccgagcagaggcagagcatctcttcccggggtcgctagagcgtatgccgagaggcggttggttgcagaaaacacaagcctgccaaacatgcataaggaagatcttgagactataataaggaatcagctccggaagccccagttgccaccttcttcatacgacacagcgtgggtttctatggtgccagtgcggggctctcatcagactccccgcttcccacagtgtgttgagtggatactgcagaaccagcaggatgatggatcttggggtgtcagccaatctgactcatcggtcagcaaggatgttctcctatccacgttggcatgtgttcttgcgttgaagagatggaatgttggcagagagaacatttggagaggactgcatttcatcgggaggaatttctctgttgctatggacgagcagttcacttctcctataggtttcaacttcacctttcctggtttgcttagcctcggcattgatatgggtttagaatttcctgtaagacaaactgatgtctgtggcattcttcaccgccgggagatggaattgaaaaggctggctgtggatagttcttttggaagaaaagcatatatggcttttatcccagaaggattcggaaatatgctggactgggatcaagttatgaagtttcagaggaagaatggatcattgttcagcactccttccacaactgctgttgcattaatccacaaatacaacgaccaagcccttcaatacctaaatttgcttgtcagtgaatttggcagtgcagtaccagcaatgtatccttcaatggtacattgtcagctttcaatggtggacgcgcttgaaaaaatgggaatttctcagcgctttgtcagtgaaatagaaagcatcctggacatggcatacaattgctggttacagaaagatgaggaaatcatgatggacatagcaacatgtgcaatggcatttcgccttttgaggatgaatggttacaatgtttcctcagatgagctgtctcacgttgctggagcttccactttccatgattcactacaaggatatttaaatgatacaaaatccctactggaattgtacaagacctcaaaagtcaccttatcagaaaacgatctgatcttagatcgcataggttcctggtctggcaacttattgaaggataagatgtgctgtagtagggtgcaaaaagactcgatttttggagagatggagtatgctgttaattttcccttgtattccacactggagcgtctagaacacaagagaaacatcgaacattttgatgcttggggttctctgatgctaacaacaaaatcctcatcttttcgtatcaatcaagaattcctagctttggcagtcgaagatttcagtttctctcaacgtgtttaccgggatgaacttcggcatcttgatagttgggtgaaggagaacaagctggaccagctacaatttgctcggcagaaactgacatattgctatctgtctgctgctgctaccgtattttcttctgaattgtctgacgctcgcatttcatgggccaaaaatggtgtcctcacaactgtggttgatgacttcttcgatgttggtggatcaaaagaagaattagaaaacctgatagcactagttgagaaatggcatgcgcaccatgcagttgagttctattcggaacaggtgaaaatagtattttctgctatttatacaacagtgaaccatcttggagcaatggcttctgcagcacaaggccgtgatcttacaaaccacctagtagaaatatggctggatttgttaagatctatgatggtcgaggcagaatggcagagatgccaatatgtaccaacagttgaagaatacatgacaaatgctgttgtctcatttgcactgggcccaattgtgctcccagcattgtattttgtagggcaagagctattagagcatgctgtcaaagatgaagagtacgataaattatttaggctagtgagcacttgcgggaggctcctcaatgactaccaaagtttagagagggaaggcaaccaggggaagctgaatagtgtttctctacttgtgctccacagtggtggttctatgtccatagaagccgctaaaaaggcaatgcagaagtccatagacgtgtctaggagagacttgctaagattggttctcaggaaagaaagtgctgttcctaggccatgcaaggagctcttctggaagatgtgtaagatacttcacctgttttactctcagaatgatggatttagctccccaaaggaaatggtcagtgcagtgaatgctgttatcaacgagccactcaaagtccaaaatagtactacgtttttgtctagttcatcaaggtagcgaggatatcatgtaatttatcctgttcatatggatcagaagcaacagcagcaagcttaagatatttgtaagtttgtgactgggctgct

SEQ ID NO: 414 - DNA, 1120 bp, Zea mays
cgcagttctcactccagtctccacacacctctcacgagcgcgcgcgcgcgcgtccgccatggcgccgtctaagcctttattccccgtcgccgtccccgcccccgacccgtccgacgaggtcgtgcgcgagttcggcccactgctccggatctacaagagcggccgcatcgagcggcccctggtggccccgcccgtggagcctggccacgacgccgccacgggcgtccagtccaaggacgtccacctcggctcctactccgcgcggctctacctgcccccaagcgccggcgccggcgccaagctgcccgtcgtcgtgtacgtccacggcggcggcttcgtggccgagtccgccgcctcgcccaactaccacctcttcctcaacaggctcgccgccgcctgccccgcgctcgccgtctccgtcgactaccgcctggcgcccgagcaccctctgccggcgggctacgacgactgcctcgccgcgctcaagtgggtgctctccgccgccgacccatgggtcgccgcccacggggacctcgcccgcgtcttcgtcgccggggacagcgccggcggcaacgtctgccaccacctcgccatccacccggacgtcgtccaggcccagcgcgcgcggcaggccggcgcgccgccgctcaagggcgccgtgcttatccacccctggttctggggctccgaggccgtgggcgaggagcccagggaccccgccgcgcgcgccatgggcgtcggactctggctcttcgcgtgccccgagaccaacggtctggacgacccgcggatgaaccccttggcgcccgccgcgccgggactccacacgctggcgtgcgagcgcgtgatggtgtgcgccgcggagggcgacttccttaggtggcgcggccgcgcgtacgccgaggcggtggccgcggccaggggcggtgacctcggggaggccgctggcgtcgagctgttggagaccatgggagagggccacgtcttcttcctcttcaaacccgactgctacgaggctaaggagatgatgcacaagatggtcgccttcatcaacgccccctgaggcgtgaggtgcttgtgttcgcgtctcagaatcatcgttggcgtggctaggtattag

SEQ ID NO: 415 - DNA, 2242 bp, Zea mays
cagtggccaagtacactcacccgctcgcgcgcgtgagcgatgaaagctctcgcctcgcccgccgcctccttcctcccgggtatcccgagcccgagccctagccatctcgcgcgcgcgcctccccgatcagcggcggccgcgctctcgcggcccccttccgggcgctccgtcgccgccgcggccgcggccgccacaggggaccactggggcgccgaccaccagcactaccacggaggacgcgcgggcgcgtcggaggccgggcctaccgcgtcggcgcgcggcgtcaagtgcgacgtggacgtggtgtcgtggcgggagcggcgggtgctcgcgtccgtgcctgtggccgccgacgtcgacacgctgtggcaggtcatcaccgactacgagcgcctcgctgacttcatccccaacctcgtccagagtgtgacgattccgtgtccgcatgaagggcggatatggctggagcagagaggcctgcagcgcgcgttgtactggcacattgaggcgcgcgtcgtgttggatctccaggaaatccctgactccattaatgggcgagaactccatttctcgatggtagatggcgacttcaagaagtttgaaggaaaatggtccataagatctggtcctaggtcctctagtgcagttttgctgtatgaagttaatgtgataccaagatttaacttcccggctatatttcttgaaaggattataaggtcagatcttcctgtaaatcttcgtgccttggcttgtagagctgaaaagatttatctggaaaatcaaggatgtggttcaagaaaattttctgttgaggacttgaagccatcatatacttctcagcttaataactaccatagtacgacagttgagacttctaagtttaaacaagcgcctcccaggtctggtgttagcagtgtgcttccttcaccttcttctgaattgattagcaaatggggtgtatatggaaacatatgcagaattgataagccttgtgtggtagatgagatccatcttcgaagatttgatggcatgttggaacatgagggggctcataggtgtgtttttgctagtatcactgtgaaagcaccggttcgagaggtatggaatgttctcacagcatatgagaatttgcctgaattcgtaccaaacctggctatcagtaggattgttcttcgtgataataacaaggttcggataatgcaggagggttgcaaaggcctgctttatatggtccttcacgcccgtgttgttatggatctttgcgaaaaacatgagcaagagatcagctttgaacaagtcgagggtgatttttacacatttaaagggaaatggcgcttagaacaacttggggatcagcacaccctgttgaagtacatggttgaaactaagatgcatagggacacctttctctctgaatctatccttgaagaggtcatatatgaagatcttccatcaaacttgtgtgcaatccgtgattatattgaaaaggctggagccaagagtagcaattccacagatccagatccagatgttgatcatgatgaaagcaggcaatctgagcaaacgtgtgtgtcttgctcatccagtaccatgaagcagagaccaaaagtcccaggattgcaaaaggacatcgaggtcctaaaatcagagcttgataatttcattgcagagtatggtcagtatggtttcatgcctaagagaaagcatctccggtctcatggaagagtggatattgagaaggctataacacgaatgggtgggttccggaagattgccagcataatgaacctttctctttcttacaaaaatcgaaaaccaagaggctattgggataatctggagaacttgcaagaagagatcagccggttccagaaaatttgggggttggatccttcttatatgcccagtagaaaatcttttgagagggcaggtcgttatgacattgctcgggcattggaaaaatggggtggggtgcaggaggtttcacgccttctttctcttgaactaagatatcctagaagacaagcagacccggacgatgagagacagtctgaatccccgtctgggatgatgaagaagcacggagtgaaacctgatgaaggcaatgtttccccaaatgcgcagaaatggctcctgaagctgaaggacttggatgtcaattgggtggaatactaggtttagctttggaaaaagatatggtctctcatcatgaactcagctctttcctttcttcggaggtgtt

SEQ ID NO: 416 - DNA, 1680 bp, Zea mays
ggacgaaggaaaaggagaggagggagctctccatgggggagcccctcctcgcctccctctctatggagaacagcaacagccacccctgcacgctcctctccatggaccctgccggctcgcacctggcctccgccgagtcctcgggcggcggtagcgccgcgaccaatggggttggcaatggtgttgaccgggaactctttgtcattccgcggcgtgagtcggcgcaccctgttccgccggacatcaacctcccgctctctgcagatcactcaccgctgcctccgtcgtggagcctcgacacgttcgacatacttgatgtcactcttggaacacacaactacgagtctgaggttgcgcttacgcttccaaagccgaccggcaacggcaatggcagtgccgctatcggcgtcggcgcgaggaaatacgctaagagaggcgacagcatctggggcgcgtggttcttcttcaataactacttcaagcctgcacttgtggagaagtcaaaggggaagatggtgcgagacgcgtccaggaacatctcgggctttgacaagtctgatctacgtcttgatgtcttcctggtgcagcatgacatggagaacatgtacatgtgggttttcaaggagcggcccgacaatgcccttgggaagatgcagctccggagcttcatgaatgggcattccaagcatggggagccgtctttcccgttcagtgccgataagggctttgccaggtcacaccgcatgcagcgaaagcactaccgtgggctgtcaaacccgcagtgccttcatgggattgagatcgtggcctcgccaaatttgtccgcagttcctgagtctgacttgaagaggtgggctgaactgacaggcagggaacataatttttcagtaccatctgaagccagtgactttgagtcatggaggaatcttcccagcactgattttgaacttgacaggccacatccaccggccgcaaagagtgccactcatggccagaagaagggattgaatggttcaggtctcaacctttcaactccaccatcatcagacgatgggatggacctttcaccgaaatgtgccaaacgccgcaaggatttctttggccatggcgtagaggaggactgtgtgatggcgaacaattcttgttccgacagagagcaagaggcagaagctcacactggtgagccatcatggatgcacgagttcactggtgtggctaagcatgcaagcggccctgtcactgctgccaagacgatatatgaggatgaggaagggtacttaatcgtggtgagcatgcttttctccgatccacatagtgtcaaagtatcatggaggaacacgctgacgcacggcatcgtgaagataacatgcgtgagcactgcccggatgccctacattaagaaacacgacaggacgttcaagctgacggaccctttccccgagcactgccctcccggcgagtttgtgagagagatccctctggcgacacggattccagaagacgcgaagatcgaggcgtactatgacgagacaggaactgggctggaaatcatggtccccaagcaccgggttggaccagaggagcatgaagttcaggtgtgcatgaggcccccacatcttggtgacaacgatctcgtgctctcctagaacaggaaaacagctagcttttagatgttctggt

SEQ ID NO: 417 - DNA, 628 bp, Zea mays
gaatccatcacggaagaaattgttccccacccaccctagactcgccgccgtcgcaactcccacccgatccccaaattctccggcggtgatggccagcctgtggcgcgccgtgatggatagcgtcagcggctcctccccctcggcgctggacgcggccccaggtagcggcgtcgagttctggcacggcgcagagcgcgctgggtggctaaataagcagggcgagtacatcaagacgtggaggcggcggtggttcgtgctgaagcaggggaggcttttctggttcaaggaccctgcggtgacacgggcctcggtgccccgcggcgtcatccccgtcgccacctgcctcacagtcaagggcgccgaggacgtgctcaaccgccagttcgccttcgagctctccacgcctgccgagaccatgtatttcattgcggactccgagaaggacaaggaggagtggattaactccatcggtcgctccatcgtccagcactcccgctccgtcaccgacgcagaggtcgttgactacgacagccgcccccagcccccgccgcagcttatgaccagcgaagagagtgcaccagcagcttaatggcgtggtgattcctgtgaactctctcgatatggatag

SEQ ID NO: 418 - DNA, 1082 bp, Zea mays
ctgttcgccaccatttgtccattccccctccatcattcctccccgctttctccaccatcagggcgaaaattttatgcgagctttggaaagcgcgagctagtttatccggccgggcgtggtcaccgaggcagtagcggcgagagaggggaggatctgatcgatgtcgtcgggcgaggacgggtactgcagctcggattcgccgcgggcggaatcccccgaccagccgcaggcagctgcggcggcggacgcggacgcggacgcggagtcgcctcgcgccggagccgggccgaacaagcgcgacctccacgcctcgtcgccggcagctaagcgcagccggagatcggtggagaagcgggttgtgtcggtgccgctggccgagtgcggggaggggccgccgccgtctgactcgtgggcgtggcgcaagtatgggcagaagcccatcaagggctccccctacccacgtgggtactaccgctgcagcagctccaaggggtgccccgcgaggaagcaggtggagcgcagccgcgccgaccctgccgtgctgctcgtcacctacaccttcgaccacaaccacgaggcgccgcggcccaagagcagctgctgccaccagcaaggcaggccgccggcgccgaagcctgatgagcccgtggccgagcaggaggatgagctgggtccggagcatgagccggaagacgagcaggagccggagcagaaggtcgtcccaggtctggccgggccggaaacggcgccggcaaccgcaacgttggcgccggtggcagaggaggacgaaagcttcgacttggggtggttcgaccagtacccgacgtggcaccgttcggcgctgtacgcgccgctgctgccgccggaggagtgggagcgggagctgcagggggaagacgccctgttcgcgggcctcggcgagctgcccgagtgcgccgtcgtgttcggccgccgccgcgagctcagcctggccgctaccgcgccgtgctcctgatggtccttaaagtcttttttacactagtagctctgatcgctgcacggggcatctgttcaaggccgtctgctgcctaagctttctgtcc

SEQ ID NO: 419 - DNA, 1006 bp, Zea mays
ctcttcccaagctccatccccttgctctcaccactgaaatgagcggcggcggcggccttgggtccggctgctcgtaccagaagttcgtccacttcgcgctggagcagacccgccaccgctccactctcgtcccccacccgtcccaggaaaagttcaggttcataaaagcaaatgaggataacaccgttctcaatgccttgtcattcagcacttccaaaattagactgcttcggagcttgacaattgagcaaaaaaactcggttcaggttcttgattttgctgccttctcaagacctgaatacgaccttcctatattttgtgccaatgccttctcatcccctgcacggagtattgttgtcttggacctcaaccctttgtatgataccactgaacacaaggattacagggaaaaatactacagggctttgatgccccttgtacacaagtacagtgagcttctgccctggggtggcaagattacaagtgagtcgctgagattcttctctcccattgttatctggacggtattcgagccaagcgaagccaaccaccaagctctatactcggccttcgtggattactatatggtctggcttgagttcatggacggagcagttcgcgaaagtagcaaagaaaaaatcgaccgcaatagagaagcgcaacataaatatctcacatggagagcagagaaggatcctgggtacccgctgctaaagaagttgatcggtgagagtggtgccaaggacctggtgagggagttcctcttcgaaggagttggctcgctcggaaccaagtcgtttctggagtatttcgccgagtacgcgcaagaggacgggacggtgaacaagaagcggagcatggcggggaagtcctttggaacccgaccttgggacgcccacggactgttcgtcggcgacgctgtggatggatagcggccaagcgggggctgttttgcttctacataagcagtttcatctcaatccccgttgtttattcacggaggact

SEQ ID NO: 420 - DNA, 760 bp, Zea mays
aaaggatccgcgagatggacgacgactgggagctcctcctcgcgtcccccaaggcggcctcggcggccgagccgtacgctggaggcggggaggacgacgccggcgccatcaagcacgactacttcgacctcggctccgacgccaagtacccgcggagggcgtcgctgtcgacgggggacgaggaggagggcgtggaggaggggcttctcagggcgtcggacagcgcgagctgggtggagccggaccctgacgaccttctcttccccggccgcgaccgcgcggcgctgtggtcggactcgtcctccgacggggagaggcccgaggtagaggccaccgatcccgtggagcgggccagggaggaggctggggtcacggcggccgcggctgatggggtggagggggccgtggcgaagggaggagaacacgtccggtggtggaagctgccgctcgacgcgctgcgtgtttgggcgatgcgcgcggcgaggagcgcctggtcggtgccgttcgccgtcgcgctgctcggattcgccgtgctcgggcgccggctgtacaggatgcgccgccagagcaaggccgccgcgcgcgtccgcctcgtattcgacgaaatgaaggcctcccaattcaagggccaatcgtcacgtctgaatgaatccacgacgatggtgcgccgaactcctttcataaaacctatgcttcctgccaatggagtgactccatggcctgtgctggggcacctgtgagatgtgtgatcggtaccaaa

SEQ ID NO: 421 - DNA, 1260 bp, Zea mays
aaactcgagctccactcttcttctgcggtcggatcccccggcgggtcggactgcggagcacgggctccggcgagccgctgacgagggcctgtgcggcgaccgagctcgtggcgggagaagatggacgaagcgagcacctccgcgtccggcgccgcgacgaggcgcggcttcgtgcctgcgagatcgggagttttctataggttcacccagcagaacctcccagcttggaagccagcaatgacacctggatgtataatagcaatgttcttgattatcggaataattttcatacctttcgggcttctttgtctccaaacttcaaatcatattgcagaaatcatctaccgctatgatgttgactgtgtgcctgatgcttacagaggaaataggcaagcttatattaaggacagctcgatttctaagaactgtactctggaagcgaaggttctggaatacatgagagcaccaatttatgtttattatgaacttgagaatttctatcagaatcaccgcaggtatgtcaaaagtagaagcgataaacagctgcgttttggggcaaaatacacggccgactcgtgcagtcctgttgagtgggataataatggttccccaattgttccctgcggcttgattgcctggagcttattcaatgatacatatggttttactcgtgggtccaaggaaataaaggtcaacaggaaaaacatttcatggaagagcgaccgggagcataagtttggcaaacatgtgtttccttccaactttcagaacggaaccttgattggaggggggaaactcgaccctactgtcccgctgagtgaacaggaagaccttattgtgtggatgaggacatccgctctccccaaatttcgaaagctctatggtgtgattgaagacgacctgcatgccgatgagaccatatctgttttagtaggaaacaattacaacacctacacttttggtggaaagaagagcatagtactgtcgactgcgtcctggctaggcggcaagaacgacttccttggacacgcttatattgtcactggttcgttgagcatcatcatatcgattctctttgctctgatccatgtgaagtacccaaggccgcaaggtgaccccaattgcctatcctggaacaggaaaaacagcaatagctaaggggcccgcctgtatctaccacacgaatcagtattacacatctgtatctgaaacatgtcagacactgtgccgcaaggttaatcccagatgatggaattcttt

SEQ ID NO: 422 - DNA, 672 bp, Zea mays
gaggatggaggtgggcaggactccgcggcgacgggcgtccccagcggcagcgcctgtgccttcgctgcttctgttcgccgtgctattcgtgggccgggcggcggcagcgttgggcggcccggcgccggcgctatacaagcacgcgtcgttcttcgaccgcgacggcgacggcgtcgtctccttcgcggagacgtacggcgcgtttcgggcgctcgggtttggactcggcctgtccagcgccagcgccgccttcatcaatggcgcccttggcagcaagtgcagacctcaaaacgcgacgtcgtcgaagctggacatctacatagaggacatccggagagggaagcacgggagcgactccggctcgtacgacgcccaaggaaggttcgttcccgagaagttcgaggagatattcgccaggcacgcgaggacagtccccgacgccctgacctcggacgagatcgaccagctgctccaagcgaacagagagcccggggactacagcggctgggctggcgcggaagcggagtggaagatcctgtacagtctcggcaaggacggggacggcctcctccgcaaggacgtcgcgaggagcgtctacgacgggacactgttccaccggctcgcgcccagatggaaatctcccgacagggagagaagctgataagcgtggtc

SEQ ID NO: 423 - DNA, 361 bp, Zea mays
cccttcacttttattcacagtttgcaagctagctagctaggacgagctgccagcggcgccagccatggcgatccgtggcgtggcctccacccgcgaggaggacatgacgctggaggagttcaaggagtggctgaagcagttcgacgccgacggcgacggcaggatcagccggaacgagctccgggaggcgctccgccgccgcggccgcggccgcggctggctcaccgcctggaggagcgaccgcgcccttcgccacgcggacaaggacagcagcggcttcctggacgactccgagattgagaacctcgtcgccttcgcccagaaggatctcggcatgaagatatccacctggtagaagtag

SEQ ID NO: 424 - DNA, 2300 bp, Zea mays
cagctgagcaagacaaggaaggggaatctctccctcattcgccttgccgtcttgatctgtcggctcccggcggcaacaccctacaggtttcatctatggggcaagatgctggcttcaaacgcgaggatcattctggattgggatcaggtcctcaaactttgaaggtctcctgctgcactagtgaagaaaacgagagtcgaaacagaagataccatcagttgaaatgctcagagagcaactcggggcagttgcacctggactacgtcccaaatttccactgcaggagcttgccaacgagaagccgcaagacgaatgctgagcaaagcaccgtggggaagcgtggttctatgtaccagagctccagcgaaataagcaggatcagaaagatccaggagggcaggaggaaaatagattctgcattcgatggggacgcgttcctgtcctttgatattgtcgatgcatcctctcgccctagcacaagtggagcttatctgcattcccatcagaatcggaggtcgggcgctaagccttctgtggacaccgctaagcgagcgtcaaaggacttcctggaccttcagttccgtgaacatcctgatgagaattttaagctagatcgaccacgcttggatagtaccttgttgaaaaacgatgatggtttcttggagatttctctcgagaaagagatagcaaagggtggcccgtgcagaaatgcagctcctatcttgctaaacactgggtcaggcaaatgcactgacctgcaaaagatgaatggatgccccagtgagaacaactgtggtgacaaggggagagattcagcaagcagttccaaatcaacgcctgtgaaagtaagctcctttgacggaacctgccaatctgacggtgctcaacaccatatcacagagaacaacactaaagctcgatcaagccccttcaagaagatgctggaccctattatgaagtccaaatctcctaggagcccatctatcatggaaagaggaggctccaactccgcagctgggccaggaagcaggaaaaactccgtgtctcgaaaatcactgctgggtgatttttcaagaagtgaacaagcatctaattgccagcccaatgggcaaacacagcagcgtgtaaacaaatctgctttgtcacctgctcatctccaagcggttcttagattggattccaagaacggtgtccaggtttttgaattctgtgttgacggcccaggagaatccatttccgccaggaattggaaaaacggtgatgagttgagctctatatacaccttccatagtggcgggaaacggtccagtgctgctggaaggatctccaaagatggaggctgggatttacccccaatcgttgggcaggtgcaggtttcatcatacttatgctctgaagttggaaaagacggtacggtgaataactctgtcgtcaccgagtttgtttcgtacgacattggtcatgcgaggcggattgttgaggagaagacaggggcacttcaacagccacagaggactagtctgacggaagagaacaagactgggagaaataactcagatgtatcgacatcttgcccgtggtccgaagaagaccttcatccttatttggagattgcggcgactgtgatagaggttccgtttagcagatacaagtccgaagaggtgaagaatggttcatctccttgtactgtcaaagttgttgcacctagtggactgcatggttcgccgagtgacgatgaagccggcggcccatctcccttgctagacagatggaggtatggtgggggttgcgactgtggcggatgggacatggcttgccccatcgacgttattggcaacacatatgataatagctgggctgagtctatagctaccaatgtgaaacatcccatggagctctttgttcagggtagcaaagaagagctccccgtcctttctatgaaggagaacgggagagggcagtttgtggtggatttccatgggcgactatcagcgttacaggcgttttcagtatgcatctctctgctgcactgttctgaagcttcgatcgccatcagcctcaagaaggggaagcagaagctgtattccagctcgctcaagttgctcctcgaggaggacgtgaggcacctgatcgaggcagtcacagctgaagagaagaagaagaagaagcggagtagagaaaaggcgcctcctccgtctgttctgcttgacccgcctttttctcccatcggaagagtgtagtgtagccaccaggcagggcgcggccggagcttgaagaacccattgcattgtttatgatag

SEQ ID NO: 425 - DNA, 1508 bp, Zea mays
ccctttcatcctcggcagtcggcactcccgagtcccccacaccgccgtgttcccctctcttgtcagttgtcccttcccccacttccctttccttcccgaagagacgggcgcagacggcagagccaccatggccatggaggacgccgcctcggagagcagcgactgggaggtgctctctgccacctccgcctgcgggggcggcgacgacgatgaggtattaatcgtctctggcgggggcggcgacgtcgtcctcgaccacttcgctctcacccccgacaccgcagccgcctggcctggcgacggcgagggctcgtggtcggacgaccggggcgcctggcaaggattagaattattggatgggttcgatccgattccggaagcaagtttcaatcttgcagctggtgtttggaaccagccgctgctgataagcggcgtggatgacgcccgcgaaggggcgcgcagtgcgacccgcagcgcagatggaaatcaagaggaggtggtagccgctgagattcagcaggagagtaattctgtgtttagccgcggtgaattgcgcccggtgctgcagccggcgtatcatggcgtgggagaaactctggattctgatgcagctacacgtacaggtgcctcgctccagggtgaggtatcggagagttcccttgtgcgattggatggaggaattggtactggtgtagaaagatcgtgccttgaagatgctgtgtcaagtgatgagatccatggtgaacaagaagagcaggaacaagggagcaaggttaatgctgccactggttgcgatgaaccagatggagaggtcaaggatggtgctctgcctctggctcacacggcaggtactgaagagggggagaagcaatttgttgtctggtggaagctgccgttcaagctgctgcactactgtgcttggaaggtgaagccggtatggtccttctccatcgccgcagcacttcttggcctggtcgtgctggggaggaggatgtacagaatgaagcgcaaggcaaggggcttgccccagattaagattgcgtttgatgataagagggcctcccaatttgctgatcgcgcggcatatctcaaggaagccttcctggtagctagacgtgtacctatgctgagaacatcatctggtgctacgcttccatggtcaatggttcaggagagatgagtgaagctgctcaaagctccattctggatggtgtacatcagtacgagcatctgatttggctttgtctataaccttttgttttagatgacgcgtcaaggaggattccaatgttgatgtcagtggtctctctttctcgatcttctccatttttactttaccttatctttcttttttaaggaaccacttcttgtgctcctgatttccttttttttctttgcccttactctgtttagtccgtggttagtagtggtgtcctaaatttatcgttcgtacagacgtgctcttttctttatcttgttaatttagatgctagttgttgacgctgaag

SEQ ID NO: 426 - DNA, 748 bp, Zea mays
aaagtcgacagacttccagctaacagtgaccacggcgacgatcgccggctcgccgccatgaagcacctccacctctcatcttctcttcctctcctcctccaccgcccctccaagccccatctcctccaccatagccgccgccgcgcctccatccgcaacgccgcatccggcggcggctccggcgaacccacccccgccgcggaaacggcctcaggtacctctccgccagccgctgccaagcccgccggcgtcaaggaccgcctcaaggcgaggaaccaggcccgccgggtccggctggactccccgccgccggaggtggtggtggtgccgaagaagaagcccgcccccgccgcgtcgtcgtctcctgcgccgaagaagaaggtcgggcggaaggggtgggaggagatgagcctgggcgagaaggccgtggacctctacgtcggcgagaagggcctgctcttctggctcaacaagttcgcctacgcctccatcttcatcatggtcggcgcctgggtcctgttccgcttcgtcggcccctcgctcggcctctaccagctcgacgccccgccgctgccgcccaccgccgtgttcagcggcggctcgccgtgatggcgtcgagtcgttcccgagtgggcgtacactaggtcgaggcgtagagctagcgtagccgcggattaataatggtgacatgatatggaaagattgaggaagatgatgctgattctggagccaaagtttgggatccttt

SEQ ID NO: 427 - DNA, 2718 bp, Zea mays
gcacacgcacaagcacacggaccccccctcccccctacccgctgcctccgccgcggctcgccggagatggatggctccggcagctgggacgctatagactggaaccaaatcgaggatccgaggccgcggaggtcgggccaggccgtcaaggagagcatggacgacttcttgctcgaggacgaggaggtgctcgcgcagggccatggagttgttctactaaacaaccgtgatgctggtacactttcagttacaaatttccgtcttctctttgtgagccaagcaaaaaaatgtgtcatagaactgggtaccattccactgacgacaattgagaagctaaatgacgatgtgaaactccaacccttgccccacctctctgataagaaccacccccgtgaacttcttcaagtaattggcaaagacatgagaatcattgtgtttgcttttatccccagaacacagcagaaaaatgaagtgtttgatgctttgaggagatacactaaacctgctaatttgtgggatctatatgcattttcttgtgatccatccaccattaagcatgattctgagccaaagtggcgtctcttgagggaatactttcgtctttttaggagaagtttaccgctacagggagtcgaggaagtttctttgtgtaatgaatggtggaggctaactagagttaattctagttattcattgtgttcaacttacccctctgaactcattgtaccaagaagcataagtgatgaagatttatttcaagcctccccatttcgatcaggcaagcgcttgcctgttatttcatggtgtgaccctgggtctggagctgttctggcaaggtcatctcagccgatggtggggttgatgatgaactttagaaacaatgcggatgagaagcttgtctgtgctctcagcagcagaaccatcgatgagaaaggatctccaaggaaattgtacataattgatgcccggccaagagcaaatgctatagcaaatggggcaaagggagggggctcagaatcatcttctaactaccataaatctgaggttctgtttttaggaatacaaaacatccacaccatgagagagagtctttctcgccttagggactatgtggatgctcatggctcaatttcatcaaatgggagcccttcagctgtatctgttgttggagatcggaggaaccgtggatcaacctggggtggaggcaatctaaatagcatgacatcattttcttcaacactgggggaatggctaaaccatatccagaatattctggttggtgcttcatggattgctgcacaaatttcagaagaagcagcgtcagttcttgtacattgcagtgatggatgggaccgcacaacccagttggtttcacttgcttgtttattgcttgatccctattatcgaactttcagtggattccaggctcttgttgaaaaggattggttagcatttggtcatccatttgcagagagaatgggagttccaacagtagctgagaatggggggtcacagtatgagctactaaggcaaccttcgctcggaaatttaagcagttccccgagtaggaacactttagggccgccagggccatcctctaattctccagtgcaatcccagacatcaaacaacacttcaccaatattgttacagtggcttgattgtatctcacagttgttacgtctgtacccatctgcatttcagttttcatctaaattcctagttgattttatggattgtgtgctatcgtgtcgctttgggaacttcttgtgcaatagtgaacgagaaagggagcaatctggtgtcacaatctcctgtcgttgcatgtggtcacatttggctaatctgagagcttctggcggcagcttccatgagcactataatccattctatgacccagtaaatcataatggtgcactattgccccctgctgcagcacttgccccaacactctggccccagttttttttgaggtggacatgccccattgagtcacaaggtggtgatcttgaatcccagtggcatgctatgaataaaaaatatgcagatacaatgaaggcaaaggatattgctgagtggagggcaaaggatatcaaattgaaattggaatctatgaaacaagacctgcagagggagaaacgtattaatagtacagctctagccgcagcccgaagtgctcaaagggagaatgctgcaattaagaaggcaatagaatctatagggtgcacaattaaattttcgacaagcgaaaacgaggacagaactgaagtgctgtcatgttcattaggaagaggcacagatggtagagctcagcaagatgaaaacggtgacttctctgtagcaattgaggacagcctggtctcggatgcaccggcggaccatttttgcgaatcactctgccccttccgcacaagagaagggtgcagatggccagatgctccgtgtgcacagcttggaagtcagtttgttggtttgaaggcaaattttgatgcttttgaccggctgtcaatacatgactgctattttggaccggagtagttgatcatgaaccagccgtgtcagtaaacgcttggcagttgccaatggattttttcagtagttggcacctccaggtcggcatcaataacaaaagaatgctgcgaaacaactcaatgatccatatttgacgagtatttacaaattccttgattcaatagtttttcactgtctgggtcctcc

SEQ ID NO: 428 - DNA, 1164 bp, Zea mays
aaagtcgacagaagggtgggagtacggcaaaaggcctgcctctctgcgactgatctccggcggcgaggcgccgcaccggggtatgggccaggatgtggtcgcgcacgtctacgacgtcgccaccgctggctccgacaccaccgtgctccacatcaaccgcttctttaaggacgccatcggcctcggcggcatcttccacaccgccatccaggtctacggtgatgaagaatggtcctttggctactgtgaacgtggcactggggtttttagctgtcccccatgcaaaaatcccatgtacacttatcgcgagtccatagtgctggggaagaccaactgctgtatcctcaaggtaaatcagatactaagggagctgagctgggagtggcctggacattcatatgaactcctgtcaagaaactgcaatcacttctgcaataccttctgcgaaaagcttgaagtaccgaagcttccaggttgggtcaatcgctttgcaaatgcgggtgacgctgctctagaggtcgctgaaaccacagcaggaaagctgaaacaagcgaaaaaggaaatcgtgaccgcatgcaaagcagcctcaacatttttgaccggcacatcgtcaagcgcctcttcaaatgcggaggatacgggtggctcaacctcgacaggaaattccctcttcgagggggcatggatccgaagtatcatcggtatgacaatgaagccgtcgaagagcctagtctgtgtagatagttcagatagcgacagctccgggagcgaatcagaatcagatggcgatcggcccaacagcgatgacaacgctgagcgacaagctaaaggcgtgaagcaggagcgaggcacgaaaaaaaagaataacggaccacattgccattcatgaagctcactcacaccaatactgcagagagaggaaagacctctacatgctgccgttttctgataaacagattacacagggagcagacctacagcaggaactaactttacaattatgttcatttctggttgagagctgggagcggcgaaagggccctgaggagtgcggaggcgatggagcgcaccacaatgcgtgcaatcttgagcttgatttgcccgcgccgtgggagcgggcgagatctcctttgcctttcagccctgtaaactctggaattcttt

SEQ ID NO: 429 - DNA, 2227 bp, Zea mays
cctaagccaaacccaaattcccccatcccacgacgccgccgctgccaccaccaccaccatgggaagaaaggacacctcttcctcctccgcggccgccggcggcgggaaaaaggagaaacctatgtcggtgtcagccatgctcgcctccatggacgcccccgcggcgaagcccaagtcctccaagtcggcggcgccgtccaaggccaaggcgaagccctccaaggcgccggcgtcctcgtacatgggcgacatcgacctgcccccctccgacgacgaggaccaagaggaggcccagctcgccgccgccaagcccaagccggcccgcgccgccgtcgacctcagcgccggcgctgcgccgtcgcacaaggacgccaagaagaaggacaagcgcgaggccgtggcggccgcagccgccgaggccgccaggcaggaggcgctgcgcgacgaccgcgacgccttctccgtcgtcatcggcgcgcgcgtcccgggctcctccgccgccgacggcaccgtcgacgacaacgtcagggacgtcgtgctcgagaacttctccgtctccgcgcgcgggaaggagctgctcaagagcgcctccctccggatctcgcacggccgcaggtacggcctcgtcggccccaacggcatgggcaagtccaccctgctcaagctcctggcctggcgccaggtccccgtgccgcggaacatcgatgtcctgctcgtcgagcaggagatcatcggcgatgaccgctcggccctcgaggccgtggtcgccgccgacgaggagctcaccgccctccaggccgagcaggcgaggcttgaggcctctaatgatgctgatgacaacgagcggcttgtggaggtgtatgagaagctgaatctcgtgggctctgacgtcgcccgtgcccgagcgtccaagattcttgcggggctggggtttgatcaggcgatgcaggccagatccacaaagtccttcagtggtggctggaggatgcgtatttcgcttgcccgtgcgctcttcatgcagccaactctgctgctgctcgatgagccgactaatcacctggatctgcgcgctgtgctatggctggaggaatacttgtgctcccagtggaagaagacattgattgttgtttcccatgaccgtgacttcctgaatacagtgtgcaatgagatcatacacttgcatgataaaagtcttcatgtgtaccgtggaaattttaatgattttgagagtgggtatgagcagaaaaggaaggagatgaaccgaaagttcgaggtgtatgagaagcagatgaaagcggccaggaagtctgggagcaaggccgcacaggataaggttaagggccaggcgctatcaaaggctgctaaagaggccgccaagaacaaggggaaagggaagagtgctgcagatgacgatgatgaccagaaacaggtagctgtgccgcggaagtggcgtgactacagtgttgagttccatttcccagagcctacagagctcacaccacctctccttcagctcattgaggtagggtttagctaccctggtaggccagacttcaaactctcaggtgttgatgttggcattgatatgggaacacgtgtagctattgttgggcccaatggagctgggaagtctacgctgcttaatttacttgcgggtgatcttatcccaacagaaggggaggcaaggaggagccagaagctgaggattggacgatactcgcagcattttgttgacttgctgacaatggaggaaaatgcagttcaatatttgttgaggctccacccagatcaggagggaatgagcaaagcagaggctgtccgtgctaagctcgggaagtttgggttacctggacacaaccatctcactccaattgtcaaattatctggcgggcagaaggcccgagttgtgttcacttctatatcaatgtctcaacctcacatactcctgcttgacgagccaacgaatcacttggacatgcaaagtatcgatgcattggcagacgcgctggatgaattcactggaggtgtcgtcttggttagccatgactcacgattgatatctcgtgtttgtgaggatgagcaaaggagcgagatatgggttgtggaggatgggactgtgaacagatatgatggcacatttgaggattacaaggatgaactcatggaagaaataaagaaggaagttgaagaataatgctgctccaagttagttgtgctttgctgttag

SEQ ID NO: 430 - DNA, 688 bp, Zea mays
aaagtcgacttaggaagaggaggccgacgccgtactgctagcacaagccaagaaatgggcgcgctctgcctgctctacccatccacgccgccgcgctgcccatgcggcgcccgcgcggacgcgaccgcggccttcgcgccttcccctttcctctcatcatgtgctgccaccggtgcacaaacaaggctgcagctctgcggcaggagccagaggcgcggcggcgtggcgcgggtaggtggcggcggcggtgggggcaagggggagagtggcaagaacggcgcggcggcgttctttgatgaggacggggtggtggacgacatggacgggtacctcaactacctgtccctcgagtacgactctgtctgggacaccaagcctgcctggtgtcagccttggacaatattgcttacgggaactggtgccgttgcctgtagttgggtgcttatccaatctgttgtaattactgctggggtttcttttgtaatatccgcatggtggtacatatttctctactcgtaccctaaggcatacaccgagatgatagcagagagaagaagaaatgtagccagtggagctgaagatacctacgggatggagaaaatccagtgaggatctacggcggcgctgcttgtagagtgcataactctcttgtgttgtgtctagcatttccttgctgaggggatccttt

SEQ ID NO: 431 - DNA, 888 bp, Zea mays
ctgcaagctgcttatcttctcccgtcccataggttgctaggctcggccgtgtagagcagcaagagcacgccgcgccaagcaacaaagagggaccccgcttccatggaggtggtgggcggcgtgtcgctgaggccgtcgccagcgccggcgcgtatccggactaccctgccacccgtcgacgtaggcggacgcttccttctccgccgggtcgcggggcgccagccggcgaggcgcgcgctggtcgtggaggcccggggcggcaggggctggtcggagcggcagatgcagcagcagcgccgcgcgccgctgctgccgaaaatcgaggacgacggcaacccgcgattcgtcatcttcatccgcaccgccaatgtctacttctggtacccgctcaacatcatcacgggcggtacgacggcgaagatcatgctcgccgccaaggacaacttcctcggcaggtacatctacaaggacacgctcgccaggaacctcgccgccgtcatttacaaagacgaggatgagatcatagacacagcgaaagagcagtaccgtgtgctcaagaccgaaaatgagtttcggtatggctacaaagttgtggagaaagggaacataaggtctgctctgacgacaagcaatgtgatcgaacttccaaagaaggacgagctcaaaaccgtggttgacaaggtgaaggacttctttggcgacgtgactgccggcgccaaagaatcctttgcgcagataacagggtctgctgtcagcaaggaggaagaggaagcagagagcaaagagaagttccgctccaagagacgaaagaagcagcggaagtcgaaggagggcctcaagacggagaaatgattcagtcagtcacacaagtaaagcaccggctgtagt

SEQ ID NO: 432 - DNA, 1204 bp, Zea mays
aaacccatttccctcgctcccatcccgtcccgccccttgtctcttccgcttccgcccgaccccgcgcgccgcggaccagcagccatgtcgtgctcccacctctccaccgcctggtcctcctcggcgctcgccagcagcgcctccaccacccgtcggcgctcccccccgcgctcgggtctcctggtgcggtgttccctccgtgagctccgcacccgcatcgactccgtcaggaacacgcagaaaatcacggaggccatgaagctggtggccgccgccaaggtccggcgcgcgcaggaggccgtcgtctcctctcgccctttctcggaggcgctggtggaggtgctctacaacatgaaccaggagatccagacggaggacatcgacctgcccctcacccgcacccgccccgtcaagaaggtggccctcgtggtcctgaccggcgagcgcggcctctgcgggagcttcaacaacaacgtgctcaagaaggcggaaacccgcatcgatgagctcaagcagctgggcctccagtacaccgtcgtcagcgtggggaagaagggcaacgcctacttccagcgccgcccctacatcccgttggagcgcgatctggaggtgagcagcgtgcccaccgtcaaggactcgcaggccatctgcgacctcgtctactcgctcttcgtctccgaggaggtggacaaggtggagctgctctactccaagttcgtgtcgctggtgcgctccgaccccatcatccagacgctgctccccatgtcgcccaagggcgagatctgcgacgtcaacggcgtctgcgtggacgccacggaggacgagctcttccgcctcaccaccaaggaggggaagctcaccgtggagcgcgagaaggtgaagatcgagacgcagcccttctcccccgtggtgcagttcgagcaggaccccgtgcagatcctggacgcgctgctcccgctctacctcaacagccagatcctccgtgccctgcaggagtcgctcgccagcgagctcgccgcccggatgagcgccatgagcagcgccaccgacaacgccatcgagctccgcaagaacctctccatcgcctacaaccgacagcgccaggccaagatcaccggggagatcctcgagatcgtcgccggtgccgacgccctcgctggctgagcctgagtccccttggtggtgcggtgctcctgctatatat

SEQ ID NO: 433 - DNA, 439 bp, Zea mays
aaaggatccaaggcaccacacctcttcttcctcttcctcctcctagcacagctagcgcctgctccccttcgtctgtgatcatgtcttgcagcagcggcaagtgcaactgcggctccagctgctcctgcggcagctcatgcaactgcatgtcccctgacgtggagaccgccgccgccagcagcatcaagaccatggtcctcgctgcgccgaccaccaaggccagcgccggcggcttcgaggcggccaccgagggcggcggctgcgactgcaacacctgcaactgcggcaccagctgcggctgctcctgctgcagctgcaactgagccggcccgcccggcccggcgatggcgcacgagagtcgagaggacgacgacgacgaggcgtataaatataatagcagcgtctaaataagatcctgtcaactgcacccggtaccaaa

SEQ ID NO: 434 - DNA, 755 bp, Oryza sativa
ggcggatggcggcggcggcggtggcggcaccacccgtgagggggtactgccccgcggcggcgtcgacgtcgtcggtggcgagggtgcggatgccggcgtcgttcgtgagcgcgccgcggcgggtttcggtgcggctccgcgcggcggcggtggcggaggtgccccgagggctgcagctccggcgggaggaggagcgggggttggggttcttcggaggcgtgtttggtggggaggaggaggaggtggtggagaaggttggggaggagagggtggaggggtggatgagggagtcgatcgcagagatcgtgcggcacatcggggaggcgccgttcctggtgcacctgttcaacgacgacgacggcggcagcgggcggggaggcgcggggcgcgtgacggtgcggcgggagacggcgtcggcggagagctggcccgacgtgcggcggcggtggggcccgggcgggatgcggcgtcccgacggaatcatactggtcgagcagatcgccgcggcggtcgaggagggcggcgcgtccgccggcgccggcgccgccgaggcggcgcggcaggtgtggggcctggtggtgcaggcccgcgggatggagtgcgcgtcgtgctacgtgctcgacacctgccgcgtccgctccccggcggggctctgcacccacttctgcctcgccagggcgcagtgcttcggcgaccccctcgagctccagctccgcaacgcctggctcaaccgcctctccggccgccggtagtag

SEQ ID NO: 435 - DNA, 1336 bp, Oryza sativa
agacagcagaggcgagatggcggcggttttcctccgcgccgccgctcgtgccacgaggtcctccgcgctcgtccgcgccatcctcgcgagccggagccccctctcgtcgtcctcctgtgccgcctcccctacgaccgcggcgcccgtccccggcaccgcgccgcgcgccgccgcggctggcgatggcgacgagggatgcgcggcggccgcggccacgcccgcggacgtgggaggggacgaggacgacctgagaagccgcgtcttccggctgcgcctggcgaagcggagcgcgaccgcggcgctcgagaggtgggccggggaaggccgcgccgcgtcggcggcggagctccgcggcatcgcccgcgacctcagccgcgcaggccggtacaagcacgcgctcgaggtagcagagtggatgaagacacatcatgagtccgatttatctgagaatgactacggaatgcgcattgacttgattaccagagtttttggtgctaatgcagctgaagatttttttgagaaacttccagcttgtgtgcaatcactggaagcatatacagctctcctacattcttatgctcgatccaagatgacagacaaagctgagaggctgtttaaaagaatgaaggatgccaacctttccatgaatatccttgtttacaatgaaatgatgaccctgtacatttctgttggtgagcttgataaagttccggtcattgctgaagagctgaaaaggcaaaaattttccccagacctcttcacatacaatctccggatcagcgcttctgcggcatcaatggatctggagggcttcaaaggaatccttgatgagatgtcaaaagatccaaactccaatgaagggtggaagctgtaccagaacctcgctgtgatttacgtcgacgctggtcagcttgttggttcaggaaactcgctggtggaagcagaggcgaagatcagccggagggagtggatcacatacgatttcctcgtaatcttacacaccgggctcggcaaccgggatagaatcaaggacatttggaaatccatgctgatgacttcacagaggatgacgagtcggaactacatctgcgtgctctcatcctacctgatgtgcgggcagctgaaggatgccggggaagtcatcgaccagtggcagcggtcgaaagccccagagttcgacatctctgcctgcaataggctgtttgatgccttcctgaacgccggtttcaccgacacggcaaatagcttcagggaactgatgctgcaaaagagctgtatactgacaagcaggcaagaacgctcttcctgagtggccatccatgctgaaactgtttag

SEQ ID NO: 436 - DNA, 1986 bp, Oryza sativa
agggttactaggaggttgctggagcggccgatgagaggggccagcggcggcggcgagggattcgtcggcgcctcttccgtttcaaacaatattagcctaccaaatgagggtactagccctagaggaacagataatgctgaatgttctgagacatcttcagacaggtcgaattcggaaagcataaaacctgaagaatgtgcaatgccatcttcaatatttgataagaagatttccataaaaaagaagctcagattgttaagtcgaatggctatactgaaagatgatggaactgtagaagttgatatccccactaatgctgaggctgcatctcttgacctttcttcaaatgattactgtaatgaagcctttagtggggaaccattggcatcttcagatttccagcacagacctcctatgcaaattgttatgctcattgttggtactagaggagatgtgcagccttttatagctataggaaaacgattgcagatctatggccatcgtgttagactggcaacccatgccaacttcaaggattttgttgtgacggctggcctggagttttatcccctaggcggagacccaaaacttcttgcaggatacatggtgaagaataaagggttcttgcctgcaactccatcagaaatccctatccagcggaaggagattaaagagattatattctccttgcttcctgcttgcaaagatcccgatactgatactggtgctcctttcaatgtaaatgctataatagctaatcctgcagcgtacgggcatgtgcatgtggctgaggctctgaaggtaccaatccacataattttcacaatgccatggacgcctacttgtgaattccctcatcccttctcccgtgtaaaacaacctgcaggatatagactatcataccagattgttgactcctttgtttggcttggtattcgggatattataaatgatcttcggaaaaggaagttgaagttaagaccagttacgtacctaagtagcgcacatgcttattcaaatgatattcctcatgcatatatctggagtccttaccttgtacccaaaccaaaggactggggacccaaaattgacgttgttgggttttgcttcctcgatcttgcttcaaattataaacctcctgaaccccttctcaaatggcttgagagtggtgaaaagcctatttacataggttttggcagccttccaattccagaaccagataagttgacaagaatcatagtggaagcacttgaaattactggacagagaggtatcattaacaagggttggggtggccttggaaatttagaggaacctaaggaatttgtatatgtaatagataacattccacatgactggctttttttgcagtgcaaggctgtggtacaccatggtggtgctgggacaacagctgccagtcttaaggctgcgtgccccactaccatcgtaccattctttggagatcaattcttttggggcaacatggtgcatgctagaggattgggagccccacctgtccctgtggagcaattacaattgcatctactggttgatgcaattaaatttatgatggatccaaaggtgaaggagagagctgttgagctagcaaaagcaattgaatcggaagatggcgttgacggggcagtgaaagcatttttgaaacatctcccacagcccaggagccttgagaagccgcagcctgcaccgccatcgtcaaccttcatgcagccctttctcctccccgtaaagagatgttttggcatcgccacatagtccgttgctctcaagcaatcgtgttaatattttggcaacacaaccaacaaccatgttaaaagagaaatgctctcctatagtttttgttcgtcacagtatagaatgagcggtctcctgcagttttcttcaaacgtggagagattgttcttaccttaatttaacacctgttcagctgttatagcttgattcatgattggtttgtatagcagcggt

SEQ ID NO: 437 - DNA, 1337 bp, Oryza sativa
cactcccactcgcataagtacccacccaccaccaccaccaccacgcaagaaccgcaaaggagaagagaaggcggtttccggtgaaaattttggcctctttttcggaagttttttttttttcttcccctctcgttctctttttattccaccgctttgtcgttctcgcaatctcgctgtccaccttccccacccccccccatttactcgatcatcacaacgtgccaatcaattaatcgatcgatcagttttgtgcgtacgtgagcgtgtggagagggagagaaatggacatggaaatcgtggtttttctgaggtaatgtgctggaggaggaagaagaagaagaagaagaagcagctattgttgctgctgctgctttctgggattccgaggaggcgatatgcttcgcaacagatcgaggagatcagtcggtgccaagcaaggaggcgtcaccgccatggcgcagcctgagccgccgccgccgtcatcgcaatcttcgtcgtcgtcttcctcctcttctcccgtgttcccttccccgaggccgttcatggcgctcccgcacccgccgcaggctgggttcttggacggcgccgccgaggggccctcgtcgtcgatgagccccacctccattcttgagaccaagcagttctgctgctcgtccgccatgccgccgttcctgtcggagaggagcctcaggaaggcccacgtggagatggccgccgcaccgccggagccggccggcgtcggcctcgccgacgtgctccgggagcaccacgggggcggcaaggccggcggcggcaaggtggtgttcgggtcgcagctcagaatccaggtgcccacggggagggccgtcgagctggtgtcctccccgatcgagttcggcgtcaagaaccgggacgcccacttggcggcgatgtcgccggcgaggaggttcctgccggaggtggtcagctcgccgtccgcgcgggtgttcgccgccgccgtggtgtcgcccggggagatggccatgtcggaggactacacctgcgtcatctcccgcggccccaacccgaggaccacccacatcttcgacgactgcatcgtcgagagctgcggcgatgtgctcgtggagaaggtggccggcggcggcggcgacggcgacggcgacgcggtgcgaaccaatgggttcctgaactcttgctacgcatgcaacaagcagcttggacatggcaatgacatcttcatctaccgaggtgataaagcattctgcagcagtgagtgccggtaccaggagatgcttttcgacgaggcggtggacaatttgcgctaggctgttgaacgaaatggtcgttccacatgagta

SEQ ID NO: 438 - DNA, 1533 bp, Oryza sativa
gagggagaggtcactcattcacaacctcatacagaaggaagaagaagaagatggtgttggtggcgattggggtggttgtggcggcggcggtggtggtgagcagcctgctgctgcggtggaacgaggtgcggtacagccggaagcgcggcctgccgccggggacaatggggtggccgctcttcggcgagaccaccgagttcctcaagcagggacccagtttcatgaaggcccggaggctcaggtacgggagcgtgttcaggacgcacatcctggggtgcccgacggtggtgtgtatggaggcggagctgaaccggcgggcgctggccagcgaagggcgcgggttcgtcccgggctacccgcagtcgatgctggacatcctggggcggaacaacatcgccgccgtgcagggccccctccaccgcgccatgcgcggcgccatgctctccctcgtccgccccgccatgatccgctcctccctcctccccaagatcgacgccttcatgcgctcccacctcgccgcctggtcctcctcctcctcctccgccgtcgtcgacatccaggccaagaccaaggagatggccttgctatctgcactcaggcagattgccggcgtctccgctggcccactctctgacgctctcaaggcagagctctacacccttgtgcttggcaccatctccctgcccatcaaccttcctggaaccaactactaccaaggcttcaaggcaaggaagaagcttgttgcaatgctagagcagatgatcgcggaacggcgatcctccggtcaggtacacgacgacatgctggatgcgctcttgaccggtgtcgagggcaccagggagaagctcacagatgagcagatcattgacctgatcatcacccttatatactctggatatgaaaccatgtcgacgacctcgatgatggctgtcaagtacctgtcagaccatcccaaagctcttgagcaactcaggaaagaacattttgatatcaggaaaggtaaagcgcccgaagatgccatcgactggaatgatttcaagtccatgaccttcactcgagctgttatcttcgagacattaagattagctacagttgtgaatgggctgctgaggaaaactacccaagatgttgaaatgaatgggtatgttatcccaaaaggttggagaatatatgtttacacaagggaaataaattatgatccattcctgtaccctgatcccatgacattcaatccatggaggtggctggagaagaacatggaatcacatccacacttcatgctgtttggaggaggtagtcgaatgtgcccggggaaggaagtaggcaccgtagaaattgcaacattccttcactatttcgtgactcaatacagatgggaggaagaaggtaacaacacaatattgaagttcccccgagttgaagctcccaacgggttacatatccgcgttcaagattactgatcctggaacattttgcgaagttagataggaattcaaatcagatagaaaataagagtgcaattctgatgctgct

SEQ ID NO: 439 - DNA, 905 bp, Oryza sativa
agctaaccctgtccacgtctgctcgtcgccatggcctctcgttccttccccagcacttcagccacacacacctgcgactgcgagctccccgtctctcgccaatggcggcgttgtcgtctgcctccttgctccctcctccttccaccttcgtccccgtcctctcgccactccgcaagccgccgccccagcacctcgccatccgcggctccccccaccgccgtcgcggccgccgcctctcgctcgccgcttcctccgccgcctcaccggacttagagaaggagccctcgcaatcgccctcgccctcgccgcaggagaaatcccctggtgatctgtcggccgtggcggagagcgtgaaggtgctgaaggaggcggccaagacgaggaaggtgccgtcgccggagttgctcgcggcattggccaagatcaagaaggcaaagctcgacacatccaccttcttcgagaccctcggtgggacacagtccccgggcaggacatggatgctcatcttcactgctaagggtcggctggagaaaggacagtacttcccagtgaccgcagtccagcgctttgatgctgcaggaaagaggattgagaatggcgtgtatttggggcctgttgggtccttaacctttgaggggaggctgtcatggaagaagaagatactcgcattcatcttcgagcgggttcgcataaaggtcggccctttcggccccctcgaaatcagcctcggaggtggcaatgatggtagggagccgagcacaaaggaccctttctttgtgtggttctatgttgatgaggaaatcgctgtggcacaaggcagaggagggggagtggcttactggtgcagatgtaagcgtgttccatgaactctgaagattcagttcagtcatcattccaggatgtag

SEQ ID NO: 440 - DNA, 806 bp, Oryza sativa
gctcgttctctcgcttcgctcgctcgctcgcgtccctcccaaattcccccaaaataattggaaccccactccgccaccggtgcggccgcggcggcgccgagatcggagagagagagagatggtggtgcggcggctgggcggcgccggccgcgcgctgctgtcccgccaggcgctctcgctgcccaacctccgccgccgcgcgtccaactcctgggccgccgtgcgcgacaccttcttctccaccaaggaagtgttcgagagccaccgcgtcgtgttcaccgtcggcacatccatcgcctccgtcctcaccgcatgggccggttattctttgcggcacatgcaacaatcaaggattgataagagacttaactcaattgaacaatctctgaaggatactcacaaagtcgaacatgaagagattaaaaagattgtcacttccagtaatatcagcactccagcctgtgtagccactgcattgacaacttcagttgtcgggtatgcgctagggtggcggggtggagcctggtacgctcggagaggcttccgaagagagcaacagaagctgatgggccaaatcaattcacaccacagatggcactggcggcctttcagtaaactcaaaaacagactcagaaggaaccgaccagcggccaagactgtcgaggcccctcggttgacaggcgaaagcaccatctgaaaatgttaacagtaactctcaggcagcaggatgtgcatgatccctctgaaatacagatgaacatcgatgcccatgtgcctgagaatagaaaccaaagaagcctgttcat

SEQ ID NO: 441 - DNA, 2247 bp, Oryza sativa
aatccgtaactctcgcctcaccggccaccgctcctcccccccacatgagcggcgatgacgtcgagggttctcgtctcctcctcctcctcctcctcctccgccgccgccgccgcattcctgccgcgaattccgaacccctgcgcgaaccctagccaccgcggcgcgcctccttgcggggcggcgctctggcggcaccattctggccgtgcggtcaccacggccgcggccgccgccgccaccggcgaccactggggcgctgagtaccacggcggcggaggcgggcgcggcgggaagagcgccgcgggccccggcgtgcagtgcgacgtggacgtggtgtcgtggcgcgagcggcgggtgttcgcgtccgtggcggtggccgccgacgtcgacaccgtgtggcgcgtcatcaccgactacgagcggctcgccgaattcatccccaacctcgttcacagtgggaggattccatgcccgcatcagggccgagtatggctcgagcagagggggctgcagcaagcgctttactggcatatcgaggcacgcgtcgtgttggatctcaaggaggttccggatgctgttaatggacgagagctccacttctccatggttgatggtgactttaagaagttcgaagggaaatggtccatcagatctggtccaaggtcatctagtgcaattttgttgtatgaagttaatgtgattccaagatttaatttcccagcaatatttcttgagaggatcataaggtcggatcttcctgtgaatcttggagcgttggcctgtagagctgaaaacatatatttaggaaaccaaagacatggaactgcaaaatttagtggtgcaggctccaggtttcataacttccgtaatgcaaccactgagaatgatgccattgctcctagtaagttcaaagaaacacctccttctggtcttggtggtgtgcttgcttcacctccttctgagttgaacagcaaatggggagtatatggaaatgtctgcagacttgataggccgtgtgtggtagatgagatccatcttcgaagatttgatggtctcctggaacatgaaggggctcacaggtttgtgtttgctagtatcactgtgaaagcgccagtgcgagaagtatggaatattctcactgcatatgagaagttgcctgaatttgtgccgaatctggctatcagtaggattattcgtcgggataataacaaggttcgcatactgcaggagggttgcaagggtctactttatatggtgcttcatgcccgtgttgttatggatcttcgcgagaaacttgaacgtgagataagctttgagcaagttgaaggtgatttctactcatttaaaggaaaatggcgcctagaacaacttggtgatcagcacaccttattgaagtatatggttgagactaagatgcataaagatacctttctctcagagtctatccttgaagaggtcatatatgaagatcttccatcaaacttatgtgcaatccgtgattatattgaaaaggcagaagctgagagcggtaactccacaagtagctctattgtagcatcaaatgcagatactattgctattgattatgcagaaggtaggcaatcagaacaagcatccacgtcatgttcttcgagtcctgtgaagcagagaccaaaagtcccaggccttcaaaaggacattgaggtcctcaaatctgaacttgagaaatttattgcaaaatatggtcaggatggcttcatgcctaagagaaaacaccttcgtttgcatggaagggtggatatcgagaaggcaataacacgcatgggtgggttcaggaagattgccagcataatgaatctttcactttcttataaaaaccggaaaccaagaggttattgggataatctggagaacttgcaagaagagatcaggcgattccagaagaattgggggatggaccctgcttatatgccaagtagaaagtcctttgagagagcaggacgttatgacattgctcgggcgttggaaaaatggggtggagtacacgaggtttctcgccttctttctcttgaactcagacgacctagaaggcgagccaactctgatgatgagagtaaggctggatcctcatatgccataacaaataaacacgcaagcaagccaaacaaaccaagcgtttctccggacaaacagaaatggctcctgaagctgaaggatctggatgctaattggattgagtactaactaggaggacttcactaatacggt

SEQ ID NO: 442 - DNA, 2023 bp, Oryza sativa
attcgatgccatgtaggaagacgaagatgatgaagctagcgtagcctagtgatggctcaacccgccatggaagggacggtgcagggtggaggaggaggaggaggaggagcacaagaacctcgcggacagtacggcggaggcggcaagaacggcggcgacgcctccccgcgcaagcatgccgctgccgctgccgctgccgccttgccgcgacaccggcgatccaagagtgcttcttccgatcggagcctggagccatgcaagcacgcggcgttgcacgatcagcgctgcacccaagcagcacaggcgacgccgagctctcatcaccaaccggacgcgacgacgaggaaatcccacgccgccgccgccgccgccgccgagggctcctccatccaccatgtactgacgagagatcgcagcagggcgagcgcgtcgccgaaccatcgcgtctcgctggagaatgatatcaggcagctgcagcttaacctgcatcaggagaggtcgatccggatcatgcttgaccgggcgattggccgcgcatccagcactctgtctcctggccacatgcatttcccagctcagacaaaggaactgattgcagagattgaattgcttgaagaggaaatcgcaaaccgtgagcagcatgttcttaccctctacagaagcatcttcgatcaatctgcgtctggagcatcctcagggcagagttctggtctttcttccccagcgcataccaagagtatcagctctagaacaagacggcatccgagcataatatcgagtgcattttgctcatctaagaagctcccgctccaacctttccaaatcatgacatcggtatcggagtcggggagatcgaagagtatgctgaaaaccaagattaagcatgaatctttctcaagtgaaacattggatattcaccctgcaaccttcccaccagatccaaggaagcttccttattcaggaagtagttctttgactcggaccctgaaagatcacctctaccaatgtccaagcaaaatatccgaagaaatggttagatgcatggcctccatatactgtcttcttcgcaccgagtgtcccgaaaaccctgaaaaggtccgttcaccattcttgtcgaggtcatcaacaaatgtcattcttcctcggagaggaaacggagaggacactaatttgtcaaacaccaaatgtacggtggaagtatcttcaatatcagctgataagaatcacatgccagatgtctcttatgcaattacgcactacaggttgcttgtggagcagcttgaaagggttgatctgagtatgtcagaaaccaatattaaattggccttctggatcaatgtgtataattctcttgtcatgcatgcatatctagcatatggcattccaaacagttctctgaaaagaatggctctatttcacaaggctgcctacaatattggaggccatgcagtcacggccaattccatcgaacacgctctactatgctgcagatctccacggattggtcgttggtttgaatccatactgtcgacggcgatgcggaagaaatgcgcagatgagaagcaactcgtccagctcaaattcggcctgccggactgccagcctctcgccctgttcgctctgtgcacaggagcttcatctgatcccatgctgaaggtgtacacggcgaagaacatcagtgaggagctggagcgtgcgaagcgggagttcctgcaggcgagcgtggtggtgaggaagtccaagaaggtgttcctgccgcgcctcgtcgagcggtacgcccgggaggccggcctcgccggcgccgacgagctcctcgcgtgggcgcgcgacaacgccgacgcccgcgccacccaggacgccatccagcggctgtgcgtcgacgccggcggcggccggaggaaggcagcgcaggccgtcgagtggctcccctacaacgccaggttccgctacgccttcccccggaccatggtcgacaagccactcttctgagcaagaaacaagcgtacattctgatgctccaatg

SEQ ID NO: 443 - DNA, 1064 bp, Oryza sativa
actgaagagtggctgcttgcaggcttggcttgcagctggggagagagcatgagcagcggcggcgtcggcggcgggagcttgggcgccggcttgctgtaccacaagttcgtcagcttcgcgctggaggagacccgactccggaccaccctcacccctcacccctcccaggaaaagttcaagtctataaaacccaatgatgataatacagttttcaatgctctctcattcagtgcaccgaaaattagattgcttcgcagcttgacaatcgagaagaaaaactcatatcaggttcttgactttgccgctttctctgaacctgaatacgatcttcctatattttgcgccaacgtttttacaactcatgcacaaagtattgttgtattggacctcaatcctctatatgatactacagtgcacaaggattacaaagataagtactataggagtataatgcctcttgtacacaagtataacgagcttcttccttggggtggcaagattacgagtgagtcattgaagttcttctctccaattgtgatctggacaatatttgagtcaactgaacacaaccaccatgttctacattcagctttcgtggattattataaggtctggcttgaattaatggaccaagcaattaaagaaaataacaaagcaacaattgctcgtaaccaagaagaacaacataaatatctcacatggagggctgagaaggatcctggctatccccttttgaagaagttaattggtgaaagtcgtgccgaggatctggtgatggagtttctgtttgaaggagtaaatactcttggaacaaaatcatttctggattatttccctgaatacgcccgtgatgatgggtcagtgaacaagaaaaggagtatgatcggcaagtcttttgaaactaggccttgggacgccaatggagaattcattggcgatgccgaagcacagtaaaatgttcgctacgcctttcggcctgatcaatctctcttatgcttgtagtactgttttctttttttttagaaaacttacatttttcatgctcatatccctgaacttggatt

SEQ ID NO: 444 - DNA, 3346 bp, Oryza sativa
ggtggttgctgagatgccggccaagtacttgcagatgctcggggaggagaggcggccggagcttcaccggcagcaggcggggtgcgtcaccgggatcctgcaggcgttcgaccgccggtatcccctcgccgcccaccattcccacaatcgccttcttcccccagcccatgcactgtcaagcagtccaagtgttggggaagagcgaacaagatattcatctcagattgttcttgacaagaacatgagtaaaagctggatcgataatcaaagagcaccattaacagtggagttgtcgcaaggatcttattcatcgtcgtcttgttcttcgtcgtcctcccttgatggaaacagatcaggacagcaagacctatcctccactgatcgaatgctatttccggagaagccattcaaaagctcaccgaagctcaagagctcttctgacagtgactgtggagtggattactaccttgatgatgcccttgccaagctctcagcccaacctagctacccaactcttggtataagaaatctcgtaaaggattcaatatatagagatactcgtgatttttcaatcagaactttcaccaaagaggcagaaaaagatcacctattcaattgtggagatccgcctagaatcttgaatgagcctcctaacagtgctatccaagagaaaaacaaaggaaccatggacattgacgaatccctccgagttttagccaagctcaggaatccatctgaatcagtccagcaaccaaggctatcatatgatgctcctcgcttctcgtgtgaaggaagggaatcagcgtcaaaacttagggaggtgccaagattgtcactagacataaaggaaagccctcttaggaaccgcgaaatcgacgtaaggccaaagccaagcatgactgatgaagacaggagaagcagcatcagtaaagattacagtccacccttggagacccagcaagaacacaatgcctgtaaacgtctccctagcgttgttgcgaaactcatggggttggaagacttgccagagcataaggacaatactgcgatatcttcacaggtatccaaatcagttacagagaggagtgaagaacccaccatgctgaggcctttgagcctttcttcccaaaatgaggctactcctaggcagcagaggaatctagatgcaacaatcaagaatgttcctaactctaagttccctgtggaaactgcaccttggaaacagcaggagaagattgtgctacctagaaaattgccgaagggatcaaagggagctcatggaaaagagcaacatgctgcatcagtttacagtgagatagagaaacggctcaaggaccttgattttcagcaatcgaacaaggatctcagggcactcaagcagatcctggactcgatgcaagcgaaagggttgttgcagaacaagaaacgtgaggaaccatcgatgccgaagatatatgatggagaccatgataacggagatgtgactgatgtaaacctgagactgaatagcaccagcaacaccaaacaggcacctgaaggaaccccatcatttacaacggaagaagatagcactacagaaagaagcttcaaatcacccattgtaatcatgaagcctgcaaaatctgcagacctgttaagtgatgtaaccgaggattccgctgttggtccattaggcggtttatcagagctaccgcagctgagaacagccaatagtgctgataaaaggaaaagctcaaagaaggtcactagggaagctgtggagcaacataccaaatctagttcaagggcacctacacctcaacaccttgcttcttttgacaagagagcaaatggaaggaatgaagaaattagcaggaaacagaagtctacttcacagctgatgactgagaactcagctaggagacagcagatgcaaagagaaaataatggaagcttgctaaagcataaaaattccactagccctagagtacaacagaaaaaacctgattcagagcggagggccagaccgccaattccctctcccgattcaagcaagaatcaaaggcaatctgtggaaaggagccatttggattcagtatcacccagaagtaaatttagaagaaaacctgctcaagcacaaggtgaagatttccatcaaaatggtgtaagtagaaggacaaggagcctgaaccaggaaggcaatgatatgtccgcaaggtcagatggtagcataagtgttgcatcagagctggatgtagaagtgacaagtacagacagatctgcagaagttaacattttgagatctcagcatggcactcaaacaccatcaggaaggaatcctcaaaaagtgaaaacctcttatgatgcaaacaaggacctgccatctatggatcctgcagcaactattactgagcggcctagtccagtctctgtattggactcttcgtttgatcaggaggaatttttccataccagcaagaccacaaattcatctaatgttgatgatgagcatcacccatcaccatcagaagagtcctgcaagccttctgaaaagaagtccacagagctccccacacaacccaagaacagcaagctcgcaaacatagccagcctccttaagaagctccagcaattgagcgtaaacaaggatgaggcacctcctgtcgatcacattgccttcttgtgcgagacgccaagcccagaccatcgctacgtatccgagattctactggcgtcagggcttctgatgaaagaccttggttcagggctgtcacaaatgcagctccacacatcaggctaccccatcaaccctgacctgttctttgttcttgagcaacgaaaatctgggtggacatccaaacctgaggggatccatcagagcaggagcaccacaaagccagatgatcccaagagagcgcaccggaagctaatgttcgaggcggtgaacgagcttctccttgacaagtttgagaaggaaaccacactcatcactggagtagcagcaagggatccagtgatgagcagcgggcagcagctggtgaagatgatatgctccggcatcgaatgcctgaagacggagagatcgcgcatgtgccaagaagacagcagcgtgatccctgacgcagagatcctcaacaggttggaagggtggtcgccgagcttcatcaggagggagcttccaggcatggtgctggagatcgagaggtcgatattcaaggagctcgtcgacgaggtggtgcgcggcgagtccgccgacggtcagccggcgaaggccggaaggcgcagaaggaggctcttcgcttgacagtcactagtgatggctgctgacttgcattggagtgcgaagcgtgaagcgagtgtaacttag

SEQ ID NO: 445 - DNA, 1712 bp, Oryza sativa
cgatgcggtgatgggaagaaggggcgcgggcgcgggcgctgcggtggtggtggtcgcggccttcgtggcggcggccgtggcgtcgggggacacgctcgccgatctcggcggcgccgccaaggggatcgacagcgtgccagaagtgaataacttgggaccatgggcgaaggggcttctgaaagggatgccggactcggcggcagggccagcagagggccccatcgcaaagtatccgctggttctggcagaggagaggacgcggcggccggatgttcttgaccaccttaggatgtatggaggagggtggaacatcactaacaagcactattgggcgtctgtttcattcacaggaattgctgggtttgttcttgctgctgggtggtttatttcgtttggaattgctgtagctgcaagctgcttttggaaatcaagaatagacaaagaaaatgattttcatgcagatatactgcgccttgtgttgcttgtggtcttcatatttactttaacggctggatctgttatcctcttttgtggacagagtaaattcggacaagaagctactagcactgtcgattttgttgtgaatcaatctgatttcaccattcagacgctaaggaatgttaccgattacttatcgcttgcaaagacaatcagtgtggcagcactctatcttccttcagatgtacaagggcaaattgacaatttgaaagtggacttaaataaagcggctgatactatatcccaaaagacatcagaaaactacagaaggataagaaaagttctccataacttgtcagttgctttgatttgcatagctgcgttgatgcctgttcttgcattcttgggatatgttttggagctgtatggacaaagaagtacagtttatgtatttgttaccttatgctggacagtagtggcaactctcttcattcttctagggattttcctgatattgaacagtgctgcaaaggatacctgtgaagcaatggatgaatgggcacaacatcctcaagcagagacagctctcagcaacatccttccatgtgtagatgaaagcacaaccaatcaaaccttgtaccagagtaaacatgttgtggtaattcttgtaggcatagttaatagggctatatctgctctttcaaatcgaaggccacatcataaacatcctgggcagttcatgccttacctgtgttctccctatgatgcgaacctgactgatcggcagtgcaagtctagggaggtcaccttcgataatgcaaccacagcatggctgaactatacatgcacagttcctgactcagatttgtgctctggccccagaaccataactccagagatatacagtcagcttgttttagctgccaatgtaagctatgctctgtaccattatgcccctctcatgctcaatctccaggactgcaagttcgtccgcaacacattcagctccatcgcttcgcagtactgccctcctatatggcgcgacctcagcttggtctcagcaggcctggctctcattgcctctggcttaacacttggcctcctcttgatgctttttgcggaccgcccccaaagggaggaggtgtccgagctgccatcagggtcaaggatcaccccagtagactgctctccatgacgagctcagtctctatggtcattcagactagtatagcaattgcctgtaatagttaggaaaagaagaaggtgaagcactg

SEQ ID NO: 446 - DNA, 401 bp, Oryza sativa
tgcagacacaatcgttaaatcgcgatcaccgcagcaagccatgtcgtcgcagcggcccggccgtcaccagcggagggcgtcgcagagcgtgttcgtgctcccggataacttcgccgacctcgacgacgtgccggccggcgccggcggcgccggcgaggacggccggaagggcgccgccgcgacggcggacgcggccggcgggcagcagcaggctcgcccatcgccggcggcgcgccaccggagggcgatgtcggtggccgtggcgtcgtccagggagctggagatgatcaaggaggacatgggcagctacaagatcggcgcctgatgcagcatcgatcgcacacacaggggcgccgtgcttagtacttgcggctaaatcgtcatgtgtatggccggttaat

SEQ ID NO: 447 - DNA, 988 bp, Oryza sativa
aacaatatgggcttcagatgggccgtaaaaatgcaggcccaccttaattttaggcccataacaactctacattgctttcctcctccgtcgattcgtccgccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccggtccaggagatggaggcggcttacaagttcgggccgtacaagatcgacgcgagggaggtgttccactccacgccgctgtcctacgccatggtcaacctccgcccactcctccctggtcatgttctagtgtgccccaagcgtgaagtgaaacgatttgctgatctaagttctaatgagattagtgacttatgggttaccgcaaaggaagttggtatacggcttgaacagtaccacaaagcgtcttcacttacatttgctattcaggatggtccacaagctggtcaaactgttccacatgtccacatccatgtcatccctagaaagaaaggagattttgagaaaaatgatgagatatatgatgcgattgatgtcaaagagagggaattgaaggagaaacttgatctggacatagagagaaaagatagaaccatgaaagaaatggctcatgaggccaatgagtaccgtggtctcttctcttagatgtaatttttgcgataaatttcttgtaaactatctctaaattgcagttactcttctccagaaattatttttgtaactgtttgtcatccatcatgggaatggtacctttaaaggatccaacaatatgggcttcagatggaaaggatccgtccagacaacaatatgggaattcaagtcttcgggtacctttaaaggatccgtccagacaacaatatgggaattcaagtcttcg

SEQ ID NO: 448 - DNA, 419 bp, Oryza sativa
aaaggatccggactctattcaggccaaagaaaaaagaaaaaaaaatccaaagccccgcaacgctgagcagagagaggaagaggaagaggaagaaggcatcatggcgacggcgaaggcagccacggcgccccccacccaccgcgcgtcgtcgccggcggcggcgtccccgccgtaccccagcgccgccaggatcgccgactccgactgcttcccccagtacaccgcctccctcaagtgtttggaggccaaccaagacaagagcaagtgccagcagcagttcgacgactataaggagtgcaaaaagagagagagggaggctcggcttgaacgaaacaagggtcggtcattatttggttgagcagtacagaggaccgatgtgcgataagatgttagtctgaagcacgtgaacgggtaccttt

SEQ ID NO: 449 - DNA, 704 bp, Oryza sativa
aaaggatcctgaattagtgatatcgatcagagtgtgaagaagatgtctctggtgaagctgtttgatacgttggcgttcgacgcctggaacccgttcagcatctttgggacgacggtggcggcggacgcgtggctggcgagcgacacgtcggcgttcgccaacacgtacatcgagagccgggagacggcggaggcgtacgtgttccgggcggacctgccggcgggggtgaagaaggaggaggtgcgggtggaggtggacgaggggaacgtgctggtgatcaccggcgagcgcagcgtccggcgggaggagaagggccagcggtcgcaccacatcgagcgcagctgcgccaccttcttcggcaggttccacctccccgacgacgccgtcgtcgacctcgtcagggcgtccatggacggcggcatgctcaccgtcaccgtgcccaaggtggtcactgacaagcagcccgccatcgccgccgccgcacccgtccccgccgtcgtcgcacccgctgtcgaggcgaaggcaatcgaagccagcccgtagtgatgcgatgaacacacacacacacacacagacagtcagtcaatccaacgatccgtatgtatacgttgtcgtcgatgataagttcaaagtgcttgcgagtaaggtgcttgctgtacttttggtttaattacctttggtgtgaaatgctttctggtaccttt

SEQ ID NO: 450 - DNA, 689 bp, Oryza sativa
aaagtcgacccacagaaagccgaggaagagaaaaaaaaaatggagctcttcgtctccaccgtcgcctccgcgcgcgccaccgcccccttatgcttcgcctcctccttccaccaccgccgcgctgctcctcccgccgtcgccgccgccgccaccctccgccgcagcaaccgccacctcccgactcgaggatggcggtgcgcgagcgcggcggcgccggacccggtgccatcggaggagcccgcgtcggcgtcggcgtccaccgtcgtcgtcacggaggacaagcccgatccgccgccggcggaggagaagagcgaggaggtcgcggcggtctctaatggcgggtctctggagaccgtggcggcggcgccggtgtcgtcgggggcagccgaggaggacggcggcttggatgacatcctcagcaagctggacatccaagtgacaccaactcttgtcctctatggatccggtgctttggttgtcctatgggttctatcttcagttgtttctgcaatcgattccattcccttggttccaaaagttcttgaactcataggaactggttactcaatttggttcacttcacggtacctcctcttcaaggaaagcagggacaaactgtttgcgaaattcgaagatctgaaagagaggattatttgagctcacgatgaatgatcctatgggaattcttt

SEQ ID NO: 451 - DNA, 617 bp, Oryza sativa
agtatcgcactcgtggaatctcctcccgtcccatctcctctccaccggcgatgcagcagatgaggtccgccgccgccgccccctgctccctcgccgccatgctcctccgccgcttcgcctacacctcctactcctcctcctgtgggcccatccgccgtcacgccgccgttgccctctcctccaccaccaccaccaccaccaggttcgccgcctggtcccctcctcctccttcgggcggcgccaggagcagggggttcgctgcctgggcgtcggcgcccgggccggcggggtccacggattcccccgccatgcaggcgctggagaccaagatcaaggagcagctggaggcggacacggtcaccgtcgtcgacacatctggcgacggccgccatgtctgcatagatgtagtttccaaggtattcgaagggaagtctgccgtaaatcggcagagaatggtttacaaggctatatgggaggagctccaaagcaccgtgcatgctgtggaccaaatgacgaccaagacgccttctgaggctgctgccaaccagtagcaagcatctgcttgagataaatttggagtgccacagtgggaactgttgtactgggacctgaccatt

SEQ ID NO: 452 - DNA, 999 bp, Sorghum bicolor
gttatccatttcttctcctctgctctgctcgccgccgccgctcccgctgccgctgctgcagtccagttcggtagttatggcggccgggagtgccagtgccacggcgtctctctccgtggcggcggcagcggctgctgctctgcgcgtcaggcggccatgcgctcgcgctcgcgcttgggccccctcgcagcggccgcagcaaggggcactcctcagcctcaagccttgcgcctcactggcaccacacgcgcctctgtggcgggcggagtcggatgccgcgggcggtggtgccggcgccggcgacgtcatgggcctccttctccgggagcgcatagtcttcctcggcaacgagatcgaggacttcctcgcggacgccgtcgtcagccagctcctcctcctcgacgccatcgatccggactctgacatccgcctcttcgtcaactcaccaggggggtccctcagtgcaacaatggccatctatgatgtaatgcagcttgtgagggcggatgtctccactattggaatgggcatagctggatcaacagcttctataatccttggtggtggcacgaagggcaagcgatttgccatgcccaacaccaggattatgatccatcagcctgtcggaggtgcaagtgggcaggccctagatgtagaggtccaagcgaaggagatattgacgaacaagaggaatgtcattcggatcgtgtcaggcttcacgggccgcactctggagcaggtagagaaagatattgacagagatcgttacatgggccctcttgaggctgttgattatggacttattgatggtgtgatcgatggagacagtatcatcccacttgagcctgtcccagagagggtgaagcctaagtataactatgaagagctgtacaaggacccacagaagtttcttacacctgatgtcccagatgatgagatatactagtctaaaagttgtattttctacgaatcttaagtctgttgttctgcaaacagttg

SEQ ID NO: 453 - DNA, 1513 bp, Sorghum bicolor
acacagagaatcaaacgctccgcagcgaattcaattttgaaagccccagagagcttccatggcttccgctaccacctccatctcatcgcaccctgccgccctccgcgatgtcgtccaagctgcgaggattggcgcgctgaggcagcaggtgggcgtggccccggcggcggcgcgcggccagcgcgctcgcgctgtgcgcccgctgcgcgcggcggagcccgcgaggcagccggtggcggcctccgcggccgcggcggcgccggccgcgcccatggccgacgaggctgcggcggccctcgcggcggtggactacgaggccctggcgcgtgagctggatggcgcgtcgccgctggagatcatggatcgggcgctggccatgttcggctccgaaatcgccatcgccttcagcggtgctgaggacgtggcgctgatcgagtacgccaagctgacggggcgtccgttccgggtgttcagcctggacacgggtcgtctcaacccggagacgtaccagttcttcgaccaggtggagaagcactacggcatccgcatcgagtacatgttcccggacgcgagcgaggtgcaggagctggtgcgcaccaagggcctcttctccttctacgacgacggccaccaggagtgctgccgggtgcgcaaggtgcggcccctgcgcagggcgctcaaggggctcagggcatggatcaccggccagaggaaggaccagtcccccggcaccagggccagcatccccctggtccaggtcgacccttccttcgaaggcctggatggcggagctggtagcttgatcaagtggaaccctgtggccaacgtcgacggcaaggatatctggacgttcctaaggaccatggacgtccctgtcaacaccctgcatgctcagggctacgtgtccatcgggtgcgagccgtgcaccaggcctgtcctgccggggcagcacgagcgggaaggccggtggtggtgggaggacgccaaggccaaggagtgcggcctccacaagggaaacatcgagaaggacggccaggcggcggcccccaggtccgccaacggcaacggctcggcgggcgccccggacatcttcgagagccccgccgtggtgtccctcacccgcgccgggatcgagaacctgctgcgcctggagaaccgcgccgagccgtggctcgtggtgctgtacgcgccctggtgccccttctgccaggccatggaggcctcctacgtggagctggccgagaagctggcgggctccggcgtcaaggtggccaagttccgcgccgacggcgagcagaagccgttcgcgcaggccgagctgcagctgcagagcttccccaccgtgctcctgttcccgagccgcacccccaggcccatcaagtacccgtcggagaagagggacgtcgactcgctcctcgccttcgtcaacagcctccggtgaggccgccagtgagcgagaaccatcgttctctgtcagtatgtacttgtaccgtgttatgttggcgtccatctt

SEQ ID NO: 454 - DNA, 709 bp, Sorghum bicolor
aaggatccaaaggaaagccaagtcgtttgctcatttcatggagagctcttctcacaagcgggcgcgggaggtggtggacctcaccgccgccgggcccggagaggcagccgcgttgccggaggcggacgcgaagaggctgcggccgcaggatctcctggacatgctcgatgacgacaccgacgcggccgccgccggcgacctagcgtccgtcatgaggagcctggaggaggagatagctagcttcgacgaggccgtgggggccgcggaagcggcgcctacgcagcagcagcagcagccggagctggggttcctgctggaggcctcggacgacgagctggggctgccaccggctggcgcctccgcctcgtcgtcggaggaggccggcggcggcggcgggggcctcgccggggcgccgccggagtccgccgagctggacggcggccagatctggggcttcgaggacgagatagacggtggagcgggcttcggtggctactcgccggaggcggccgccgcggccgtcgccgccgcggcggcgtgggacgacgacggcttcgacgccggcctgttcgcgttcggcgaaagcgacgcgtacgggccgtcggatctcgccgcgctgcgccacgagaccatgccggccgtctgatgaccggccggggcagacacaacagccgcagccagtggtggattagccttgtttggtaccttt

SEQ ID NO: 455 - DNA, 955 bp, Sorghum bicolor
aaagtcgacaccctcttattcgtggattggaatcgacgcctggaagtggatgacgatggcgggttcttgcgccgcgccgcccgttgccggtcttccctcgttgaggacgccgccgccaactcacctcagacttggcggcttcttgccctgttcctcggccgcgcggagtcgcggcgccgccgtgctgggatgcgctctgggggccaagaagcagacgccgggtgttctgaaccggttgctctgcggatacatgcgaagagatggccatgaaggtgatgtaagcagtcaaggaagggatgacactgttatgtttgggccagatgatgatggtgtaaagattcctactcaggtagagactcttgtaaagggcactgcaatggttgctgaaccagaatacaaggcgatcccagatctagattacctacaggagcttctggctattcagcagcaaggacctcgtgcaataggtttctttggaacccgcaacatgggatttatgcatcaacagcttattgagatcctgagctatgctatggtcataactaaaaatcatatattcacatctggggcttctggaacaaatgcagctgttatcaggggtgctttaagagctgaaaagccagagttgcttactgtaattttaccacaaagtctaaagaagcaacctcctgaaagccaagaactgttgtctaaagtacaaaacttgatcgagaaaccgcagtatgatcatttgccactaattgaggctagcaggttatgcaatatggacatcatctctaaggtccaacaggtgatctgcttcgcgttccatgacagcaagctgctgatggaaacatgccaggaggccaagaaccttcggaagatcgtgacactcttctacttggattagctcctccggaagggatctagtctcctattttttgtccgtggcgtaggctaatgttggggtaccttt

SEQ ID NO: 456 - DNA, 591 bp, Sorghum bicolor
aaaggatccgctaaacagagagcctacgaccgacgcggccaaacggagataagagcaagataatgtcgtcgacggcgtttagccacctgttcccctccgccgccgtcgccgcggtatccctcctccctcgctgcgtctccttcggcgccagcggtggagctgcccctggatggaggagaagaagccgcagcatggccgcggccaccgcggaggcggcggcgcccgcctacacctccgactccctcgtcctctacttcaaggcggagggcaccatggaggagagggccattcccaagatcaccgagtctcttcagggtatggaaggagtcaaggacctagaggtgctcattgaagaaggcatcgcgagtgttgtgttaacaaaggagacaaccgtgcaagctactggagtagcctcgaacctagtggaagctatccagggagctgggttcaaactgcaaacactaagcttgagcttcgacgatttcgacgacataacagcaggagcaggaggcaatgtccaacccagcgagtgagctaatttgtgcagccgtgcttagtgccaaatgcatataattctgtcggggtaccttt

SEQ ID NO: 457 - DNA, 1491 bp, Sorghum bicolor
gtgcctggtgcttctcatccccacctcactcgtgctccgcgcccgtttcaccgcctgaacagagatggaggccttcctcgccggtctcttcagggcgcctccacgcgccgtccccggccctcggggcacgcctctctccggccttcctctctttcacggcaggcgccgcaggcggccgtcctcgtccgtggtctgcatggcggagccctatctgattgccaagctggattctgcggagaaggcctggaaagaaatgtcggttaggttggcagatccggacattgtctcagatccaagcgaataccaaaaactcgcgcagtctgtttctgaactggatcaggtcgtgaccacatacaggcaattcaaggattgtgagaggcagcttgaagagacaaaagctctggaaaaagagaacgaagatgaccctgatatgtcagagatgataacttctgagctggaggctctatctaaccagcttgcagagcttgaagaaaaattgaagttactactgcttcccagtgatcctctagattcacgcaacatcttacttgaagtaagagcaggtgctggtggtgacgaagctggaatttgggctggtgaccttgtacgcatgtatcagaaatactgtgagcgcaacaattggaagtttaagccagtttcttgctcagaagcagacatgggtggatacaagacatatgtgatggaggtgaaggggaaacaagtctacagtaaattgaagtttgagtcaggtgtacaccgtgttcagcgtgttcccctgacagagactatgggtcgtgttcatacgtcaacagcaactgtagctattatgccagaggctgatgaagttgatgtggttattgatccaaaagatattgagcttaaaacagcacgatctggtggagctggagggcagaatgttaacaaggtggagacggctgttgatcttattcacaagcctacaggaataaggatattctgtactgaagagagatcacagctacagaacaaagagcgggcatttcaattgttgagagcaaaactttacgagataaaattaagggagcaacaagagtcaataagaaaccagaggaaaatgcaggttggtactggtgctcgatctgagaagataaggacatacaattacaaggataacagagtgacagaccatcgattaaagatgaactatgaactgaccggcttccttttaggagacatcgaatcggctgttcagtcttgtgctacactggagcagcaggagctcttggaggaaatggccagttccgtgggcgcagtgaacgtatgattcaggcaattcggcgttgagatcaggtcatcaaatagaatcaagaaactcatgatgtgttcaaaaccgatgaagatgattgatagttgtacaagaaactgacaaaatgaactccacataggaaatttttctgtagtccacatggtcatgagttcatgactaataccatagaacacacccatgcatct

SEQ ID NO: 458 - DNA, 921 bp, Sorghum bicolor
tgtagaggtagcaagccagagccactggtgctgatcgatcggccggtatggccgggagtgcgaggtcgtcggcggccgcgaagcacgcgtaccggatgttcgcgccgtccaggggcggcggcgccgcgacgagggggcccggcgctggcgccgcggaggagttcgacgagtcggacgtcgtctggggctcgttcggcggcggcgcggactcccactccagccccggggcggagctgcaggccgcggccggctgggcgcgcccgatccccgcctcccgcgccggggccgggcggaagaagcccgccgccgtggacggcggcggcgcggcggggtcgctgccgatgaacataccggactggcagaagatcctcggggtcgagtaccgggaccactaccgcgcgggcgagtgggagcctgacgcggacgacgacgaccacggcaggtcgcgcggcggcggcggggccggggcggagatggtgccgccgcacgagctggcgtggcgcagccgggccgcgtcgatgtcggtgcacgaggggatcgggaggacgctcaagggccgcgacctcagccgcgtccgggacgccgtctggaagaagaccggcttcgaggcggactgacctgatcgtcggtgatccgccgccgcgcccgcgccggcgggggatgagcgcgcgcggttgccggttggtgttggtgtaggtattatcggtaggttagaaaatgagcagtgctgctaatttcttatctcttgatttctttctctctcttttttttttttttgcccttgctatcatcacttttccattttttttccttttgcgtttccatgcttgtaaggggaaaaagtcggggtagtaagctttttcttgtttttgttcgtgttgatgcgagccagagggttgggtgttcgttattcatggtgtg

SEQ ID NO: 459 - DNA, 896 bp, Sorghum bicolor
tgcgtcctgcgctagctgcgcccatggctgccgtgaccagcaccgcctccctctgcccggccgcagccggcggcctctctgcctcgtcgtcgtcgccgttcacgcgcaagcccagcagcagcaggaggctgcaggcagcgtccacggcctgccactgccgccctgctcgggtagtagaggggctggaccggagggacgccttgctcggcatcgtcctctccgccgcggtggcgccgctgctcgcccctgccggtgctctagcggacgagcccaccaccgagtcgcaggagggcttcactacgtacgaagatgaggccaacaagttcagcattcaagttccacagggctggctggtcggcgccggcgaggccagcggcatcaagtcggtcacggcgttctacccggagcaggcagccgccgattccaacgtcagcgtcgccatcaccgggatcgggccggacttcaccagcctcaagtccttcggcgacgtcgactccttcgccgagggccttgtgaacggcctggacaggagctggcagaggccgccggggctcgccgccaagctcatcgactccagggcggcaaacggtttgtactacctggagtacacgctgcagaaccccggcgagcggcggcggcacatcgtctcggccatcgggatggcgttcaacggctggtacaaccgcctctacacggtgacaggccagtacatcgacgacgatgacgattccgaaaagtacaggcctcagatagagaaggctgttcgatcgttcaggctgacatgaaagatgccatgtcattcagcagaggtcttgtgcctgaaaattgacaccttgccatttccatgagatgagacaagacaagacatgtatgccaattcttgagcactgtaacac

SEQ ID NO: 460 - DNA, 583 bp, Sorghum bicolor
aaagtcgaccaccgtctcctgatccaatggcgcgcatccacctcgtagccgtggcaatggccatgctcttggccgtcgcgacggcgcaggcaccaggcgcgtcgccgacgccggcgcccagggcgcagcctccggcgaccccgccgccggcgccggcaccagccccggcgtctcctcctccggcctccgcccccgcgccctctccgacgcagaagccggccccggctccggcgcccaaggccacggcacccgccccggagatccccgcctcgccgccggcgccgagctcgatcgggcagacgccaacggaggccccgacgtcccctccgcctcccagcgacgcgtccagcgtctcccccgccttgttcctggccgccggcgccgctgtggcgtttttcttctgaggtcggtgggtgggccggccggccggcgccgatggatccgcatccgcctgtgttgtgagtgtgacacgatggctctcgctactcgtatttgttggccgcgtcgtcgttgcattgcattcgggtttattactagcatagcatactactgctttcctagctgggttcgatctgaattcttt

SEQ ID NO: 461 - DNA, 953 bp, Sorghum bicolor
accacatggaaagtttacgctcgggagctgggatattttgccgtggcggataaaaccaaacgagcccgcgtcacggatggatatcttcgcgccatccgctgcgtcgcgagctcgccgccatggctcttcccctcgcccgcctcgtcctacccgggttccccgcctgccagtgccagccacggccccccctgcgcttcccgaagcaccacgtctccttcgccgcccctgccagttctcgcgccgccttcgctgcctgcgcggcggctagtgcgccggcggccccagctgcccaagcgccggaggcggagacggtcgagcaagtgggcccgaggacacgcctcgtcgcgcagaacatcccgtgggactccacggccgacgaaatgcgcgcgctcttccagacccacggctcagtcgtcggcgtcgagctttcaatgtacagtgccagtaaaaacagaggattggcgtttgtaaccatgggttcagaagaggatgctcttgcagctctcacccatctcaattcaactattttaaatgatagaaaaattaaggtggactttgcaagacctagaaagaagcaacctaagcaacctgttgtggtatcaaatcccatggaaaagtatattgtgtttgtcggaaatttgacatggagagtaagaaatcgtcaccttcgggaattatttgcctctgccccaggtgtgatatcagctgaagtcatctttcataccaccactccgaggcgatctgctggttatgcatttgtttctttttcttcaaaagagaccgcagaggccgccatatctgctttcaatggaaagatattgatgggacggcccattaatgtgatgctcaaagatgaaaatggtaaaaagaatgaatcttctgtcccaaaggaggaggccgaggtggaatcatctaactagagtgatagctaagcacgaactgttcctagagca

SEQ ID NO: 462 - DNA, 2420 bp, Sorghum bicolor
gtcgactgctccgggtttagataggttccttcaatgcatcgtgttgggagtgctggtaacacagctggctcgactcgaccgagaaaggagaagcggttcacatatgtgctcaatgatgctgatgataaaaagcattgtgcagggatcaattgcttggcttatctaaatggttccacatttagtacaagtgactatctttttagcgggagtcgtgatggtaccttgaaaagatgggaattaaataatggggatgcaagcttctcagcaacttttgagtctcatgttgattgggttaatgatgccattatagttggagaaaagcttgtttcctgttcctcagacaccacaataaaggtctggaattgcttctctgacggtgcctgtaccaggactctccgccagcattctgattacgtgatttgtcttgctgctgctgagaagaatagcaatattgtagcctctggtggccttggtggtgaggttttcgtttgggaccttgatgctgctcttgctcctgtagcaaaatctgtggatgcaaaagaggatgaggttcctaatggaaactctgggcctgctttgtcaacaatgtgcagcgcaaattctagtagcaatattgcttcctctaatggtcaatcacatgggtacaatccaattgccgccaaaggacacaaagactcagtttatgcactggctatgaatgatacgggaacacttcttctctctggtggcactgaaaaggttgtccgagtgtgggatccgagaacaggttcaaaaaacatgaaattgagagggcacactgacaatatcagagccttacttgttgattctacagggaggtattgcctatcaggatcatctgattccatgataagactatgggacctaggacagcaacgttgtgttcattcttatgctgtgcatactgattcagtttgggcgcttgcaagcactccttcatttggtcatgtctacagtggtggaagagaccaatctgtatatttaacagatttgtccacaagagagagtgttttactgtgcacaaatgaataccctattctacagttgtctctgcaagatgacacaatatgggtggcaacaactgattcttctgtttatggatggccagctgaagggcgcacaccccaaaaggtcttccaaaagggtggctcattcttagctgggaatttgtcattctcaagggcaagagcatctttagaaggatcagcacctgttcctgtatacaaagaaccatcatttgttatcccaggagttccagcaataattcaacatgagataatgaataataggaggcatgtactgacaaaggacaccactggttcagtcaaattgtgggagatcacccgcggtgctgttattgaagactttggcaaggtttctttcgaagataagaaaaaggagttatttgagatggtaagcatacctgcttggttcaccatggatgctcgattaggatgcttgtctgtccacctggatactccacaatgcttttctgcagaaatatatgcggttgatctaaatgttgctggagcacaagaagatctcaagattaatttggctcaagagacccttcggggtttgctagttcattggagtaaaaggaagcagaaatctagttcgcacagcttgcctaatggtgatagttcaatagggaaagatgttccgtcaaaagactcaccccggtcaagatctgaggtggatgatgccactgaaaatcatgcaactcatgtgcttccatcatttgagttttctacagtttcacctccctcaattatcactgaaggttctagtggagggccttggagaaagagaattaccgatttggatggaactgagggtgatcttccatggtggtgtgtggactgtgttactcacaatcgatatccaaaggagaatacaaaatgtggcttttatttacatcctgctgaaggctcgcctgcgccaaacataactcaagggaagcttagtgctccacggatattgcgaattcataaggtagctaactatgtggttgagaaacttgtgcttgacaaaccggatggaggctctgatagcgcgtttgttatgggattgagttctgctcaatcgcagctctcagcgctagatagttcttcgcggcttggactaaagtcatggcaaaaaacaaagccatgtattgagatattgtgcaataaccaggttctatcaccagagatgagtttggctacagtgcgaacatatatatggaagaagccagaagatttgattcttcattatagagtggtccagtcgagatgatcacggcttcagatgtacatgctcacatggttctccagatatgttcagcatgtctgcacgatagatggttttgttgaagatacccttggcttagagaggaaaccatcatctcactgaggaggggg

SEQ ID NO: 463 - DNA, 892 bp, Sorghum bicolor
gtatagcgtttgctcgcgtccctcctccacccggacccggcctggaagttctcggcgtcagccgaccaccgcgccgaattccggcacgacgtcgccataggccaaaacacgatgggattcccagatgaaagagtacaagtagatgcactggagagacacttactaactggtttatcttcaaacgactataatggaagttttgaggatgaggtcctctatgatgcatcatttgcagaaatggaagataattttgtcaagtatcaaattgctcagtggactttattatctctattactaatcatagcttggggagtaggactgctcatgctactttacatacctattcgagcatatgtatgtcgaagcgactttcgctcgaggaagctatacttgacaccacatgctgttatttacaaggtaaacaagccttttgcttttccttgttttggggttttcaagaaggagaaacattgtatcctcccttcaatttctgatgttgttgttgagcaagataagctccagtccgtttttggggtatattcgatcaggattgagaatatcggtgtcagaaagcctcgtagttatgatgtaaaaattactggggttgctcatccacatgatttcaggaaggctgttctagtccatcttttgaacactaggaagctgaagttcagtcaaaaagcttcatcgcatgaccaacagagcagaagtttgagttctacagctagttcttcggaggctcctcttggagatttgatgctagagaagcttgatgaagttgaaatctctgtaaagaaaatgcaagcactgctgcagggggctgaaacttcaaagattaagaccacatccagttgactcaatgtatgttgacatttcacaggatcgaacaaga

SEQ ID NO: 464 - DNA, 1683 bp, Sorghum bicolor
tctgggcatttacatctctaagctcaaagaggaaggattatgaaaatggcgcacttgatcactaactgtagtttcagtacatctgctgttcagacattctccagttctcctaattactgccgcagtgttggccaattacagaactcaaaatcttcaaatttatccctcaaatcttgttccaggagacaaaagaagtcatatgtttcctgtgctagtgcagccgtacaaggacagacacaaacacctcttactggtagccagcaagcttatgagcattcatcctccaaacctaaaaaggtaatggttattggtggagatggatactgtgggtgggcaacagctcttcatctctcaaacaaaggttatgaggttgctattgttgataatcttgttcgccgtctttttgatcaccaacttggtcttgattcccttacccccataacttcaatccaaaatcgtgtccgtagatggaagtctctcactggtaagacaattcagctctttatcggtgacatatgtgattttgaattcctctcggaagctttcaagtcttttgagccggatgctgctgttcactttggtgagcaaagatccgcaccatactctatgattgatcgttcgcgggcagtctacacgcagcataacaatgtcattgggacacttaatgtcttgtttgccataaaggaatacagtgacgagtgccatttggttaagctaggaactatgggtgagtatggaacaccaaacattgacattgaagaggggtttatcactattactcacaatggaagaacagacaccttgccttatccaaaacaagcgagttctttctaccatctaagcaaagtgcatgactcccacaacatagcatttacctgcaaggcttggggtataagggccacagatcttaaccaaggtgtggtctatggggtcagaacagatgaaactgcactgcatgaagagctatctaacagatttgactatgatggcgtctttgggacagcactaaataggttctgcgttcaggctgctgtagggcatccacttacagtttatggaaaaggtggtcagacccggggatatctggacatcagagacactgtacagtgcgttgagctagcaatagccaacccagccaaacctggcgagttcagagtcttcaaccagttcactgagcaattctctgtcaatgagctagccaaactggtgacagccgcaggagcgaagcttggtctagaagtgcagaccaaatcggtgcccaacccacgagtcgaggctgaggagcactattacaacgccaagcacacgaagctcattgagctcggcctggtgccccacctgctctcagactccctgcttgactcgcttctcaactttgccatccaatacaaggatcgggtcgacacagcacagatcatgccaagcgtgtcatggaagaagatgggtgccaagccacggacagtctctgtttagagggtgattcaacttcccctggcttatagtgtcaaccaacattgacattattgacatatgtaatgtaataattatgcacattagtatgatgtgctaggtagtgaggtgtttattacgatattaaatttcatttttgttgccggtacaactgaagttcatgtttgattttgttgcccactcgagctcttggtctaatgcacctgagggtta

SEQ ID NO: 465 - DNA, 1115 bp, Sorghum bicolor
agcaattcgtcgagcagctgccgcgcgcgcttactctcctgcggctgcgggcaccgggccaccagggcaccatggcgtccaccgcgcgtgctctgggggcgctcctccacagggcctcgttcctgtcctcctccgcttccgctctccggggagcgtcgctcctccgcggggatcgacctattggcctgttccggaggcatgcggcgaggcggcggatttcgtcattccagccgctctgcatgggacgacgctcctgcaaaatcgctggaaggaaggatgcccagaatttgaagaagatgaagcgcaacagcaaaattggaaaagaaattgttgcagccatcaagaagggtggcccaaatccttcatccaacacaactttagcagctatactggagaaagcaagggaacttgatgtccctaatgaaattttggagcgcaacatcaaaagggcatcagaaaaaggacaagatacttacactgaaaaggtttatgaggtctatggttttggtggagtaggtatggtcgttgaagttctaactgacaaaattacaagatcagttgctgacattagaaatgtggtaaaagactgcggagcaaaattggctgatcctggatctgttacttttagattcagacaagctcgagtggtgaacataaaagttactgatgcagataaggaccaactgctcaccattgcgttagatgctggtgctgatgacgtccttgaaccaaattttgatgatgacgactctgaagaagaagcagaaaggttctacaagatagttactacatcagaaaactatccagttgtgctatctaagctacaagaagaaggattgaagtttgaaactgataatggctacgaacttcttcctctgaacccaattgaggtcgacgacgaggccatggaactaaacaaggaacttgtttcaaaattgctagagcttgatgacgttgacgccgtctacgcagaccaaaaatgagtgaactcatgagctacagctctcaattcaagacacgcttagcccatgggtctttgttggagtatatttactttacattgataggaaaaaaaattgataggtctgcttatgatgcctggttacattggttct

SEQ ID NO: 466 - DNA, 665 bp, Sorghum bicolor
cgtatctccagctttcagacgtcaaagacgatgctgccgctgaggtccgccgcggccgcgccgtgcttggttgcaggattgctgctccaccgattctcatcctgctcgtcctcttctgtctattcggtccgccaccacgcctcgtatgctgtctcctcccagccctccacctgccccaccactacctggttccctttcccccattccagcagccctaggatccggggatttgccgcctgggcatcggcgccggggcaggcggggtctgcggattcccccgctacaaaggcgctagaggctaagatcaaggagcagctgcaggcggacacagtcacggttgtggatacctctggggatggccgccatgtctgcatagatgtggtttccaaggtatttgagggaaaatcagctgtaaataggcagagaatggtttacaaggctatatgggaggagcttcagagcactgtgcatgctgtggaccaaatgactacaaaaacgcctgatgaagctggtgccaagtaatcgatagctgcataataccggggagacagattatctgtgcttttaagatcaggccattgtgtcgacaaaaaattctcttgtgtagtattaatttgcgtgtcaactgaatgatcaataatttggagtatgattagcgtggcttc

SEQ ID NO: 467 - DNA, 1076 bp, Sorghum bicolor
ttcccacgatcagcgtcgtcgcttatctccgaatctctctctccctctctgcagtccgcaccatgggttccgacttcaaatcgatccccttgatcgatatcagcccgcttgtcgaaaagattgatgatccaagcatggccaacgacagggatttactgcaggttgtccggttgctggacgatgcttgcaaggaggctggattcttctatgtgaaaggccatggtattgacgagtcgctgatgagggaagtcaggaatgtaacgcgcaaattctttcagcttccttatgaggaaaaattgaaaattaagatgacacctcagagtggatatagagggtatcaaagattaggggagaatattaccaagggcaagcctgatatgcatgaagcaatcgattgctatactcctattagacctggcaaatatggagacctcgctaaaccaatggaaggatctaacttatggccagaatacccatcaaattttgaagtactgctggaaaactatatcaacttatgtagagatatttcaagaaagataatgcgaggtatagccttggctttgggaggggcgattgatgcttttgaaggggaaacagctggagatcctttctgggtgttaaggttgattggttatccagtagatattccaaaagagcagcgcactgatactggctgtggagctcatacagattatggacttctaacactggttaaccaggatgatgacatatgtgcccttgaggtgcaaaaccgctccggtgagtggatatatgcaacgccgattcccggaacctttgtttgtaacattggtgacatgctgaaggtttggacaaatggaatatatcagcccacacttcacagagttgtcaacaattcgcctcgttaccgtgtatctgttgcgttcttctatgagtcaaactttgatgctgcaatagagcctgttgagttctgccgggagaaaaccggcggtgctgccaagtacgaaaaggttgtctacggagagcatttggttcagaaagtactgacgaactttgtcatgtaaatttgctgggtgcagatgtggaggaataaatag

SEQ ID NO: 468 - DNA, 285 bp, Sorghum bicolor
aagcggagcaatggagtactggtacccctgcaacggcagcagcggctgcagcaaggagaagaggccgccgctcaagaggggccagctcaaactgcagatcgccaggaccctgctcggcagcctcgcggcgccggtcgccaagaaccgggatcgcggcttcgggagttaatcagtggtaggaggagtagagtagagtagctcatgccgtcgagggggtgcttgtaatagggaatgtgcaatctgatgaattttcctctttagaacaggatgtgttggtgtcaagtt

SEQ ID NO: 469 - DNA, 1653 bp, Sorghum bicolor
cagtaatcactccactcctcagcccaccacaccagcaagcaggccaggccgctacaacgcacaacgcgacgcgaccgccgcctcggggttcgcgcaccaccaccgtatagtaccatgtccaccatgggctcctcggcgcagctcaggcggctgaagcctctgtaccagctggtggtgaacaacatcctggccatcgtggccgtgccgctcgccgcctcggtcctcctcaaggcggcgtcgctcgggcccgaggagatccttgcccgggccctggcgctccggccggcgcacatgttcctgctcgcgttcctgccggccgcggccacggtgctgtacctcatgctccgcccgcgcgcggtgtacctggtggactacgcgtgcttccgcaccaaccccaactgccgcgtcccgttcgcgacgttcctggagcactcccgcgtgtggccgggcttcgacgagcgcagcgtccggttcatgacgcgcctcctggagcgctcgggtctcggggaggagacttgcctgccgtacgcgcagcactacatcccgccgtcgcgtgacctcgagtcctcccgcgccgaggccgagctcgtcatcttctccgccatcgacgacctgctcgccaagacgggcgtctccccgcaggacatcgacatcctggtcgtgaactgcagcctgttcgcgccgacgccgtccttcacggacatgatcatgcaccggtacgagctccgcaaggacgtgcgcaacgtgcacctctccgggatgggctgcagcgcgggtctcatctccgtggagctggcccggaacctgctgcaggtggctccccgtggcgcgcgcgcgctggtggtgtcgacggagaccatcaccccgaactactacatgggcagggagcgcgcgatgctgctcccaaactgcctgttccgcatgggcggcgcggcggcgctgctgtcgaccagcggcgccggggcgcggttccgcctggctcgcgtggtgcgcacgctgcggggcgcctcggacagcgcgtaccgctgcgtgtaccaggaggaggacgaccgtggcaacgtgggcatcaacctgtccaaggacctgatgaacatcgcgggcgacgcgctcaaggcgaacatcacggcgatgggcccgctggtgctgccggcgtcggagcagctgctgttcgcgctgtccttcatcgcgcgcaaggtgctcaacaaccggatcaagccctacatcccggacttccgcacggcgttcgagcacttctgcatccacgcgggcgggcgcgcggtgatcgacgagctccagcggagcctcacgctgtcggacgagcaggtggaggcgtcgcggatgacgctgcaccgcttcggcaacacctccagcagctccctctggtacgagctcgcctacatcgaggccaagggacgcatgcgcaccggcgaccgcgtctggatgatcggattcggctccgggttcaagtgcaacagcgccgcctgggagtgcatccgccccgccgccaacgccgacgggccatgggccaactgcatccaccggtacccagtccacattcccgacgtgctcaagcactgagccaccgtacgtacagccattcctgccctcccagtcgcgccattgcacctgctggctgctgctacatttgtctag

SEQ ID NO: 470 - DNA, 832 bp, Sorghum bicolor
gcgaactcccacctcctatcgcctccccctctcctttctctctctctatagccccgcacaaatctctcctccccctctcgccctcgccgcattgcccgccgacgacccccgccggatagagaggaggagagcggcgcggctgcgggagaagcgggcggcggcggagcgggcggcatgtgcgacctggtggcccgcacgggccggcaccagcagcggtacgaggatggccgtcggctagtggccggatgcataccatttaggtatagagctaataatgatgaaacctctggtgacaaaactaagaaacttgtggaagttctcatgataaattcccaaagcggacctggtcttttgtttccaaagggaggatgggagaacgatgaaactgttgaagaggcagcagctcgagaagctatagaagaagctggagttcgaggtgatatagtgcattttctggggctctatgacttcaaaagcaagacacatcaagatgcgtgctgccctgagggtatgtgcagagctgcagtgtttgcgctgcatgtaaaggaagagctggcctcatggcctgagcagagcacccggcagaggacctggctcacggttcctgaagctgcatcaagatgccggtaccagtggatgcaagaggccttgctcacaggcttctccgactggcacgacaagtggagcagaggcggcggcggcacaaactgtgacccggcctaactgctgaacccatctgcagtcgtccattttttttcatctcctcttcccctaggctccaaccttgcataatgcaataacagtgtacttctcttgatatgctgggttggtc

SEQ ID NO: 471 - DNA, 687 bp, Sorghum bicolor
cactgctccaactccattcccccacacccgctcgcgcggttgctcaatggcgggaggcggggcgtcgtcggcgtggggcccgagcccggctctggtgaccgcgctggtggctctgctcggcctcggcctcgccgcctacatcgtcggcccgcagctctactggcacgccgcggaggcgctcacggcggcggccgcgtgccccgcctgcgactgcaactgcgacgcgcgcccgctcctcgacctcccggaagattgtgctaaacacttcaagggggtcaagagtcgagcatctggtgaagagacagaaaaaagtttcacagagctgcttgtggaagaactaaagcagagagaagaggaggcaacacaagctcagcaagaggctgatgttaagttgctcgaggccaaaaaattagcttcacagtatcagaaggaggctgacaaatgcagctcaggcatggatacctgtgaagaagctagggagaagtcagctgtagcattggtccaacagaagaaactgacttctttgtgggagcaaagggctcgggaactaggatggaaacccgagaataccaaggcacacctatagtaaatcaaatacccttgtggatggggttgtatactatgtgtaccatagatcacattgcaaatacaacccactaagagctcgagatgatgtggaaacaaatg

SEQ ID NO: 472 - DNA, 1366 bp, Sorghum bicolor
ggagcatggacatgaggaggcgcctctcgctggcccgcgtgccagcggtggcgacgatggtggtggttatgctgctgtcgctgagctcgtccttgtgcgtgtcggcggcgagggcggagcagcagcggcacccggtggtgctgatcccgggcgcgggcggcaaccagctggaggcgcggctgacggaggactacaagccgtccagcctcgtgtgccgggtgtggccactcgtgcgcggccgcggcggctggttccgcctctggttcgacccctccgtgctggtcgcgccgctcaccaggtgcttcgccgagcggatgacgctctcctacgacgccgacgccgacgactaccgcaacgcgcccggcgtcgagaccagggtctccgacttcggctccacctccaccctccgctacctcgaccccaacctcaagctcctgacggggtacatgaacactctggcgagcacgctggaggagaaggccggctacgaggagggccgcgacctgttcggcgcgccgtacgacttccggtacgggctggccgggccggggcacccgtcgcaggtgggcagcgcgtacctgcagcggctcaggctgctggtggagtcggcgtgcgcggccaacggcgggcgggccgcgatcctggtggcgcacagcctgggcggcctgttcgcgctgcagctgctggcgcgcagcccggcgccgtggcgcgcggcgcacgtgcagcgcctcgtcacgctctccacgccgtggggcgggtcggtgcaggagatgctcaccttcgcctccggcaacacgctcggggtgcccttcgtcaacccgtccctcatccgcgacgagcagcggtccgccgagagcaacctgtggctgctgccgacgcccaaggtgttcggcaacaccacgctggtggtgtcgcggagccacaaccggtcctactccgccaagaacatgacgcagttcctccgggacatcggattcgagcaaggcgtggagccgtaccgcgcgcggatacgaccgctcgtcgaggccctgccggagcccggcgtgcccctgacgtgcctcgtgggcaccggcgtcgtcacggtggagagcctcgtgtacggcgacggcggcttcgacgaggaccccgaggaggtggtctacggcgacggggacgggacggtgaacctggccagcctcgtgggcccgatcaaggcctggtctgactcgcccacgcaggtcgtcgaggtggtggagctgcccaaggtgtcgcactccggcatgctcaacgacaagagcgcgctggagcagatcatcaggatcgtcgattctataaacttcaacaccacgagctatcatcagtcctcttagagcaactccaacactag

SEQ ID NO: 473 - DNA, 1874 bp, Sorghum bicolor
aaaggatcctcatccggtcgttagcctggccgttcagcgcggagcccatccggccatcccgttcgtatcgagccggcacttcggccgcgggtcaatccggcaagccagcgcgcgcgatgcgccagcggtggggcagctgcttctcgggcggcgacgtccgcgtgggcgggcgcgtccccgaggaaccggagccggaggtcttctccttcgcccaccccctccccttctggcccccaggcggtggattcgcgcaggggaggatacgcatcggcggaggggagctggagctcgccgcggccaccgcgttccagaagatctgcaccctgtcgtcgcggcggcgtggcggcggcagcgccaccttttaccggccggtcggcgtcccggcggggttctccctcctgggctactactgccagccaaactgccgcccgctgcacggccacgtcctcgttgccagagcgggggagcgcccgcccggcgccacgcctcagccgccgccgcttgcaaagccgctggactacgcgctcatctgggaattccatgccggtggcagccgtgccaatgccggccacggctacggccgaagcgacgcctacttctgggtccccgtgccgccggagggatactgggcgatcgggtgcctcgtgacgacggaacggcagagtccacctctcgaggaggtggcatgcgtccgcgaggacctcacggacgagtgcgagccgcacgggtcgctgctccgcctgcagctgccggggccgtcgtcgttcttcaccgtgcagggcgtgcgtccggtgcgcagagggatgtggaggaaaggagtgtgcgtgggcaccttctgctgcgccgctgacgggctcccgccacgcgagcacggcatggcgtgcctgggcaacgtcgagctcgacctgtcggcgatgccgacgctggagcaggcgcacgcggtgatccggcactacggccccacgttgttcttccaccccaaggaggtctacctgccgtcgtccgtctcctggttcttcaagaacggagccgcattgtacaagcgaggtggagacaccgccgcgggcgaggagatcgacggcgaggggtctaacctccctggcggcggttgcaacgacggggagtactggatcgacgttcccagcggcgagcggggccgcgccgtgtgccgcggcaacatcgacagcgcggagctctacgcgcacgtgaagccggccatgggcggcacgtgcaccgacgtggccatgtgggtgttctgcccgttcaacggcccggcgaggctcaagctgggcccgatcagcctcccactgggcaagaccgggcggcacgtcggggactgggagcactccacgttccgcgtcagcaacctcaccggtgagctcatgggcgtgtactactcgcagcacagcggcgggcactgggtggacgcctccgcgctggagtacatcgacggcaaccggcccgtggtgtactcgtccaggaacgggcacgcgagctacgcgtaccctggtgtgtacctgcagggctcggcggcgctcgggatcggcatccgcaacgacgccgctcggagcagtctattcgtggactccagcgccaggtaccgcatcgttgcggcggagtatctgggcgagggcgccgtcgtagagccgcagtggctgcagttcatgcgggagtggggtccgacggtggtgtacaagtcgaggaagcggatggagtggatggtcgggcgcctgcctccccggctcaagtgcagagcggagagcatgctgaacaagatgcccaacgagctgtctagggaagaagggccgaccgggcccaaggagaaaaacaactgggagggagacgagagatggtagggaacatgagatatcaaa

SEQ ID NO: 474 - DNA, 1673 bp, Sorghum bicolor
attctcgttggcttcccttcttccccttcccccgaaaccctcgctctcgggcagcccgcacaaagccgccggagcgccgcgccaccatgtaccggcttctcctccgccgcttctccacggctgccgagggtgccgccgccgcctctccttctccctctccctctccatccccctccacctccatgtccccgaccctgcggcaacctctgccggacaacctgtaccgccgcatcatgaatgtcgggcgcccatccatcccgctatcccccgtcctcaagcaatgggatcaagaaggccataccgtcaagaagttcgtcatccaggccatcgtcaagaagctcgtcggcctccgccgcttcgcccacgcactcgagctgtcgttctggatgaccgaccggaggcacctccacctgacggccggtgacgtcgcgtaccggctggacctaatcagcaaggtgcacggccttgagaaagctgtcgagtactttggcatggtgccgaagcggctgaggatgccgcagtgctacggctccctcctgaaatgctatgtggaggcaaaggccgtcgacaaggctgaggagcacttcgcgaagatgcaggagatggggatgaagagttcttatacatacacttcgatgatgaagctttacttagagactgggcagcttgaaagggtgcacgccatgttccaggacatggaagagaaaggtgtgaaacctgatacgttcagtgtggagagtatgttagctgcgtacattgctgctgaagatgtcgagggggttggtaaggtgctcgacaaggccaatccacatgaaaagcttgtgaagtggcatggacaagctttggcagcgagcttgttcatgaaatctgggatgcaggtgagagctgtcatggctctcctggaagccgagaggcggatatccccaaagagtagtaggatcgcatacgctttcttactgaagacatatactgatctggggatgtatcctgaggttggacgaatttggagtgtctacaaatccaaagtgccaccatccaacacgatgtacttgtcgaggataagtgcgttactcaagatgaatgacattgatggggcggaagcaacattgaaagagtgggaaacagtgtctcttcgttatcatgatttcagattaatcaacttgatggttgatgcttattgcagagaaggtcttgtggagaaggcagtagctcttgtggatgacgccatcaagaaagggaggacaccttatgctaatacttggtataagttggctggtgggttttttaaaaccggtgaggtatcaaaagcagtggacatgacaaggaaggctcttgaatctgcgactcctccatggaaacctgacctaacaaatgtgctaatgagcctggagcacttcatgaatcaaaaggatgtagaagcagctgaggagattgcgagtatgctacagaagctgggtcctttgactaaggaggtttaccattgtttactgaagacctatgtccgtgcgggaaagccagtgtccgatttgctcgagcgtatgaagaaagatggccttgaggctgacgaggaaacagagagaatgcgagtagatttgcacccgttgtcgatcactaaataatccattttctctgttcatgtgttccttctttgttcttgagctcttctcattagc

SEQ ID NO: 475 - DNA, 1577 bp, Sorghum bicolor
cgtttctccacctccaactccagctccagctcttcctcccggttcctcctcgccgcccccgccgacgacgcctccctctgtcggatccaccgctgaccgggccgctccgtctgcgccggcctgatcaccggctggttcttggcctcttcgcttcctgcgccgcctagacgtcgccatgggcaagagtaagaggaacaagggcggtcgaagtggcggtggtgccgatgaccagcttgacggtggcagcgatgccgatagcgtgacctctatgtcgactgcgctgtctgaccttcagctcgcgcaggccaccgagcatgttagctcgcaggaattcgttcttgacaactacattgacgctctctacgagaagaggggatccacaagagagaaagcactgggcgctcttatcgatgcttttgaaagttttgtgcttcttggtttagtggaaaacaaatatgtcaccctattgagccagttcaccaattcaattaaaaaaggatctacaaaggaggtgtgtctggcttgtcgctgcattggcttactgtcaattacactaggtgcgggaagtagttcgcacgaaataatggatgagtcacatcaacagcttttgagagttctccaaacttggcctgatgcaccaaaaatgatctctgcacttgattgcttagcagttgtcacatttgttggtgcaactgatctttctgaaacccagctatctctgaaagccatctgggatgtgatccatccaaaatcaggatcaaatgttggcattgtcagaaaaccgaagcctcctttgttagcagccgccgtatctgcatgggcatttcttttaacaactgttggttcatctagaagaaatactgattcttggaaagagccaattacatttctctgtagccttcttgaagcagaggatcgtgctgtgcggattgctgctggtgaagcattagctctgtgttttgagctaaaactgctggatgtttcctctagttatgaagctgatgttgacattgacactagagagaccagtggttctaaacatcaacttttcttgaatatgcaagcattgaaggccaaaatatctggtctagtctatagtctctccatggaggctgggggcagaggtgctgacaagaaaaatcttaatgatcagagagacttgttccaacgaatctcagattttattaagagtggtgagtgccctgaagaatcacttaggatttcaggcaagaatggcattttaagagttacaacatggcgtgaatcaatacagttgaactatatgaggcggtttcttgggcgaggattcctgaagcattcacaggataatgatttgctgcatgagatctttgacatcaaaattgatcgtactgaaaacatgtcaaccactaaaaagaaaatgtttagatccgaagaagagaaaggaagagctctgaagttgaataaagagcgtcgtctagctcaggagaggaaacagaatatcttgaacgagcaatatggatagaacctacccagaataccagagtttttgtatagtcgaactgttaccagatagcgagtgctgtgtatatgacggt

SEQ ID NO: 476 - DNA, 1784 bp, Sorghum bicolor
gatccatgctcgcagccaccccttcccggtccactgatccgatggccgccacggcggccttgagcttccacccggccgccttctcagtctcagctcacccacgagaggcagcagcagcgacgacgaagcagccgctccgccattgctcacctctcaggagcgtcgtccctagaagaacttgccttctcagggccaggtcctccaatgggcgcccgcagatcagtgcctcgttcggcaacagcaatgaggtgctagatgggatgccaacaggagatggtccaccggcaccggggcagggagggagcaccgtcagcatcaccgtcgttggcgcctccggcgaccttgccaagaagaagatcttcccggccctcttcgccttgttctacgaggactgccttccggagcattttacagtgtttggttatgcccgtagcaagatgagcgatgaggagctcaggaacatgatcagcacgactctgacgtgtcgaatcgacaaaagggagaactgcggcgacaagatggaacagtttctgaagaggtgcttctaccagtctgggcaatacaactcagaggaggggtttgctgagttagacagaaagcttaaagaaaaagaggcaggtaggctaccaaacaggctattttacctatcgatcccgccaaacatatttgtggatgttgtaagatccgctagccgcaccgcgtcatcttcaagcgggtggacgagatttatagtggagaagccattcggccgcgactcggagtcctcaggcgagctcactcggtccttgaagaagtacttagtcgaggagcaaatatttaggatcgaccattatctgggcaaggaactagttgagaatctctccgtcctccgcttctccaacctcgtcttcgagccgctgtggtcgaggaattacatccggaatgtgcagttcatcttctctgaagatttcggcaccgagggtcgaggcggctacttcgacaactacggcatcatccgggacatcatgcagaaccacctggtgcagatcctggccctgttcgccatggagaccccggtgagcctggacgccgaggacatccgcaacgagaaggtgaaggtgctgcggtcgatgcggcagctgaagctggaggacgtggtggtggggcagtacaagggccactccaagggcggcaggtcctacccgggctacgccgacgaccccaccgtgcccaagggcagcgtcacgcccaccttcgccgccgccgcgctcttcatcgacaacgcgcgctgggacggcgtgccgttcctcatgaaggccggcaaggcgctgcacacacgacgcgcggagatccgggtgcagttccggcgcgtgccggggaacctgtaccggcggaacatcggcacggacctggacaaggcgaccaacgagctggtgctccgggtgcagcccgacgaggccatctacctcaagatcaacaacaaggtgccggggctgggcatgcgcctcgaccgcagcaacctcaacctgctctactccgagcgctaccgccgcgagatcccggacgcgtacgagcgcctgctgctggacgccatggagggcgagcgccgcctcttcatccggagcgacgagctcgacgcagcctgggccatcttcacgcccgtgctcagggagctggaggacaggaaggtggcgccggagctctacccctacggcagcaggggccccgtcggcgcgcactacctcgccgccaactacaacgtcaggtggggagacatcaccagcgatgacgccgccttctagtag

SEQ ID NO: 477 - DNA, 433 bp, Sorghum bicolor
aggtgctggatccgtggcagcggcggccatggacaagagcatgctcggcgacctggacggcctccccgaggaggacaagatgcggatggccggcatgatcgaccagctccagatccgcgacagtctaagaatgtacaattccctggtggagaggtgcttcacagactgtgtggacacattccgccgcaagaccctggacaagcaagaggagtcatgcgtccgccgctgcgcagagaagttcctgaagcactccatgagggttggcatgagattcgccgagcttaaccagggtgtggccacgcctgactaatagtcccatgctggtttcattgcacctgccaagtttctaaccttggggattttgttagcacagatttgtaatccaaaaatgatttcggcacttcactacctgagatatgtgaccgaccgagtt

SEQ ID NO: 478 - DNA, 1323 bp, Sorghum bicolor
aggatataaggctgagcggtgcagagtagcggcatggagcgcccgaagaagaccgcggtggctggcctacccgacgacctcctggtggagatcctctcctgcctccccatcaacgagatccaccgatgcaagtgcgtctccaaaggctggcgcgacctcatcgcggatcccctccaccacaagaagctcccccaaaccctccatggttttttcccttcctacgtgggggagttgggatctttcatcaatctgtctgggggatccgcgtcaaccttcgacccttccttcgccttcctcaagaagctgcctggcattcacaacatctggctcagggcgtcctgcaacgggctcctcctctttaggcacagcaccaggcttcgcgagcttggctatattgtgttcaaccccgccactgagcagtgggcggccgtgcccagcgagcatactctggctgataggcctattcgcttcagccacacctgtttcgtgttcaatccggctgtctccccctacttccatttggtcatcatcagcgcgcggggggtgagcctggcaacagtgcaattctactcctcagaaacaggggtgtggaggcacacccagattgactgggctgaagaagtagagctgcgaagacaatggaataagcgggatcctcagatcagggggtgcaccccttgtgctgccattttcaacagcatgctgtatttgatcttgactgataatcagatatttgaggtggatgtggaagggaacacaaaaaggataatccgagcgccatcttctgtgggtgggcgggttcatggctgcgttccgcttttcattggtcaatcccaagggcgcctatattgcatcaatgaagaacattgggcagatggtatcccatctgaactgtccagtcgtgtttttagaagagactccgatgataattctaatctactgtcaatctgggttcttgaggactatgatacacaaaagtgggcccttaagcacagtgtgagctgttcacgtctgtttggaaggacaggttttcttggttacaatgttgttgccattcatccagacaacaacaatttcatgttcattgtatatcggaaacaccagctgatatcatatggcttgaatagcaaggaagtgcggactgtcggcacatttcaggaatccttgcagcttcctccttatgttccttgcttctcggacttcttatcagtggcacggcatgaagagatactaggggttggcgtgtgagataagcgtgaaggacgttgccagggcaggcgaccgtgcagtggccattgatcactcaggacagatagcacggag

SEQ ID NO: 479 - DNA, 1049 bp, Sorghum bicolor
agggcagattctccaccaccgcctccaccccgccctcacgacgcgaatctgcggcgaatacccctctcggattcctcctcggctccccgccccgccccgccccgatcgcgccgtccagaggccgccaggctccggcgcccccgctcgcccgggctcgccgggggtcgggatgccctgctgcccgccgtcgctgctcggagtcgggccgcggctgcgctccttcctccgcgactacgacgcgctccagtccctcgccctcgcgctcatctacctccagattgtttgtgcactgatcggatcacttggggcattgttcaatggggttcttgtgatcaacctggtgattggtctatttgctgttgttgcaattgagagcagtagccagagacttggccggacatatgctgtccttctcttctttgctgtcgtcattgacgttgcttggtttatactcttctcacatgctatctggacgattactcctgatgagaagtatggtcgactttttgttttctcactcagactagcattgtggatgcaaatcattgggttttcagtaaggtttttgtcttcattcttatggattcagatgtatagattaggggcttcttccagcacgccaacatattttgaaaccaaccatgaagcaagaaatagtttcttaagccctagatctgattctgttagacggagttccatggcagatgatatattgggaggttcaatctatgatccttcttactactcgtcactgttcgaggatgttcgaaacaattcatgcaatcatcagggtgataaacaaagtggtagtaatgacagtggttctacatctgcaggccagtctccacgacttaaatcttttgcttgtagatctcttctggctaatgatgtggaaagtggactaagaagaccattgaactcctaggataaaacagcgggttcatgttgaaggtggaccatattttgagaacctatacctgtagccattgttcatcgttctctttgaaacatagaggtttgcacaccgcagcagttcatttctcagacca

SEQ ID NO: 480 - DNA, 1144 bp, Sorghum bicolor
aacatcaacactgttcagccaccaaagcacgggagagcagaggaaggacgaaggagagcagagctttgtgggagcagcaatggcaggaacctgggtgaagatggagcagaagggtggcggccctggagcacgaagctcccactccatcaccctggtggggcacacggcctactcattcggcggcgagttcaccccgcgcgtgccggtagacaacaccatgtacgcgttcgacctcgccacccagacctggtccgccctcgacgacgccacgggcgacgtgcccccgccgcgcgtcggggtgaccatggcggccgtgggcgccacggtgtacacgttcggcgggcgggacctggagcacaaggagctgaacgagctctacgccttcgacacggcgacgcgggcgtggacgctcctgtcctcctccggcgccggcggcgggccgccgcaccggagctaccactccatggtggcggacgcggagggagggcgggtgtacgtgttcggcgggtgcggcgacgccgggcgcctgaacgacctgtgggcgtacgacgtggcgagtgggaggtgggaggagctgccgtcgccgggggaggcgtgtcgcccgcgcggcgggccggggctggcagtcgccggcgggaaggtgtgggtggtgtacgggttctccggcgaggagatggacgacgtgcactgctacgacccggcgacacgggcgtgggctgtggtggagaccacgggcgacaggccgagcccacggagcgtgttctgcggcgccgggatcgggcggcacgtcgtggtgtttggcggcgaggtggatcccagcgacctcggacacctcggcgccggcaagttctcggccgaggcgttcgcgctcgacacggagacccgcgcgtggacgcggctggtggacgacgacgacaaggcggaggcggaggcggagcagcagcagcaccccgggccacgcgggtggtgcgcgttcgcggcgggggagaaggatggccggcaagggctgctggtgtatggcggcaactcgccgaccaacgaccggctcgacgacatctacttcttcgcgcccgttcttgaagctgcggccgcaagctagcgcgcgcgtctggcaaactggcagtggtgaaatgtgtagcagtgc

SEQ ID NO: 481 - DNA, 801 bp, Sorghum bicolor
gtgtagccgagtagcagagcagcgagcgccatgtccctgtccgtcgccggcgcgcggacctccacctctcccctcccctcttcgttcgccgcctcttcatcccgcccgcgcctcctcgcgcttcctctccaccgccgctcgcacggctccctcgcctcgccgccggccgcgggcaggcggcggctgcggcggctgctcagggtgcgcatggcccggacggagtccaccggcgtaggtatcggcttccgcgcgccggagttcgagctccctgagccactgaccgggaagctctggacgttggatgacttcgagggcaactctgcactgcttgttatgttcatatgcaatcactgcccatttgtgaaacatctgaaaaaggacattgccaagctcacctctttctatgtggagaaaggacttggtgctgttgccatatcgtccaactcagttaggacgcatccccaggatggcccagaacacatggctgaagaagcaaagttgttcaaatatcctttcccatatctttatgatgagtcacaagaagtagctaaggcttttggagcagtctgcacacctgagttttacttattcaaaaaagatgggcgaaggccttttgaacttttctaccatggacagttcgacgattcaagacccagtaacaatgtgccagtaactggaagggatctaagccgtgcaattgactgtgcgctcagtggccaagaactgccctttgtacaaaagccaagcgtcggctgcaacatcaaatggcacccatgaggtgctcgtaactcatagtgtcgc

SEQ ID NO: 482 - DNA, 693 bp, Sorghum bicolor
aaggatccccgttctgtctacgaggtgaacgcggatcggcggcggcggcggcgcgaggcgagcaagatgagcgggaacggggtgatgaagaaggtgtccgacgcggcgacgaaggccggcaaggcgatcgactgggacggcctggccaagatgcttgtctccgatgaggcccgtaaggagttcgccaacctccgccgcaccttcgaggacgtcaatcaccagctccagaccaagttctcgcaggaaccccagccaattgattgggagtactacaaaaagggaattggatcaaaagttgtcgatatgtacaaggaggcctatgaaagcatagagatccccaagtatgttgacactgtcactcctcagtacaagccaaagtttgatgctctgttggttgaaatgaaggaagcggaaaaagcatcactaaaggaatcagagaagatagagaaggagattgctgaaatgaaggagatgaagaaaaagatcagcacgatgactgcagatgagtactttgcgaagcaccctgagctgaaacagaagtttgacgacgagatccgcaatgattattggggatactaaggcgcagtgtcacctttctttggaacatccaataatacatttcgccccctaaatgtccttaggagttaaccatccaaacttcacgaattgtgtagcgcatgtattggtaccttt

SEQ ID NO: 483 - DNA, 1224 bp, Sorghum bicolor
attcgcagagcagagagtgtagaaggcatgtttccgatggcgtcttcctcactatcgccgccgccgctctcacttatcctcctccggccgctcccgtgcagacccgtcctcctctcgaggcaaaggaagccatttccaactgtccgcgtagaagcaaggcctgagcagcggttgcagcggcggccggtgaccggccggtggaggaggggcggaggcttcgcgtgtttctcctacaatgccaataacaagacgcccccgccatcagataagagttcagacaagtgggcgatccttcgccgatgggatgtgccatgggagtggcaaaccgttgtgctcagcatggtaggctgtggagtaagctttgttctgacaggattggttgagcaatctgctttgcaatacctgggatttaaagctgtggaggcaactatagatgagaaggcagaaatactcttttttgggcaactgagcgtgacagtagtagtccttggcgttatatttagcatcaccaacacttttcgaccattcccagatgatgtgtttcgttatgatattaaagaaccattcaagctgcagaatggatggcttttgtgggctggagttggcctctttggagcaataatttctattgctttagccggagctgctatgacttatctgaatggtgaaactccagagagagagactgattcactagtccttttgttgcccctgattggctcatccactaccagcactgcctttttggtgggaatcactggagttctagcaccacttctcgaggagactctgtttcgaggatttctaatggtgtccttgactaagtggtttcctactccattttgtgtacttgtgagtgctgctgtatttgcccttgctcatctgactcctggacaatttccacagctgtttatacttggtgttgcattgggtttttcatatgctcagacccgcaatcttctaactccgatcacaatacatgcattttggaactcaggagtaatacttctgctaacctttcttcagctgcaaggatatgatctcaaggagctcttgggagcatcgtgaaggtttgaacaaaccagacattttgtgcataatatgatatgaagtagatctatcgggtatgtgctcttgcacacctgatgccagcaaaaccacgtgaaaaagaaatatgagtcttcaagttagctgatggttgcgtttccagaagtgttacgaggc

SEQ ID NO: 484 - DNA, 832 bp, Sorghum bicolor
gcggataggaaactgaggaagctagagccatggtggtacggatccgtctggcgcggttcgggtgccggaaccggcccttctaccgggtgatggccgccgacagccgctccccgcgcgacggcaagcacctcgaagtcctcggctactacaacccgctcccagggaaggatggaggcaagaggatgggcctgaaattcgaccgggtgaagtattggctgtcagttggggcacagccatcagatcctgtgcagagtattctctttcgtgccggacttctgccaccacctccaatgctagctatggcacggaagggtgggccacgcgataggcgccccattcatccaatgactgggcgccccttggatctcgagggcgtcacaattgtcgatgactccaatgctcctgaaggcgacgctgaagagcctacagatgaggtggcttcataagcctcttatattagcatatgaaaatatgatgtattttctatttagcatatgtagtggtgctgcaaaagaaaacttgtttgttgtgcttctgacaagacttgagtactagtacaatgtggcaaaacttttagacaggtaatctttcatccgattttcttctaaaaaatggcagtgccattgtttgttctcatagaaaatgtaaaaccaatgccattgtatgcatctttagcttttgttctgcagcaccatcagcttgtggtctctagtattctctgcgctttttgaaagaaaaagggcaggagctctgccttgcatttaagttctctatacttggctaataagatttgcatgtgaaatggaatatgcatgataagtcgagccttgat

SEQ ID NO: 485 - DNA, 2767 bp, Sorghum bicolor
aagtcgacgtggagcgaataagtggcagcagcggcggcggcggcgggactggcgtaggcagccatgtttttcagcaggctcgatgactcgcccatgttcaggaagcagatgcaatcgcttgaagaaggagctgatttgctaagagagagatgtttaaagtttcacaaaggttgtcgaaaatacacggaaggactaggcgaagcatatgatggagatattgcattcgcaagttcacttgaaacatttggagggggtcataatgatccaatcagtgttgcatttggaggccctgtaatgaccaaatttacaattgctttgagagaaattggaacatacaaggaagtattgcgctcccaggttgagcatatgctaaatgacaagctgctccagtttgtggaaattgatttacatgaaatgaaggatgctaggaaacgttttgacaaggctacccttctttacgaccaggcacgtgaaaagtatttgtccttgaagaaaggtacaaggactgacgtagcagctgcagtagaggatgagcttcacagtgccaggtcttcatttgagcaagctcgtttcaatctggtgactgcactttcaaatatcgaggctaagaaaaggtttgaatttttggaggctgttagtgggacaatggatgctcatcttcgttatttcaaacaaggatatgaactactacatcagatggaaccgtatatcaatcaagttcttgcatttgcacaacaatcaagagaaaggtctaactatgagcaggctgctcttcttgagaggatgcaagatttcaaacggcaaattgatcgtgaaagtcggtggtcaccaaatggaatgaatgattcccctaatggtgatggtatacaaacaattggtagaagttcgcataagatgattgaggaagcaatgcaatcagcttcaaagggcaaggttcagaccattcggcaaggctatctctctaagagatcttcaaacttgagaggtgattggaaaaggaggttctttgtcctcgacagtcgaggaatgttatactattatcgcaagcagaacagtaggccatctagtggttataaccaaaggactagcattccctcagaacatggttctgggttgctcagcagatggttctcttctcattatcatggaggcgtgcatgatgagaaatcggttgcacgccatactgtaaacttgctaacatcgaccattaaagttgatgcagaccaatcagatctgcggttctgcttcagaataatttctcccacaaagaactatacattgcaggcagagagtgcaatggatcagatggattggattgaaaaaattactggcgtcattgcttctttgctgagctcccagtcccctgaacgacgtcttctattgagtcctaagggcagcagccatcatcgaactgccagctcaagcagttcattcagtagctcaacagaacttgaacattcaataaatgaagattgtatgctggaaaagaactcagggagtggttatttcgagcattctgcaagagttgcacagcatcatcgaacaagcatgatgaaacctgacaagccaattgacttgcttaggaaggtggctggcaataatagctgtgctgattgtggtgcttcagagcctgattgggcatccctgaaccttggagttcttttatgcatagagtgttctggggtacacagaaatatgggtgtgcatatatctaaggtaagatccctgacgcttgatgtcagggtttgggagccatctgtaatcaatctctttcagtcaataggcaacacgtttgccaatactgtctgggaagaaatgttaccttcatcaacctgtgttgaccatggtgatatttcaaggcctgatggattagaaaacatgtcacatcgctttgcacccagcaagcctaaacaatctgattctatcgcagtgaaggagaagtttattcatgccaagtatgctgaaaaggattttgtgcggaaacataatgtggatgagattcaacttgcagaacagatgtgggacaatgtaagttcaaacaacaagaagggtgtgtacagtttgattgtggggtcaaatgccgatgtaaatttttcttacggtcatacatcatttaattcggctttgactctgggaaaagctctccttctacaagagcaatcaacttctccatctaatggaagttctagatgttttgatctcaatccacttgagaagggttctaccggggattctgtttctcctgccagcacaagtgcccgtatagatggattggatgattacgttgaaggattatctttgcttcatctagcatgtcgtgttgcggacctgggcatggttgaactactcttgcagtatggtgcaaatgtaaattctacagattcaagagggcggacaccacttcatcacagcatcatgaaagggagacatgtgtacgccaagctactgctttccaggggtgctgattctcaagccgtggaccgagatggtagaacagcattaaagtatgcaatcgacagcggaaccatagaggatgaagagatccttgttttgttagaggacccaagtagataaatcatgtaggtagtcaagtctcgagttcctgcggtaccttgtgcttttgtggccgccttttgcagtcacctggcacacggccgaggatacgtttgctgatatttcttagtttgtggcgagaggaagttatagtttcctaggtctatctgcggttttggtcgcgcttagggtaaagtggcctgttggatccttt

SEQ ID NO: 486 - DNA, 2796 bp, Sorghum bicolor
gttggttgcctagacgttcgccgccgcctctcccctgccccgaccgcgaggctccgtcgccggcgatggcgtcgccggccggcggcgggtctccggctaagcccgtcctcctgcacggcgacctcgacctctggatcctcgaggcgcgcctgctgcccaacatggacatgttctccgagcatgtccgccgctgcctcgccgcatgccgcccgcccagctcctgcgggaccaagcacccgaccgccgccgcgcgcggccccggcggcggccgcggcggccgccaccaccaccggaagatcatcaccagcgacccctacgtcacgctgtccgtgtccggcgccgtcgtggcgcgcaccgccgtcatccccaactcccaggaccccgtctgggaggagcgcttcgccgtgccgctcgcgcaccgcgccgccgagctcgagttccaggtcaaggacaacgacaccttcggcgcgcaggccatcggcaccgtcaccgtccccgccgaacgcgtcgtgtcgggcgacgaggtcgaggactggttccccgtcataggcaccaacggcaagccgtacaaacccgacaccgcgctgcgcctccgcttcaagttccagcccatcgccaacaacccggcctaccgccacggcatcgccggcgaccctgaccacaggggcatcgaggactcctacttcccgctccgccacggcggccaagtcacgctgtaccaggacgcgcacgtcagggaaggggacctgcccgagattgagctcgacgacggcaagacgttccagcacaacgcgtgctgggaggacatctgccacgccatcctagaggcgcaccacatgatatatatcgtcggctggtcggtgtacgataaggtgcggctcgtacgcgagccatcgccgtcgcggccattgcctgagggtggcgaccttacgcttggcgacctgcttaagttcaagtcgcaggagggtgtcagagtgtgcctgctggtgtgggatgataagacttcgcatgacaagttcttcatcaagacgggtggagttatggcaactcatgatgaagaaactcggaagtttttcaaacattcctcagtcatctgtgttctctctcctcgatatgctagcaataagctgagcattttcaaacagcaggttgttgggactttgtttacacaccatcaaaagtgtgtgctggttgatacacaagccaggggaaacaagcggaaaattacagctttcattgggggcctagatctttgtgatggccgctatgacacacctgaacacaggcttttcaaagatcttgacacagtattccaaaatgattaccataaccctacattttcagcaggtgcaaagggacccaggcaaccatggcatgatttacattgcaggattgatggtcctgctgcctatgatgtcttgcttaattttgagcaaaggtggcgaaaggcaacaaaatggcgtgaccggtttagaagagtatctcattggaaagacgatgctttaattaagctggagcgtatatcatggattctaagcccttcacccaatgttccaaatgatcatcctagtttgtgggtttcaaaagaagaagatcatgaaaagtggcatgttcaggtatttcggtcaattgactctggttccctaaaaggatttcctagtgatagcaaagaagcttcaaagctgaatcttgtgtgccggaaaaacttggtaattgataagagcatccacactgcatacgtccgagcaatcagatctgcacagcatttcatttatattgaaaaccagtattttcttggttcttcatatgcttggccgtcctatgtgaattcaggtgctgataatctgataccaatagaactggccctcaaaattgcaagtaagattagagcgggagaacgctttgcagtgtatgtagtgataccaatgtggcctgaaggagtccctactgcagcatctgtgcaagaaatccttttctttcaggcccagacaatggagatgatgtataaaataattgcagatgagctcaaggcaatggacattaaggatatgcaacttgaagattacttgaacttcttttgtcttggaaaccgggaagaaccaccatctaatggcagcccagaatcagagaaatctacagataaaagtgcagcgggcttagctacaaaatatcgacggttcatgatctatgttcacgcaaaagggatgattgtggatgatgaatatgtcattctgggttcagcaaacatcaaccagagatccctggctggttctagagatactgaaattgcaatgggtgcataccaacctcattatgcatggtctacaaagaatggacatcctcatggccaggtatacgggtatagaacgtctctctgggcagagcaccttggaacggttgatgatcgcttcaaggatccttcgagtttggagtgtgtaaggcgtgtgaatcaaatagctgtagagaactggcaaaggtttacagccgaagaaatgagtacattacaagggcacctcctcaagtacccagttaaggtggaggctgatggtaagatcagctcactgccagaccaagaatgctttcctgatgttggcggcaagattctgggagcttcaacttcacttcctgattcgctgaccatgtagagttattattacatttttttttttcagagtcgagcttcgtaattgtctaaacttggtgcaattgtcactgaacttgtactgtatctgtaatcatccatagttggcgcagggaaagctcaaggtgtcggtggtgtttgtagagtcgtgctcc

SEQ ID NO: 487 - DNA, 2106 bp, Sorghum bicolor
ttggttgttgcatttccttggcgaaggagaagcaagccgcccgtccttttgccgctggcgatgctcgccggcagctgcgtctttgtcgccctcgcgctgcttctgccgtcggtaccgccggccgcggcgacccaggagttttactgcgacgattccacctatgcggacaacagcacgttccaggcgaacctgaacctcctcggcgcggcgctccccgccaacgcctccgcctcgccggcagggtacgccacaggcgccgtcggtgcggcgccggaccaggtcaacgggatggtgctctgccgcggcgacacgaacgcttcctcctgctcctcctgcgtcgcggctgcgttccgggacgcgcagcagcgctgccccctcacgaagggcgccaccgtctacaaggacgattgcacccttcgcttcgccggcatccggttcctcgacttcctcagagaggaccagtggctcgtctcagaattggttccctcgattgacccgggccctgggagcgtcaacgccgcagatgcctggttcgacgccgccgttacggggatcttcacggccctggtcgaccgcgcggcggcggcgagcaacgcgacgaggaagtacttcgccacgggggagatggatttcgaccctaagctctacgggctcgcgcagtgcgcgccggatctgacgctggcgcagtgccagagctgcctcggagacctcgagtcgagggtgacgacgcagttcctgagcggacggcccctcgggaacaacgctttccatgtgtggtgctccctgaggtatagtgtgtcgccgttctacgccggccgggcgatgctgcagcttccggcgccgccggcacctccaccaacggccacgcccacgccccattcttcagggaggaaaatgaatgcagcaggaatctctgcaggcataacctgtgttgttgtgttgatgttaattctttcggtctttttctttattcgcttcaggctaaggattaaagtgaagaaaaatgatcactcactgaagaagatagggagagctcaatgcacgatctttgatttgctgacgctggaagaggcgactgaacatttctcagagaaaaataagcttggagaaggtggttttggtattgtgtacaaggggatactgtcagacgggcaagagatagcagtcaagaaacttttaggaagagccgggtctgggttagatcagctacagaatgaggtgcagctactggcagagcttcagcacaagaatcttgttgggttacagggtttctgctcgcatcataatgatacactgctagtttatgaatacatcaagaatgggagccttgacagcattctatttgatgatagcaagggaaatgcacttgactgggagcaacagtacaacatcatctttggaattgccaaggggatattgtatctccatgaggactcaaccatgaggatcatccatcgggacctgaaggcaaataacattcttcttgatgacaacatggaaccgaaaattgcagattttgggttggcaaggcttataggagaaggccacacccatactcagacagccagagttgttgggacattcggctatatggcgccagagtatgtattgcatggtcgtgtgtcgcccaagatcgacatctttagcttcggcgtgttggtccttgagatcgtgaccaggagaagcaactgcaactctgatgaccacagcactgtgaatctccttagtgatgtctgggatcactggaagaaagggacgatgtcgcaaatgcttcatggatcgctgaatgagtttgctcgaagccaagcgctgcgatgcatccacattggcctgctgtgtgtccagccggaacctgacgataggcctgacatatcagccgtagtgttcatgctaaccagggatagcatagagctcaagccgccggcgcagcctgcattcttctttggtagcgaatcaccttcagcttcacggtcagatggtcaaagcagctatgtatatgcccggtctggtttcatgctggaacagggcgtctctgtgaacgggattacactcagtgaactgtatcctagataggatcaaagtctggatactgagctcatggaatag

SEQ ID NO: 488 - DNA, 777 bp, Sorghum bicolor
aaaggatccaagcgcacactcacggtcagagaaaaagctccgacgacagctgagatggcacaagccatggcgtcgatgaccggcctctcgcagggcgtcctgcccagcaggcgcgccgccaacagggccagggcggccgccgtcgtcgtcagggcgtccgccgagggcgaggccgccgcggcgcagccgggccgccgcgccgtgctcgggctggtggccaccggcgtcgtcggcggcgccttgtcgcaggcggtgcacgccgcgaccgtcaattccatcaagatcggagccccgccgccgccctccggtggactccccgggactgaaaactctgaccaggcgagggacttcggcctccccttgaaggatcgattctacctgcagccgctgccaccggcggaggcggcggcgagggtgaagacgtcggcgcaggacatcatcaacctgaagccgctcatcgacaagaaggcgtggccgtacgtccagaacgacctccgcctcagggcctcctacctgcgctatgacctcaagaccgtcatcgcttcaaagcccaaggaggagaagaagagcctcaaggagctcaccggcaagctcttcagcaccatcgacgatcttgaccatgccgcgaagatcaagagcaccccagaggccgagaaatactttgcagcaaccaaagatgtgctcggcgatgttctcgccaagataggctagacggaagggctaataatggccatttaatttcgaacttgtgtttgttcatatggagccggtaccttt

SEQ ID NO: 489 - DNA, 1124 bp, Sorghum bicolor
tccttcctccccgtctacccgtcagctggccgtcgcacccaaaaccccaggctgccagccgccgccgcgacccaccacgacaccatgtccgctgcctcggcgctccggccgaccgagctatttcccctccctagcgggctctccctttcgccgcgcctcaagcttctgctcaccttcttccgcgccgaccttaccgtccggcccctcgacgagtggcagctcaagtccgccctcctcgccttcctccgcgacccgcctctctccctcccgctcctccccgactccgacctctccgtgagccgcctccctgacctccagaagcgccgccgcgaggagcccgtagcctctggggtcctccacgttcgcgacctcaccttcctccgcccccgcaagggcgacggcgaggccgaggagatgacccgggagcaggaggaggagaagtacttcgagtggcggaacaccctggtccagaagctcgaaggcatcgagctcaacctcgagggagtgaagttccggatgaccgttgagatcccgtcgtccgacgacttcagaacgatgaagaagtcatgggaggatttctactcctccgagctactcaatagcaggaatccggtgagaaagatagcaaaaaggccagacactattatcgtccgtggcgtgccttccagatggtttgcggagacaagagtatcatccaaaccttccacgctggtcacccacactattttctcagctcttggtaaaataggcaacctaaaaattgccaatgatgatgagatagaagctaaaggagatggagccagtaaggagctcatatctggacttaattgcaaagtttgggtgcaatttgagaactatgatgacttccacgatgcaatgaaggcattatgtggacgctctttagagaaggaaggatctcggttgaaagtagactatgacgtgacctgggaccgtgaaggtttctttcgcattgctcaatatgagccagctggtaacaattcaggggagagggattcatcagcatcggttcatggccggaggaaacatcacacttcacgcattgagtcagattataggaagagattcagggattgatgacacaggtccatggtatgagcgatatt

SEQ ID NO: 490 - DNA, 733 bp, Sorghum bicolor
aaacaagtcaggtagcagcgtcgtcctccggtcagagctcaagaagcccaccgcgatcgacgcggcgcaggcgagacagcatgggtgggggcacggcggcagagcccccggcgtggatggccgccgccgcgcgcaggtggctggagaacgccggcgccacggtggaggacgccccgggccgggccttcaacgcgctgcccctctccggcgtgcgcgtgtccctcgccgagcgaggccgcgcgctctgctccctccgcgtgccgccccaactcacagacgcggaggggaactggcacacgggcgccatcgcggcggcggcggacgacgtgtgcgccgcggccatcatgtccgtcgagggcatcatcaaggtctccgtccactacgacatctcctacttcacaccggccaagctccatgaggaagtggagatggacgggcgggtggtcgagcagaaagggcggatgacagcggtgacggtggagatccggaagaaggagtccggcgagctggtggccatcgggagacagtggatgacggcctccaggcccaaaggctctcagagcaagatctgaagcttcctttaaatttaatcagtagcttgaaaattaatcagcaagatctgaagcttcgttgaaaattcagttccagatgttactggtgttgatgtcccctgtaatttaatcatgcattggcaagcaagatggaaattttcatctctgtcctgcgttaatcc

SEQ ID NO: 491 - DNA, 1343 bp, Sorghum bicolor
gatccatggcggcggccaagtccatcgaccggctgccggcgcgcctggtggttccggccgagccgacgccagccggcccgctccacctctcctggctcgaccggtaccccacgcagatggcgctcatcgagtcgctgcacgtcttcaaggcggcccccgccaccgctaccggcggcattgacggcggcgccgccgccagcccggccaggaccatcgagcgcgcgctggcccgcgcattggtccactactaccctctcgcgggccgcctggtcctgtcggagtccggcgcgcagcaggcggtggactgcagcaacgccggcgtgtggttcacggaggccgaggccgcctgcaccctcgaggacgtggactacctggaggccccgctgatgatccccaaggacgacctcctcccgcccacccccgccgcaggcgacgaggaggacgagcgcgcgctcgtcctgctcgtccaggtcacctccttcgcgtgcggcggattcgtcgtcggcttccgcttcagccacgccgtcgccgacggcccgggcgccgcgcagttcatgaacgcggtcggggagctggcacgcggcgccgaaaacgcgttgtcggtggtgccgcagtggggccgcgacgcgatcccggaccccgccgccgcgctggtcgggcgcctcccgactcccgacgccgacagcaagcggctcgagtacctcgccatcgacatctccgccgactacatcaaccacttcaaggcgcagtacagcgcggcgcacgcgggcgccgcgtggtgctccgcgttcgaggtgctcatcgccaaggcgtggcagagccgcacccgcgcggccgggttcgacccggactcccccgtccacctctgcttcgccatgaacgcgcggcccatgctgcacgcctcgctcccgcgtggcggcgccgggttctacggcaactgctactacatcatgcgcgtgtcggcgcccgcggggaaagtggccgggtcctcggtcacggaggtggtgaagatcatcaaggacgggaagcggcggatgcccgcggagttcgcgcggtgggcggcgggggaggtgggcgccgccggcgtcgacccgtaccagatcacgtccgactaccggaccctgctggtgtccgactggacgcgcctcggcttcgcggaggtggactacgggtggggcccgccggcccacgtcgtgccactgacgaacctggactacatcgccacgtgtatcttggtgaagccgtgggcccacaagccaggggcgcggctcatcacgcagtgcgtcaccccggaccgcgtcgccgccttccacgagggcatgctcgacaccagctgttgatga

SEQ ID NO: 492 - DNA, 1649 bp, Sorghum bicolor
tgtcggaatggtcgtttaattggggagatttgatgtgttgttggtgctgccggatctcgccgacatgtggaagcaatttattggaaagctgtcgtggaaggcgatgaaatccagctctggcggcgggggcacgggctcgccgcctgcgaagctgccgccgcacctaccatcgccgcgggagaatggggcctcgccgcgggagaatggggccacgccgaagcccaacgtctcgcctccgtctcccgcggcgggagccggagccggggccggagccgaggtgaggtctagggaggacgcctttgtccagaaggttaacatttgctgcgcggtgtacgacttctccgaccggggcaaggactcgccggagaaggagcggaagcggcagatgctcatgtccctggtcgactgcattggcgctgctgaggagcccctcacggagacaatgatagcagcgtgcgtgcgcatgttcgccgctaacctgttcagggtcttcccgcccaaagtccggtctggcacctcgacttcggagaccgaggaggacgagccgttcttcgatccgtcctggtaccacttgcaagtcgtttatgagtttctccttaggtttgtgacttcgccgctcgtcgatgctaaggtggctaggaagtatgtggatagccctttcgtctccaagctgctcgatctgtttgattcggatgacccaagagaaagggactgcttgaagacaatattacatcggatatatggcaagttcatgggaaatcgaccattcatccgtaaggctgtgagcaatatcttctataggtttgtgttcgagacagatcatcacaatgggatcgccgagctgttggaggtctttggcagtgtaataagtgggtttgccaagccattgaaggaggaacataagttgttcttatggaaagcattgataccacttcataagccgaaatcagtgggagtgtatctgccacagctgacatattgcatcacacaatttattgagaaggaaccaaagcttgctgggactgtgatcagaggcctgctaaagtattggccagttacaaatagtcagaaggaaattatgtttttgggggagttggaggaggtgctggagttgactgacatggctgaatttcagaagtgcatgactcccttgttccgaaagattgctagttgcctgaatagctctcattttcaggttgcagagagagccttgttcctatggaacaacgagcacctattcgatatgatctcccaaaaccgtcaagtgatcctaccgattatatatccagctctggagcggaacacccgctggcactggaaccaatcagtcctcaatgtaacaatgaacgtgcggaaaatgttccgtgaaatggatgagaggctgcttctagcctgccaaaacaacttccaagaggaagaggagaagcgagccgcgactgaggagcggcggaggctcatgtgggagcagctggagcggagcgctgctcgtgggcatcaccaacctgtgatcgccgcagacgcaagctttcctgcgcccccttcgtcggctcgtcttgtagccccaaccgtgacatgagaatgagattgcaacaaaacgtgctccgttttcaccaccttggtagctaagctagatgaagttgcttgcttca

SEQ ID NO: 493 - DNA, 1381 bp, Sorghum bicolor
gggcgtctatttgtacctgaagtctgacctgaccttgctgccggagaacaccctgactgcgatggcggcggcggcggcggaagctccgagcgcatcggcctcttccgcggagaacaggctcctgcagtccctcgcagaccgcggatggcgcttccatgaccccaccgacgaggccatccaggccctgctcctcgcttcccccactccctcgtcggaggccgtggagtccgagctcgtcgacatggacttgaggttgttcggcgtcaagtaccttcccgaccgggccaccgccgccgccacgtcgaagcggctttcatacctccacggtcccgtcgtcttgcaggtagtctctgtaagggatatatatcgcagcatcattgatgcctcctttaagaacccacagcagcgtcgtcttctgcgctttggtctgactgatgggatatgtgaagcagtagccatagagttttctcctatcccattcatcactgaagagatagctccaggtgccaagattcgccttgagaataagattccaatcaataatggcatattgtgcttaagcgcgaaaaatgtgagtgtcattggggggactgtccaatcattgtatgaagaatggcagatgaaccagaagtactctggcttatctcgtccatccttgaggttgtctcaaagtgatgatggagttgggcctccaccatttgagaagttagacattgaggcacgtccctgcagggcaaccaaagttcaagcatatcctgctaggaagttggcagatactcatgaccatgccccagttaattctggtggcaaaccaatgaatgaggattcgaacgatgtgaacaaagacactattgaaagcaaggctgaatctaaggaaattactcaagatagcagacaaaaagaagtcagtgaagctgttcctgtccaaaaccaagctgctgctcagaagctactgcagaaaatgtcacaggctatgcctgaagacaggcgtggtcggggtcatagattcaagggcaaaggtaaggaagaagatgctcaggtttttacccttgatgaatgggagaagaggaaagccattggtttgaagcccgcagcagaaagctatgtgcatgacactagccgagatgaggagttggcaaggcaactgcaggaacaactagatctagaagatatgcatggtggggcagatgttttcagtggtggggcggagagttcagatgctgaacgtttacggatgagcatgttcagcttcagtggccctgatgaagcaggtggtggtagaagagattttcgaggcaggggccggggcaggggaaggggccgaggacgaggaaggggcagaggaagattttagtccagcgatacagttggaggtttatag

SEQ ID NO: 494 - DNA, 1574 bp, Sorghum bicolor
tgaaaccctagccctcctaaaccccacctcactccccgagccatcccctcactccccgcgtcggcgatggccaaggcgctgctctcctcctccctcctccccgcgctgccccgcgccgccgggggcagcgcgagcaggccgctgctgctcccgccgctccgtctgcggcgcggcggccggcgcgccgcctccgcgtgcgcggtgagggcgggcctgcacgggctcgactccgtcggcgggccccacctccaggccacgctggagcgcgccgaggcggcgctctacacgctcgccgacgccgcggtcgccgcggcggacgcggggggcgacgccggcgaggcggctgcggcggcggtccagaagaacggcggctggttcggcttcatctccgaggccctcgaggtcgtgctcaaggtcctcaaggatggtctctctgcagttcatgtgccatatgcctacgggtttgccatcattctgctcactatcattgttaaggcggtgacgttgcctctaaccaaacagcaggtggagtcgactctggcaatgcagaatttacagccgcagcttaaggcaatccagcagagatatgcgggcaatcaggaaaggatacagctagagactgctcggttatacaagcaagctggtgtcaaccctttagcaggatgttttccaacattggcgacaatacctgtatggattggtctttaccaggcactttcaaatgtagcaaatgaggggctgttcacagaaggatttttctggattccgtcactgggaggtcctacaacaattgcagctcggcaaagtggttctggaatttcgtggctcttcccatttgtggatggtcatcctccgctaggctggcatgacaccatatgctaccttgtattgcctgtgctacttgttgcttctcagtatgtctctatggagatcatgaagccacctcagagtgatgacccatcacagaagaacacactgctcattttgaaatttcttccatttatgattggctggttctctttgtcagtgccgtcaggattgtctatttattggcttacaaacaatgtcctcagcacagcccagcaagtttggttacggaaaatgggtggagcaaagcctgtagtgagtaagggaggtagtgggataattacagcaggacgagcaaaacgctctaatgctgaaccagctggagagaggtttaggcagctaaaagaagaagagaacaggagaaaactcagcaaagcacttgctgcaggagattcagatgcatcatcatcaacatatgacatggaggatgaagaattagatgatgagaccacagaagagggaggacctgtggaggaagcatccagtactggcagtgacaagaaacttccaagttactcggggaagaagggcaaacgatccaagaggaagcgcatggtgcagtaatcgttacagcctaattggatgcattttttgtcacaactggttaatttagttgaccagttaggtgccacagttgatctcggagacagttttggtggtctgttggaggcctatatttgaggtgcagacaaatagacgatttccgg

SEQ ID NO: 495 - DNA, 1625 bp, Sorghum bicolor
gcatcctttgcattgtgtttaggttaggaaaattaaaagaccagcagctattgctagtaactactcctatatatatacataaccggctggcaggcaggcccatgcgattaacgcggcggcagggcagggcaggcgcagccatggagaaggaagagccggcggcggcagagcttgagatccccggcgagtgccagtacgcgggggatcccgtggtggtgcggccgagccagccgacgccgcgccacaccctgcacctctccaacctcgacgaccagcggttcctccgtttctccatcaagtacctctacgtgttcgcgtcccacgccgccgtgtccgccgacgcgctgcgggcggcgctgggaagggtgctcgtcgactactacccgctcgccggccggctccggcccagcgacgaggaggaagggaagctcgtcgtggactgcaatgccgagggggcgctcttcgccgagggacgcctcccggggctcaccgccgccgacttcctccgcggccgcggcggcgccacgccgcacaagtcctggaggaagctgcactacagggtggaggcgcagagcttcgtcgccgtgccacctctcgtcgtccaggtcacttggctcggctgcggcggcatggtcctctgcaccgccatcaaccactgcctctgcgacggcatcggcaccgcgcagttcctccacgcctgggcgcgcgccgtgcgcggcggccaagatgcaccgggcgccggcgccgacgacgacgacgacgttgccctgccgttccacgaccgccgcgcactgcgcccgcgctgcccgccgcgcgtcgcgttcacgcacccggagtacagcagcagccgcggcatcagcggcgccgtagtcggcaacggcaacggcaacgggaacgcgaacgaggcggcgccgagcctgctggcgcgcttgctggggcagccgctggcgcccgtgtcgctcaccttcacggcggcgcacctgctccggctcaagcggcagtgcgcgccgtcgctcaagtgcacctccttcgaggcgctggccgcgcacgtgtggcgcgcgtgggtgcgcgccctggacccgccgggcgcgctccgcgtgaagctgctcttctccgtgaacgtgcggcggcgcctgaagcccgagctgccccggggctactacggcaacggcttcgtgctcgggtgcgccgagtccacggcggcgcagctggtgaccgctgccccgtcctcggccgcggccgcgcgctacggagtgcggctggtgcaggacgccaaggagtgcgtggacgacgactacgtgcgctccatggtggacctcctggaggagcggcgcggcgcccggccggacctggcggcgagcctggtcatctcggcgtggacgcgcctggggctggaggacctcgactttggcgccggcaaggccgcgcacatgggcccgctcaccagcgagatctactgcgtcttcctccctgtaatgggcgacccgcaaggcgtcaccgtgctcctctccgtcccgcaggccgccgccgacaagttccagcactgctgcctcgaattcctcaaggacaccgacgtggacgcaaagctcagctgatcgagctatatcatccggctgctagcttag

SEQ ID NO: 496 - DNA, 1446 bp, Sorghum bicolor
gagccaacaacccatggccgccgcggcgccgcctctcctgctcgcgggcctcgccctcgccgtcgtcgccgccgccgtctggccgtccctagctgcggcgccggcggcgctgcaggacccggcggagctcctgcgcagggccaaggagccggcgttcgcggactggatggtcggggtgcggcggcggatccacgagaacccggagctgggatacgaggagttccagaccagcgagctcgtgcgccgggagctcgacgcactggggatcccctacaggcaccccttcgccgtcaccggcgtcgtggcaacagtcggcaccggcggcccgcccttcgtcgctctgcgcgcggacatggacgcgctgcccttgcaggaaagtgtggaatgggaacacaagagcaaagttcccgggaagatgcatggttgtggacatgatgcacatgttgctatgctgttgggatctgctaagattcttcaggagcatcgtgatgagttgaagggtacagtggttcttgttttccaaccagctgaggaaggtggcggtggggcccagaaaatgatagaagctggagctctggaaaacatagatgccatttttgggcttcatatagctgattctgtgcctattggtgtactggcatccaggccagggcctattatggctgggagtggattctttgaggccgtaataagtggaaagggagggcatgctgcacttcctcatcacactatagatccgatattggctgcctcaaatgttattgtgagccttcagcaacttgtttcccgagaagctgatcccttggactcacaggttgtaacagttggaaagtttcaaggaggtggagccttcaatgtgatccctgattcagttactataggcggcaccttccgagcctttctgaaagagagttttaatcaattgaagcagcgaattgaagaggtgattgtgtctcaagcatccgtgcagcgctgcagtgctagcgtggacttcctcacaaaggaccgtccattcttccccccaaccatcaacagccctgagctccatgatttcttcgtgaatgtggccagcgagatggttgggtcgaggaacgtgagggacagacaaccgctaatgggtgctgaggacttctcgttctatgccgaggcgatcccctcaacctactactactttgtgggcatgtacaatgagactcgtggaccgcaggcgccccatcactccccctacttcaccatcaacgaagatgccctcccctatggtgcagctgcacaagctgctttggcagctcgctatctactcgagcatcagcaacctgctgctaccactgataaggcaaaaccccatgatgaactgtagatacataacgtttgcttcgctctgttaatgaaattagattgagcaacaatttctttgccaagctattccacggctgtacatatcctgat

SEQ ID NO: 497 - DNA, 2155 bp, Sorghum bicolor
gtcagcggaggttgttatgagtcctgactttctaaccaagtatatataacagagttatgatatccagaaggcaggaaaatgtttcttttcattttctagttggtttgcatttgatgttatgcaattggaatggacacaactactggagacctcgagtttagtggtgatatcaacttcttgaagccatattgctcttggagcacaactcaagacacgactgtgcacaaagatagtacaccagaggcttattccagcctttttatttccaacccagaagcgtcaaaagggaagcaaggtgctatgtctagagcaaaaggtactggaaaccctttactcactttgggtttaggccgctcaccaagttcatctgataacagcaagctaagttctggcactgcttgcataacatcttcatctttattaaaggaaattgatgaggagtcttcagtagatcttggccttaaccttgggtttcatattggcaatgatattgcacactgccgacagaaatcccatgctagttttgaaaatatgctctcgacaaactctcctaaactggatcttcagttgagtttatctattggttcacctgaatcagttgtcatcgatgcaaatatgatgtcaccagatggcatggtgatgccgacgaccaatttgccacccgccactgtagaagaaggatcagtaccacctagttggggttttgagcattcgattgtttcatcatcatatgcttctgaagcaacatatgcccctgtgccttctcctgtcatgtcatcaactatgtttacaagtgtgaaaagtccagttgcctctacttttgagacaactaattcccaactacgcaacaataacacaaaaagctgtcagtttccaggatgtatgaaaggagcaagaggggcatcagggcgttgcatagcccatggcggtggtaagcgttgccacaaatctggttgtcagaagggcgctgaagggaggacaatctattgcaaggcccatggtggaggcaggagatgtcaatttcttgggtgtacaaagagtgctgaagggcgcacagaccactgcatagctcatggtggaggccgtcggtgcagtcatgaaggttgcccccgagctgctcgtggaaaatctggctcgtgtatcaagcatggtggtggcaaaaggtgtcagaaggagaactgtaccaaaagtgcagaaggtcattctggactctgcattgcccatggtggtggaaggcggtgccagtttccagactgcacaaagggtgctcaaggaagcacaaagttctgcaaggcacatggtggaggaaaacgctgcacattcttcggatgcaccagaggggctgaaggtagcacttcattttgtaagggccatggtggaggcaagcgctgcgcctttcagggtggtggtgtgtgcccaaagagtgtgcatggtggcactcagttttgtgttgcccatggtggtgggaaaagatgtgctagccatggctgcactaagagcgctagaggtcgtacagagtattgtgtgcgccatggaggtggcaagaggtgcaagtttgaaggctgcaccaagagtgcacaggggagcactgatttctgtaaggcccatgggggaggtaaacgatgttcatggggccaggcagacacaagctttggtgctggtgcacagcaatgcgatagatttgttcggagcaagactgatctatgctcagctcacagcgctttagtccaggaccactgtgttcatggcggtggtacattaggttctgctatctaccagtttgcggtggatgtcaaacctactgagatgaaggttgctttagtgaagggagatccacgcgagaagatcaacggtgataaaattttactggatccgggtagctctgttccaaatagtggtgttcatcatcctgtcctggttcagtctatggtcgatccactgccagagggcagagttcatggtggtgggctgttggctttactttcgcgggccggaagcagaacaagcaacggtggctcagaattgtactccgggcaaggtggtgtggatgtgaggctatcaggttctccaagaaattgattgcctacagttttgatcagttcccaagtttgtgctgtgatggactgagtcagcctttcagattcctccaaggttg

SEQ ID NO: 498 - DNA, 1148 bp, Sorghum bicolor
attcccgagctgttgttgtggtgggaaatgaggatctgcgaattgggagacggtgacggggggctggtgcttcagcaggagcagcaggaggaggctgttcaggcgagcggtggcggcgagctcgtacggcttaaggcgaagcgcgcgctcgtcggcgccggcgcgagggtgctgttctacccgacgctgctctacaacgtcttgcgcaaccggtacgaggccgacttccggtggtgggatcgcgtcgaccagtttattttgcttggcgctgttccttttccaagtgatgttccacgattgaagcagcttggagttcaaggggttgtaacgttgaatgaaccttatgaaactcttgtcccaacatctttataccaggcgaatgagattgagcacctggtaattccaacaagagattatctctttgcaccttcactcgaggatatttctcaagccatagatttcatccaccggaatgcattacaaggcggtactacgtatgttcattgtaaagctggaagaggacgaagcaccactattgtattgtgctacttgattaaatacaggaacatgacccctgaagcagctttggatcatgtccgatccattaggcctagagtgcttttggcaccatcgcagtggcatgctgttaggtcatttggaagtctcaccactggacaacttccagttcggagtacgaacctgggctgcttcttagaagccattgaagctcgttgtatgaacacggaaaatgatgattaccacgtgatggagtttgactgcgaagatagtggcttaccactttctcaaattatgctatctaagccagccagccccactgggtgcaccgatgcagtcctcataacagaagcagatcttgagggctatgatacttatattggtactaggaaagatgccgtgtcattggtagtagccactcgcaggcccatcatgaggagattgtcctgcctctttggctccctgaaacttaacagcagcagttgtgaaccagcttcaagccggttcactgaggttcgtgcctgctaggtagtgtctttctccagttttccatgttgaatcaagagtgtatctctagataggcaatcatccaaataggatttgtagaagcctgagtttatagccatggcagt

SEQ ID NO: 499 - DNA, 1601 bp, Sorghum bicolor
gattccatgggtcaatgacgggtgggtccggtcaggcagggcgggtcaacgcccgccacaacggcggcagcggcatctcgaggcttgctctttgtttggaggctgacacgtggggcccacagcacagccacagcggcagaaagaagccccaagcccccaaccgaacaaaaacgctatcgttctcgtcgggagccgcgacggcgcgcatggcggcgacggcggcggcgcttcggtgctgctttcccggctcctccggtgtcggcagtggcttcgtgaaagccaaatcgtccaggcgaggctggtgcgcagcggccgtggcggcgccgtcgcgggaggcggagccggtttcgtcactggggcaccgtacccgcgtcgacttccccatccttcaccaggaattcgatggtgctaaattagtttacttcgacaacggtgcaacatcacagaaaccttatagtgtgatgagaacactagatgagtactaccgatcgtacaattcgaatgttcatcgtggtattcatgcactcagcgcgaaggctactcaagcatatgaggatgcaagaagaaaggttgcaaattttgtcaacgcagctgatagcagagagattattttcactcgaaatgctactgaagctatcaatctggtagcctattcatggggactatctaacttgaaagaaggagatgagattgtccttacagttgcggagcatcatagtgctattgttccatggcaatttgtttcccagaagactggtgccaccttgaagtatgttggattgactaaagaaaatgccccagacattgagcagttaaaaaggcttctgtcgaacaagacaaagatagttgttgttcatcatgtcgcaaatgttctaggttccatgcttcctattgaggagattgtaacatggtcaaacagagttggagctaaagtccttgtagatgcttgccaaagtgttccccacatgccagttgatgttcagaaacttggcgcagactttcttgtcgcatcctctcataagatgtgtggccctacaggcgtcggatttttgcatggtaaatttgagattttgtcatctatggagcctttcttaggtggtggcgaaatgattgcagatgtattccaagacaaatccacatacgctgagcctccctctagatttgaggctggaactcctgcaattggagaagctataggattgggagcggccattgattatttatcatgcattggcatggagcagatccatgaatatgagaaagagttggggacatatctgtatgaaagccttctttctgttccaaatgtccagatatatggtccagcaccttcccaaactgttcaccgtgctccgctgtgttctttcaatattgagaatgttcatcctacagatattgcagaaattcttgatctgcagcacggtgtagcaattcggtcagggcatcattgtgcacagattttgcataggacccttggtatcactgcaagtgctcgtgcaagtcttcacttctacaatacaaaagatgaagtggataccttcatcgatgcgcttaaagccactattgatttcctcacgtctaaatactagtgtggttcgtaa

SEQ ID NO: 500 - DNA, 856 bp, Sorghum bicolor
ctctccacctccgacgaccaccaccaccatggcggccgcctccctcgcgcgtctctcccgccgcgccaccgcctccgcctccgcggcggcgccgtccctccggcgcctcctctcggccacctccaccgcccccgccgcggcatccgccccgccgccgcccccgagcgcggccgccgccgcggccgtgggcgcggatcgggtgcggtgggactaccgcgggcagcggcagctcgtgccgctgggacagtggatgcccaaggtggccgtggacgcgtacgtcgcccctgaggccgtgctcgccggccaggtcaccgtccacgacggcgcctccgtctggagcggcgccgtcctgcggggggatctcaacaagatcacgctcggcttctgcgccaacgtccaggagcgatgcgtcctccatgccgcatgggcggcgcccacagggcttccagctgagacacttgttgaccggtacgtgacagtgggtgcctactgtctgctgcgctcttgcaccatcgagcccgagtgcatcattggccagcactctatcctcatggaaggttcgctggttgagaccaactcaatccttgaagctggctctgtattgcccccaggaaggcggattccgaccggtgaactctgggctggaagcccggctaggtttgttcggaagctgaccaatgaggagatcatggagattccaaagctcgcaactgccatcaacgatctgatgcaaagccatttctcagagttcctgccttactctaacgcttatttggaggtagagaagttgaagaagtcgttctcgatccccctgtaagagtatgttgccaccctcgtccagctgagtgaatgagga

SEQ ID NO: 501 - DNA, 1003 bp, Sorghum bicolor
caccgcaagtaagatcaaggaggaggcgatggctggcggcgggcaggcggcggtgtcgttcctgacgcggatggcggcggcggcggcggggttgggcctggcggcgtccgcggcctccacgtccttctacacggtggacggcggggagcgcgccgtcatcttcgaccgcgtccgcggcgtgctcccgcagacgacgtcggagggcactcatttcctggtccccatcctccagaagcccttcatcttcgacatccgcactcgcccccacagcttctcctccacctccggcaccaaggacctccagatggtcaacctcacgctccgcgtcctgtcgcgccccgacgtcgaacacctcccggacatcttcaactccctcggcctcgagtacgacgagaaggtcctcccatccatcggcaacgaggtgctcaaggccgtcgtcgcgcagttcaacgccgaccagctcctcaccgagcgtccccacgtctccgcgctcgtccgcgaatcgctcacccagcgcgcccgcgagttcaacatcgtcctcgacgacgtcgccatcacccaccttgcctacgggccggagttctcgcaggccgtcgagaagaagcaggtcgcgcagcaggaggccgagcgctccaggttcctcgtcgcgcgcgccgagcaggagaggcgcgccgccatcgtccgcgccgagggggagagcgaggccgcgcgccttatctccgaggccacgaccaccgcgggcaacggcctgatcgagctcaggaggatcgaggcggccaaggagatcgccggcgtgctggcgcgcacgcccaacgtctcctacatccccgccggcaacaatggccagatgctgctcgggcttaacgccgcccggtgaatggatcgtctctttccccgtgattagttagtgcctcagtgtggcctattgaactacttcagtaatttcagatagttatggttttgtggtacgattcgatgatggtgatatgcgttgctcataaag

SEQ ID NO: 502 - DNA, 961 bp, Sorghum bicolor
catcagtaaccaactcagcaggctcccgtcccgaccaccagataagctgcaagctgcttatcttctcccgtcccctgcaactggaaggaaggaacacgtccgcgccagccaagcagagaggggatcccgcatccatggaggtggtgggcggcgtttcgctgaggccgtcgccagcgccggcgcgtatccgacggaccaccctgtcatgcgtcgacgtaggccgacgcctcgttctcaggcccgcaggggcgccgctgggccagctgccggcgaggcgcgcgctggtagtggaggcccgggggaggagctggtcggaacggcagatgcagcagcagcggcgcatgccgcagctgcccaagatcgaggacgacggcaacccgcgattcgtcatcttcatccgcaccgccaatgtctacttctggtacccgctcaacatcatcacgggcgggacgacggcgaagatcatgcttgctgctaaggacaacttcctcggcaagtacatctacaaggacacgctcgccaggaacctcgctgccgtcatttacaaagatgaggatgagattatagacacagcaaaagagcagtaccgtgtgctcaagaccgaaaatgagtttcggtatggctacaaagttgtggagaaagggaacataaggtctgctctgacgacaagcaatgtgattgaacttccaaagaaagacgagctcaaaactgtggttgacaaggtgaaggacttctttggcgatgtaactgctggcgccaaagaatcctttgcgcagataaccgggtctgctgtcagcaaagaggaagaggaagcagaaaacaaagagaagttccgctccaagaggcgaaagaagcagcggaagtcgaaggagggcctcaagacggagaaatgattcagtcactcagcacattgtcagacaagtaaagcatcgatcggctgtagtttcgctatccatgtccc

SEQ ID NO: 503 - DNA, 1034 bp, Sorghum bicolor
aaaggatcccaccaatccggaaaggaaaggaaagggaagtgatgggggagtgcgaggacggcaaggagtacaggtgctgggaggagctgttgccggacgcgctgggcctcatcttccgcaacctgccgctgcaggagatgctcaccgtcgtgccgcgggtgtgcaagtcctgggggcgggtggtcgccggcccctactgctggcaggagatcgacatcgaggagtggagccagcagcagagcaagccggaccagatcggccgcatggtcgagctactcatcggccgcagcggcggctcgtgccgccggatcagcgtctccgggctgccctgcgatccgctcttctcgttcatcggagacaacgcacgagcccttcggacgttggagattcccaggagtgagatcagcgactcgatcgtagaaaccgtggcgccgcggctatcaaacgtcactttcctagacatcagcagctgcaccaagatcggagcccgtgccctggaggctttcggcaagcactgcaagtccctggtggggctccggcgggtgatgcacccgatcgacctggtggacaaggtgtgccagcacgacgaggcgcacgccatcgcgtgcagcatgcccaagctccggcacctggagatggggtacatgctgatcgcgacggaggcggtgctggagatcctggggcagtgccgcgacctcaagttcctggacctgcgcggctgctggaccgtggacgacaagttcctgcgggagcgccacccggggctccgcgtcctgggcccgcgcgtcgacgactgctacgagaacagctactgggaggagtgctccgactactcggacgactcctccatctactcgtgggagttcatggacgacgactactacgccgtcggaagcgacgacgaggccatctgggacgacgggcagggactggagaacctcgaggtgaggttctacggcggcggattcagcgagagcttcgccggcttcgactggccaccgtcgccgtgagaccttccgggttaaggtaccaaa

SEQ ID NO: 504 - DNA, 1148 bp, Sorghum bicolor
aaaggatcctcctaatcctgccatccatccagagtccagggggcgttgccgcgttgcgttccgctctcccttttctgctgcgacggctggtcgagcgccggcgccgccacccttcgccagctcttcgcaggcgacgagcaccgaccagacatgggggaaggtggagaagagaagtcattcaatttccttcaagttttgctcgagggcagcatagccggaggaactgctggtgttgtggtggaaacagcactttacccaattgatactataaaaaccaggcttcaggctgctcgaggtggaagccggattgaatggaaaggcttgtattctggattagctggaaatcttgctggtgtccttccggcctctgcaatatttgtcggagtgtatgagccaactaaaagaaaattactggagacacttcctgaaaatctgagtgcagttgcccattttactgcaggggccattggaggtattgctgcttcccttgtccgtgtccctacagaggtggtcaaacaaaggatgcaaactggtcaattcaagtctgcacctgatgctgttcgtctcattgttgctaaagaaggatttaaaggactgtacgccggttatggttcctttctacttcgagatcttccatttgatgccattcaattctgcatttatgagcaaattcgaattggctacaaagctgtggcgagaagggagttgaatgatccagagaatgcacttattggtgcttttgctggtgccatcactggagctataacaactccccttgatgtcatgaagacaagactgatggttcagggacaagggaaccaatacactggaattgtaaactgtgctcagacaatcctcagggaggaaggccctaaggcattcttgaagggcattgagccgcgagtgctgtggattggcatcggcgggtccatcttctttggtgtgctggagaaaaccaagtcgatgctagccgagaggaggaaccgcgagctacgggccgtcaaggacgaatgagtgaagatcatttttttaacgttgaattcctatcatgtgaaactagataaacaaaatacaccagggccttctcgtactccagggcgttcacgttatcacgtacacgtcgaacttgaccaataagcggtaccttt

SEQ ID NO: 505 - DNA, 953 bp, Sorghum bicolor
ttgcactagctcatttcccaacgcgcacccaaacatggccgctccgaccgccggcgtcgacaccaccgccccgcctcctcctccctcggcagagcccgcggctgcacccgcaccggatcaaaaggtctctcctcctcctcatgcccctcagcccgatgcgcctgcgcccgcggcagcaccggctcctgcgcccgtgcccgcgccagcgccgaggaagcggaagctcgaggaagcggggttccacacctccgaatactacaagatccgtgccgtcgtcgccgacctgcgtgtccgcttcgtccaggtttaccaagctactgatttccgcaacacggatgctgctcgtgagattttgaaagaaataaatgtggtcatggatctatccaagaaaatgaggctcaagcttggtgctacttctgagcccgtgaaaccattggagaaaccttcagctggatttgtgaaggatgagcttgtgaaaccatcagagaagctttcagctggacctgtgacagaagagcctgtgaagccaacggagaagccttcagctggacctgtgaaggacgagcctgtgaaaccatcggagaagccttctgctgaccctgtgaaaaaggaacccactgagccagttccagctggagaaaacaatcaagctcctggggttagccagactacaattcctccaaatgatgcaggtgttggtgcaccagtagtcaagcatgataactcagaggcgcagaagtgaagatgatagaggaaacccaaagtcccgatccattgagatggcagatcatgcaaatctgctcgacaaaaatgcagagtgattggttgaacccctaggggctcagattttcttgcctcttctggaggtaaaattgattgctttgggctaatcgacgaagagtggtgggcatatcaagatccaaattagatggtgttcagttgttcgcattcat

SEQ ID NO: 506 - DNA, 2751 bp, Sorghum bicolor
ttacgatggtggacaagaatgatgggtcagagggtcttaaattcaacacgtcaaacctcattcaaacaaccgaagaggttgcaagagcgtttattgctgcggcttcggctgccactgcacagtctgcacggccatctgtagtgtattcatccaaagatgagagtggcagcccaatgcagaagcttcagcagcaattctcgaaaatcatgaaagggtttacgtcctcaccggacctgtcaggaacttacaatccagaagtgcttacaactcaaaagcggcagtggtcgaggtaccagctgaagtcattgggtgataggtgcatcagagaaccatcacatctgttcgagagcatagtgattgttgggcttccacctaacgcagatatccaggagctggaaaacattgcactagggagaaatgatgaagatggaaagagatcaagaaatttatttagcaatagccaccaccaagttcacgcaatatcaaatttggaaccacaggttctttttgcgtaccctccagagaagcctcttccactcaagtacaaggataccctctctttctgccttcccggaggtgtacaggttcatgctgtcgaacgtactccttcattcagtgagctgaatgaaatcctcctgggacaggaacagcttaaagaaagcaaccaatcatttgtgttccgcctacaggttgctgataactctgcattatatggatgctgtgtgctggttgaagagattgtacagagaccatcaaagttggtatcgatgctaatgaatgacaaacccatctttccacgccggagtcgatacgtggtaactacgccccggtgttattgcatcctgtccaggcttccgttctttgaactgcattttggggtgttgcagagtattcttatggaagaacgtctggagtggctcactgatggtgttagcatgctaacttccttatcgcttgaggaatcctgtgagaacgatatctgtgaaggaactgaagttacagcacagaaacagtatttagatagtaacacaattgatgtggataaatcatctgaatctagcatgggagtttcatcaaaggagctatctgacactgacagcagttttgggtgtagagagaaccagcttgactttgtttctaaagaacaacagcaaaatagttcttgtgataaagagcagagtgatcgtaaaagagaaattatcacttgtgatgcttctgaagtgtctgatcattttgttcctgaagatacatcatctgatcagtctggagctaagcatcatgaacttgattctgcatcaggtatccaggatgaatctggtgcaaagaactgtgatgattctccgaagggaaatgtggatgatgaggagcttgatctcttcattaccgatactattttaccacttatgcgatctcgcctttgtgaagattgtgaatcatctccaagttcacagggttctccttctagaaatttcgacacccaggaatcggattcagaggagccatcttccatcggtgatggggacttagttagacacaacaacatactgcagtgggctaaggcaaaaaaatatggttctttgcaagttgtctgtcaatactaccagttacagtgtcctgctaggggttcatcacttacttttcatcccttggagcatttgcatcctttgagttttcaccggccaggtgaaacagttcttcacattgctggttctactattgagcttaggtcacgcgatacaagcttagaagttgctgagatgcgtaattcactcttcgctgaggaggaatcgactgctttatccacatgggcggtggcatccatttgtggatgcctaaggttggaacatgtaatgacactttttgctgctgcactcctggagaaacagattgttattgtctgttctaatctgggaatgttatcggcttcagttttgtccatcctacctctaatacgaccgtatcggtggcatagtctcctcacgacggtcttgcctaatgacatgatggattttctggatgccccagttccatacatagtgggtgtacaaaacaagacatctgatgtgctcaacaggctaccaaatgccgtggtcattgatgccaacaggaatcagattaaatcttcttcagttccgcaactaccacagcacagagagttgctttctgccttgcgcccgtatcattcaatacttgttggcgaaagttatcttgcaagaaaacgtcctgtttacgaatgcacagatgcccaggtggaagcggccaaaggtttcttggcagtgcttagagactaccttgacacactatgctcgaacttgagatctcatacaattaccaatgtgcaatctaacaatgacaaggtttccttacttttaaaagagagctttatcggttctttcccaatccgggataggccttttatgaagctttttgtggacacgcagttgttctcagtacagacagacctagttctctccttttatcagaaggactaagtgtctgacagacttgaatgtctgtctcatgttgccaagcctttagatgttgagctaaactgtacatatcggcttagaaagaatgagctgccttcgtcattttggcagctgagtgtgttaagagctggggtattgaagaagaatgcctatagctgttgtaagttagtctggtgcggtgatccgccatctaaggttttgtaggctgttgtaggctgatgcttctatggattgttcctgcaatacctgtgctgtaatggaa

SEQ ID NO: 507 - DNA, 1115 bp, Sorghum bicolor
atccacagtcgctcttcttcatcctcatccacagtcgtgtcctccacagtccacacgtaccggcgccctgcactatagttgctgcaatggcggcggcgcttgctgcatcatcagcagaggcggctcttcttctcctagtattattggtacgactcgccgcggtggcgctgagatgcggcgaggggctgagcctggctttgtatgacgagagctgcccggaggcggaggcggcggtgacggcggccgtgcggcaggccatggcaaacgaccgcaccgtggcggctgggctcctccgaatgcatttccacgactgcttcgtcaggggctgcgacggctccgttctgctggactcgacgggcaccgtgacggcagagaaggacggcccgcccaacgtctcgctgcacgctttctacgtcatcgacaacgccaagcgggccgtggaggcccagtgccccggggtcgtctcgtgcgccgacatcctcgcgctcgccgcaagagacgccgtcgcgctgtccggtggtccgtcgtgggtggtggccttggggcggcgggacgggcgcgtgtcgctggccaacgagacgacgacgctgccggggccgacggctagcttcgagcagctgaagcaggcgttccacggccgcgggctgtccaccaaggacctggtggtgctgtcgggcgcccacacgctgggcttcgcgcactgctcctccttccagaaccgcatccggctccaggaccagggcaccgacgccgacgacccttccctgagcccctccttcgccgccgccctccgccgtgcgtgccccgccaacaacaccgtccgcgccgccgggtccggcctggacgccacctccgcggccttcgacaacacctactaccggatgctgcaggccggccagggcctgctctcctccgacgaggcgctgctcacgcaccccaagacgcgcgccttcgtcgcgctctacgccgcgtcgcaggaggccttcttcagggccttcgccaagtccatgctgcggatggccgcgctcaacggaggcgacgaggtgcgagccaactgcaggcgcgtcaactcatcatgatccggaccatcccatccgatccactgctgtgtttag

SEQ ID NO: 508 - DNA, 976 bp, Sorghum bicolor
aaagtcgaccccttcaccgtgtctctccgcggcggcgggcgcggttctccggccatcaccgggcgcatccggaaaaactatgaggaggtacagccccccttatcgtagtccccccaggagggcatatggtggcagaggaagaagcccccctcctcctaggagggggtatggaggacgcaacaaagagggtagtggaagccttttggtccgcaatatcccattaagcgtcagagcggaggagcttcgagttccttttgaaaggtttggccctgtccgcgatgtttacattccaaaggactattactctggggagcctcgaggatttgcctttgtggagtttgttgacccttatgatgcctctgaagcccagtatcacatgaatcgccaagttttctttggccgggagatagctgttgttcttgctgctgagtcgcgaaagaggccagaggaaatgcgcagcagagctagagtcagaggttactctggtcatgaaggtcgccgatcttcatattatgggcggtctcggtcccgttcccgctctcctcgctataggggccgtcctcggtcaagatcatactctcctgctccaaggcggcgagatgactactcagcttctccaaggagaaaggaagcgcatcgcacatctcctcccaggcgcccgccaaaggagcatgacgaagataagaagcggaggtcctactctcctgccagtagagatgatgctgacaatggttatgagaagaggtcgcccccagcagacagtaatgggtcccctccgcaccgcaggtcccccaaggaggagtactcaggctcacctcccggatcccgctccaggtccgccgacgaatctcctgttcgcagtgactgactgaccggtggatgctacaaaaatgatatgcacatgaccgtgtctctccggcacgagtcagtccaatgcctttgtcaggccgagcttactgttacctaggaattcttt

SEQ ID NO: 509 - DNA, 698 bp, Sorghum bicolor
aaaggatccccattatgccaaggatttgaagtcttcatgaagaaatatcaaatcgatattcctacagaagctgttgatgaagactttctaacccgtgctggtacattgcaacgaattgatgaactgattttgtatcgctgcactgagatgcgtgaggtatgttccaagctggttcccggtattagtggaatgatcaaggataactttcgctatgttgaagttatggcaaagattctgaccccttggttggttggtgaagaatgggattcatccaagtggtccactgctggtgagccgtggttcactcctgatgagatgcagaagatagtggctaaagatgctgcagcagatgatgcacgggaaaaggttaagggtgatcataaggtggctgctatgatagaggccaaccttgatgactacaggtgtctcactaaatctcatggtattgttcttcagaaagtcaggtcttgttatgaagcaaaggtcaagagagggcaaaagaggagccacacagagatggctgaagaggaggttgttgaggcggtggctgagtgcaggaagggacaagatggtgctgactccactgaagagaagtggagtccttccaatggcagtagcaagacagagatttctcatttctgataatcagctgttcgtgtatgcttaagctgccagtgtgttgctagtatggtaccttt

SEQ ID NO: 510 - DNA, 1276 bp, Sorghum bicolor
gtacgaatccgtgggaaccccgcaccgcatcgcctcgtatgcttcgcgcgtgcacacgcgtcggtggcgcgggcgccggcggccgacgagagcgcctcatggcctccctcatccgcttcctctcttcctccccctcctactccaccactcacctcccgcgccagcaccagccccagccgccgccagccgcagccgcagcggcgcgcccatcacggttccgcctcctgttcgcgcgcgccgcggcgcggcgcgaccccgagccgacgccggtgccggcggtcgaggagaggaggtcgctggccgtcaggacgggggagctgttcctagggctggcggcgctgctgctgcgcggggccggggccggggccggggcggcggtggaggaggtggaggcgagggacggggtggtgtgggagcagcgacccgaggacgtggacgcggagcgggcgcggcgggagctcactagccccggcttcagcttctccgcggcggggctgctcttcccctaccacctcggcgccgcgcagtgcctcatggaccgcggatacatcaccgagaaaactccgttagctggctcatcagcgggtgccataatctgtgcagtgatcgcatctgggaacacaatgcaagatgctctgcaggtgaccaaagttctagctgacaactgccggagtaaaggcactgcgtttcgccttggggctgtactcaaggatgtccttgatgagtttctcccagatgatcttcacattaggtgtaatggaagaattcgtgttgctattactcggctatcctggaggcctaggggcttgctggtggaccaatttgactccaaagaagatgtcattaatgcagtcattacatcctccttcattcctgggtacttagcacccagaccagctactttcttccgtaataggctctgcattgatgggggccttacattgtttatgccgcccacttctgctgcagaaacagtccgaatatgtgcttttccagccagccgcttgggattgcaagatattgggatcagtccagattgcaatccagagaacagagctagtccaagacagctgtttaactgggctctggaacctgctgaagatgaaactctagacaaattatacgagcttgggtacctggacgcagctgtttgggctgagcagaattctgccgagcttatcacgaagaatggtcaatcccttgtcgctgattgaatcaagctctgtttgctcaaaactaattttggtgtcctaagctgagttcatgggagtttgta

SEQ ID NO: 511 - DNA, 1564 bp, Sorghum bicolor
ttgttaccgaacagagggagagaaggagagagagatgtcggctctcctcgatctattgatggggatcctccggcagcagaccatcggcggcgccgcgctggagctcgccgcgatagcggcgccgctgtggctcgccgcgctcgtcggcctcctcatcggctgggcgtggcgcccgaggtgggcggcggccgtcggcggcggcggcggcgacaacaacgcacagcaccaggcggcggcgcacctcctccctacgccgccccctcctcctccggcgcgcgccaccgccaccgcggtggtctctcgcaacgaggcgcccgctgtcgtcccgaggactgtggtggctcctgcggcggcggcgcccgaggacgagcagctggcggtcaacaccggcgacttgatgcacctctggcggctcgtcgaggagaaggacggtggtccgtcgtggattcacatgatggatcgcaccttgcccaccatgagataccaagcctggcggagagacccaccgaatggtccgccacagtatcgcagcagcactatctttgaggatgcgtcaccagaggtcgtgagagatttcttctgggacgatgagttccggattaagaacagctgggatgacatgcttcttcagcacgagacactggaggaatgcgccaggactggaaccttggttgtccggtgggtcaggaagttcccattcttctgcagcgacagggagtacatcataggtcgcaggatatgggcatctggaaagacgttttactgtgtcaccaagggtgtgcctcgaccctctgttccaagacataacaaacctcgacgtgtggacttatactactctagctggtgcatccgtccagttgaatcaaggaaaggcgatggttcaatgactgcatgtgaggtgctcttattccatcacgaagatatggggattccatgggagattgcaaagcttggtgtccggcaggggatgtggggctgcgtcaaaaggatagagcctggccttcgggcataccaagttgcaaggaccgctggagagcctatttcgaaatgtgctgccatggcacatgtcaccaccaggttcaatgcggatgagctcattacagaagagaacacagagggcagttcatccaacaacacagaggtcgagaagccaaagcactggacaaacaatatacccaaggttctcatgataggcggtgccgtcgccctggcttgcacctttgacggtggattgttgaccaaggccgtcatattcggcacggcgagaaggtttgcagggccaggagggccaggaaggcggtaggtggatggagctggttaccgtagagcaatgccacccttgtcatgtagcaaagctatgcgtggaagtgccccaaacaatctttttgtagcaatacattgcagaggaccgaatgccgtgtctagatgttcagtgtagacatcctcatgctgcagataaggtggtgtgctcatattaggtcagttgagaaaatagatcctgcacattccagaaaaggaaatcggcggaaagatccagcgacacagaccggacatacatctgttg

SEQ ID NO: 512 - DNA, 696 bp, Sorghum bicolor
aaaggatcctctctctgtcccgtcccatacccccatcgccggcgatctcctccttcgccgccaatggatctctccgccgtccaggccgccctctccgacaagtcctactccgccctcgcccccctctgcgacgagctcctcctccaggtcgcggccaagggagccatcaccgacgaatggccctactccgtccatctcctcgcccacctctacatcaatgacctgaacagcgcgcggttcttttggaagtcgttgccgcaggaggtgaaggacacgcggccagagctcgccgcggtctggaggattggtcagtgcctgtggaacagggattatgctggcgtcaacacggctgcacaggggttcgagtggggccctgacctcgctgatttcatcactgccttcctagagagctacagacagaggatattcaagctgttgacttctgcatattccacaattagcgttgctgatgtggctcatttcatggggatgagtgaggaggatgttacaaactatgctgtgcaaaacagttggagcttggatgcagcgactgggatgcttactgtaaaaaagccaaaggctcagaccaaccagaagcttgactcgagcaagctgcagcgtttgactgagtgtgttttccaccttgagcactgatgctcactgtcaattatgtcgcatccctgttgaggtaccttt

SEQ ID NO: 513 - DNA, 811 bp, Sorghum bicolor
atttcaccaccgcttccagccaaccgcttcttccctcgccacccatggccaccgcagcgcgcgccctcgtcgccgcacgcccggcgcggccgctcctcccgtcacggcgcctcccgtcctcctcttccatccgccccccgcggcaacgtggcggcggcgttgggtccgtccgctgcatggcgcggcggccggattcctcatattccccgctgcggtcgggtcagggcggtgaccgtgcgccgacggagatggcgcctctgttccctggctgcgactacgagcactggctcatcgtcatggacaagcccggcggcgagggcgccacgaagcagcaaatgatcgattgctacatccagacccttgcccaggtggtagggagcgaagaggaggcgaagaagaggatatacaatgtgtcctgcgagcgctattttggattcggctgcgaaattgatgaagagacctccaacaaactggaaggccttccaggggttctatttgtgcttcctgactcttatgttgatgctgagaacaaggattatggtgctgagttatttgtgaacggtgaaatcgttcagcgatcgccagaaaggcagagaagggtggagccagtgcctcagagagctcaagatcgaccccggtacagtgaccggacccgctatgtgaagcggagggagaaccagtcttaccagcgatgatgatgctgtttctggagatggaaaatgccacggtttccacaagttgcctaaatgtgatgctggagatgtagcagcaatcccccttccctactacccacatgagaatgacatccctt

SEQ ID NO: 514 - DNA, 896 bp, Sorghum bicolor
cccggaactactcgaatccccacccaagcaacaccccggaaaaggcgtgaagcgcccgcggtcgggggccgatggtggtgcggcggctgggcggcgcggggcgcgcgctgctcacgctccccaatatccggaggcgggcgtccaactcctgggccgctgtctgcgacaccttcttctccaccaagcaagtgttcgagaaccaccgcatcgtcttcaccgtcggcacctccatcgcctccgtcctcacggcttgggctggctattcacttcgtcaggttcatcaatcaaggattgaaaggaggcttgagtcaattgaatcatctctgaagggtaaccacaaagttgaacatgaagagataaaaaagattgtcacttccagcaatattagcgctccagcctgtgtagccacggcgatgaccacaatggttgttgggtacacgctaggatggcgaggtggtgcttggtatgctcgaagggccttcagaagagagcaacaaaagctgatgatgggtcacatgaagtcacacaacagatggcactggcggcccttcaaccggctcaggaacaggctcagaaacagcaggttagcctccaagaacaagagcaccaacgcccatccgtcggtgggtcaaagcagcgaggccccctcaacctcaagcagcggggcctctgcggacgttagcagtgctgctcagtcagcagtgggcagtgcatgagctatatatgcatactacatggactaggatgtaaacttgagggcgcgtagtccatatgtcttgctagaacagataatgtgacttgtaggtacttaggtcgatctgtggtggatcatttttgtagcatattaaggtcataatgcacccaactacatgcgtgaaacaactgactgacgacag

SEQ ID NO: 515 - DNA, 1044 bp, Sorghum bicolor
agaagtcgagaagctagggaggggggacacgacgccaccgagagggaacgcgaggtcgccatcaccatggggggaggagtcatgcgcaccgccgcgaaggtcggcatcgccggaggcgcggcggcggcggcaaagagcggccggttccgccacgccgcaccggccttcgccacggccgccgccgccgcgggttctgaggcggcgccgcttgtctccgcctccggtggcgaggcggtgccccccgctacggcgcagtgggcggcgtcctgggagctggacgactgggagttcgcggactggagggacgactccgccgcggcggcggtggtggtggcggagagggaggccacggcagcggccgcgaagcccaggctggtcttcgcgccgccgtcgagggaggaggccgaggaggccacgagtgagctcagggacgccatagagagggcctatttcaatgagacaccagttgaggttgttaaggaacaggataaagagtttaataagcaggcaaccgatgccataattccttccatgcctggacatgtggtccaagcttttacattgctgaaatcaagcccggaggctcagagtgttgtagcctcccttgcatcagatagaaatgtctgggaagcagtattgaagaatgagaaggttatggaattttacaagaatcaccagacaactctagttgagacattccctgaagaagcagccacagtagagtcgccggggaattttgaagacgccacctctgaaaatgcatccaacactgaactccccactggctcacctttctctgattttgtggacaatgcgaagaagagagtgatggatgtgatctataatataaccgactttttcaaggacttgttcgactcagcgggagcacaggacggagcaggcccttcagctgagaagggtccttctgcagcagagatggctctcggcggatcgttcatggctctggccataggggtcatcctagttgtcctgctcaagagggcatgatagctcatgagtaccctctgggactcatggtacttc

SEQ ID NO: 516 - DNA, 1199 bp, Sorghum bicolor
tccaatcgtctatccctgactcctcctgacaaaaaagagaggaaaccgaggcgacaagcaagcaatgggtgtcaagggattcgtcgagggcggcatcgcctccatcgtggccggctgctccacccacccgctggacctcatcaaggtccgcatgcagctgcagggtgaagccgccgcggcgccgcagccagcgctgcgcccggcgctcgccttccacgccggtggccacgccgtcacgctcccgcaccacgacatcccggtgccgccgccgaggaagcccgggccgctgaccgtgggcgcgcagatcctgcggtcggagggcgcgcggggcctcttctccggtgtctccgccaccatgctgcgccagacgctctactccaccacgcggatgggtctctacgacatcctcaagaccaagtggacacccccgccggacaacaacggcaacggcggggtcctcccgctgcaccgcaagatcgcggcggggctggtggcgggcggggtcggcgcggccgtgggcaacccggccgacgtggccatggtgcggatgcaggcggacgggcgcctccccctcgcggagcgccggaactacgcgggcgtcggggacgccatcgcgcggatgacgcgcgacgagggcgtccgcagcctgtggcgcgggtcgtcgctcacggtgaaccgcgccatgatcgtcacggcgtcgcagctcgccacgtacgaccaggccaaggaggccatcctggcgcgccggggaccgggagccgacggcctcgccacgcacgtcgccgccagcttcaccgcgggcatcgtggccgccgccgcgtccaaccccgtggatgtggtcaagacgaggatgatgaacatgaaggtggcgcccggcgcgcccccgccgtacgccggcgccgtcgactgcgcgctcaagacggtgaggtcggaagggcccatggcgctgtacaaggggttcatccccaccgtgatgcgccagggacctttcaccgtcgtgctcttcgtcacgctcgagcaggtgcgcaaggtcttcaagggcgtcgacttctgaggaccggcgccgacgaagatgatgatgatgacgacaaccgccgccgccgccgccgctatgctacccgttcgtcaccgcgttcgctgctacgaataacctgctgctgctacctagaggcggcgactattatgccttcgcttgcatt

SEQ ID NO: 517 - DNA, 5540 bp, Sorghum bicolor
cctcctcagatcagatctctccatctccttctcggcaccgcgccgcgcgacgcccgcctccgcgctctccccccccacttccgctccagactagccgggagagatctaggtaccgccgcccgtcgccatggcggcggccaacgcccccatcgccatgcgcgaggcgctcacgctcaccagcctgggcatcgcgccgcagttcgtcaccttcacccacgtcaccatggagtcggagaagtacatctgcgtccgcgagacctccccgcagaacagcgtcgtcatcatcgacatggccatgcccatgcagccgctccgacgccccatcaccgccgactccgcactcatgaaccccaacaccaggatcctcgcactcaaagcccaaatacctggaacaacacaggatcaccttcaaatatttaacattgaggctaagactaagatcaagtctcaccagatgccagagcaggttgtattttggaaatggatcactcccaaattgttgggtttagtgacacaaacatctgtttaccactggtcgattgaaggtgattctgagcccaccaagatgtttgataggacagctaatttggcaaacaatcagatcatcaactatcgatgcgacccagcggaaaagtggcttgtacttattggaattgcacctggagccccagagaggccacaactggtgaagggaaatatgcagcttttttctgttgatcaacaacgtagccaggcccttgaagcccatgcagcatcttttgcaacatttaaggttgttggtaatgagaatccatcaacccttatttgtttcgcctcaaagacaactaatgctggacaaatcacttcaaagctgcatgttattgaactgggtgcacagccagggaaacctggcttttctaagaaacaagccgacctcttcttcccaccagatttccaggatgattttcctgtagctatgcaggtttcacaaaagtatgggcttatctatgtaattacaaagcttggccttttgtttgtatatgacttagaaactgccgcggcagtttacagaaatagaatcagtccagaccctatattcttgacggcagaatcttcttctactggtggattttatgccatcaacagaagagggcaggttttacatgctacagttaatgacgcaactgttgtaccttttgtcagtggccaattaaacaaccttgagcttgctgtgaatctagccaagagagctaaccttcctggtgctgagaacttggttgtgcaaagattccaggaactgtttgcacagacaaaatacaaggaagcagctgagctggctgcggaatctccccagggtctcctgaggacgcctgagaccgtggcaaaatttcagagcgtgcctgtgcaagctgggcaaacacccccactcttgcagtactttggcacattgctaactcgagggaagctcaatgcctttgagtctcttgagctatctcgacttgtcgtcaatcagaacaaaaagaatcttctcgaaaattggctggcagaagacaagctggagtgtagtgaagaactaggagatcttgtcaagactgtggacaatgatcttgcactgaaaatatacataaaggctagggcaacacctaaagttgttgctgcttttgctgaaaggagggagtttgacaagatactgatatactcaaagcaggttgggtacacgccagattatctcttcctcctccagaccatcttgcgcacagatccacagggagctgtgaactttgctctcatgatgtcacaaatggagggaggctgcccagtagattataatacaataactgaccttttccttcagagaaatatgatacgggaggcaacagcttttctgttggatgttctgaaaccaaacttgccagagcatgcttttcttcaaaccaaggttttggagataaacttagtgacttacccgaatgttgctgatgccattcttgctaatggtatgttcagtcattatgaccgccctcgtattgctcagctgtgtgaaaaggctggtttgtacttgcgagccctccagcattactcagagttgcctgatatcaagcgtgtcattgtaaatacccatgccattgagccacaggcacttgttgagttctttggcaccttgtcaagagagtgggctttggagtgcatgaaagacctcctactggttaacctgaggggaaatcttcagattgttgtgcaggctgcaaaagaatactctgagcagctaggggttgacgcttgcattaaattatttgagcaattcaaatcttatgagggcctttactttttcttgggatcctatctgagctccagcgaggacccagatatccatttcaagtacatagaagcagctgcaaggactggacagatcaaagaagttgaacgtgtaaccagagagtcaaacttctatgatgctgagaagacaaagaactttttgatggaagcaaaactacctgatgcccgtccactgattaatgtttgtgaccgctttggttttgtgccagatctcactcactatctgtatacaaacaacatgcttcgatatatcgaaggctatgttcagaaggtgaatcctgggaatgctccattggtagtggggcaactacttgacgatgagtgccctgaagattttatcaagggtttgattctctctgttcgttctctccttcctgttgagccactggttgatgaatgtgagaagaggaaccgcctacgtttgctcactcaattcttggagcacttagtgagtgaaggtagccaagatgtgcatgtccataatgctcttggcaaaatcatcattgacagcaacaacaatcctgagcatttccttactaccaatccattttacgactctcgtgttgtgggtaaatattgtgaaaagcgggatcctacacttgctgttgttgcttacagacgtgggcagtgtgatgatgaacttattaatgtcactaacaaaaactctttattcaagctacaagctaggtatgtggttgagagaatggatggtgatctgtgggataaagttcttcagcctgagaatgaatatagaaggcaactcattgaccaagtggtttcgactgcattgcctgagagcaagagccctgagcaagtttctgcggctgttaaggctttcatgactgctgacctgcctcatgaactgattgagcttcttgaaaagattgttcttcagaattctgctttcagtggaaatttcaatctgcagaacctgctcatcttgactgctatcaaggcagatccatccagagtcatggactatatcaacagacttgataactttgatgggcctgctgttggagaagttgctgttgaagcacagctgtatgaggaggcttttgctatattcaagaagttcaacttaaatgtgcaggctgtcaatgttctcttggacaacatccggagcatagaaagagctgaggaatttgctttccgtgttgaagaagatgctgtgtggagccaggttgccaaagcccagttacgtgaaggtctggtcagtgaagcaattgagtccttcattcgcgcagatgatgctgcacatttccttgatgttatctgtgctgccgaggaagctaatgtgtacgatgatttagtaaagtaccttctgatggtaaggcaaaaggcacgggaacccaaagttgatggagaactcatctttgcatatgctaagattgacaggctcagtgaaattgaggaattcattcttatgccaaatgttgccaaccttcaaaatgttggtgaccgcctgtatgatgaagaactatatgaagctgcaaagatcatctatgctttcatctcaaactgggctaagctggctgttaccctggttaagctgaagcagttccaaggtgctgtggatgctgctcgcaaggctaacagtgccaaaacatggaaggaggtctgctttgcttgtgttgatgccgaggagttccgtcttgcacaaatatgtggtctcaatattattgttcaggttgatgacttggaagaagtcagtgaatactaccagaatagaggatgtttcaatgagcttattgctctcatggagagtggtcttggacttgaacgtgcacacatgggcatcttcacagaattgggagttctatatgctagataccgccctgagaagcttatggagcacatcaaacttttctccacccgtctcaatattcctaagcttatccgggcttgtgatgaacagcagcactggaaagaacttacctacctgtacatacagtatgacgaatttgacaatgctgccaccactattatgaaccactctccagatgcatgggatcatatgcagttcaaggatgtctgcgttaaagttgcaaatgtcgagctgtattacaaggcagttcacttctatttgcaagagcatcctgatctcatcaatgatatgctaaacgtgcttgcacttcggttagatcatacccgagttgtagacataatgcgcaaggctggtcagttgcatctagtgaaaccgtatatggttgcagttcagagtaacaatgtctctgctgtgaatgaagccttgaatgagctttatgttgaagaggaagactatgagagactccgtgaatcagttgacatgcatgacaactttgaccagataggtcttgcccagaagcttgagaagcatgaattgctggagatgcggaggattgccgcctacatttacaagaaggctggcaggtggaagcaatccattgctctatccaagaaagacaacatgtacaaggattgcatggagacatgctcacaatctggtgaccgtgaactgtcagaggacttgcttgtctatttcattgagcagggtaagaaagaatgctttgcttcctgcctcttcatttgctacgacttgatccggccagatgtcgctcttgagcttgcatggatgaacaacatgttggactttgccttcccatacctgttgcagttcatccgtgaatacactagcaaggttgatgatttagtgaaggacaaaattgagtcgcagaaggaagaaagagccaaagagaaggaggagaaagatcttgtggctcagcagaacatgtacgcccaactgcttcctcttgctttgcccgctccgccaatgcctggcatgggcggccctccacctccaatgggtggaatgggcatgcctccaatgggtggaatgggtatgccgccaatgggccctggtccgatgccagcatttgggatgccgccaatgggaagctactgagttgtttttgcagagagcttagatgatctgaattgttccaagtgtaagcaaaagtggaacttctttggagttgtagatgattacagtttggaattaatattctttatggtacctggaaatttttggcggagtgaaatcttagccagagtttgaaatttgcggttaggatggttgagcatgagctgttgaaagctggtaccatttgtatagtgtgatgatctttgtagacacattttggttgtattaatacttgtcagaacagtgaaggacaaacaaatgt

SEQ ID NO: 518 - DNA, 1236 bp, Sorghum bicolor
tagattgaccctgctttcctccccaacgaatccaagttgcgcaaatgccgacgccggtgaagtcggtgcttcccgtggtgctcctcggctgcggcggcgtcggccgctacctcctccgccacatcgtctcctgccgccccctccacgccaaccagggcgtggccatccgggtggtgggcgtcgccgatagctcctccttgctcgtcgccgaagatgtccactccaacggcctcgacgacgcgctcctcacccagctctgcgccgccaagtccgccggctctcccctctcctccctgcttgcccaagggcactgtcagctgttcaagaatcctgaggctaggggcaaagtcatagacgccgctaccacacttggaagaacaactggtctggtgctagttgactgttctgcaacttatgacactgttagtctgctgaatgatgctgtgggtcatggatgctgtattgtattggcaaacaagaaacctcttaccggtgcttatgaggattttcagaagttggtctccaacttccgtcggataagattcgaatctactgttggagcaggtttgcctgtgatagcttctgtaacccgtattattgcatctggagatcctgtttctcgtattgttggcagtttgagtggtacacttgggtatgtgatgagtgagcttgaggatggaaagaaatttagtgaagttgtaaaaaatgccaagtctcttggctatacagaaccagatccacgtgatgatcttggtggaatggatgtggctagaaaggcattgatcctggctaggcttctgggccaacagataagcatggagaatatcaatgttgagagtttatatcctagcgaattaggacctgatgcagtgtccacaaaggacttccttgagagtggtttagtgcaacttgacaagagcatggaagaaagagtcaaagcagcagcatcgagaggaaacgttcttcgctacgtagctgagattgaaagcacagggtgccaagtaggccttaaagagctcccaaaggattctgcactgggtagattgaggggaagtgacaatgtggtggagatatacagcagatgttaccagagctcccctctggtgatccagggcgcaggagctggcaatgacaccactgccgccggcgtccttgctgatataattgacctccaagacctgttccagacaacggcatgatcgtagatcggcatccaacaccatcttgattcttgca

SEQ ID NO: 519 - DNA, 1766 bp, Sorghum bicolor
tccaatcttgtcgctttctacgcgccgtcgcctccccttctcccccaaaaccatccaccgtctccgccgtcccaatcgccttcaaaacccccggcaaaaccctccatttccgccgcatctccctcgctgtcccggcacaccgggtcggtcgggtgttgaggctcgctcgcggctcccctcttcctggggcctggctggaagggaagggggaggatgcaggccgcggccgggagcgtctcttgggtcaccgcgcagccgtccgtcctcggccgctgcggcggcgcgccgtccgcttcgctcaaggggagtgcttgcggcgtcggaggaggagggtgcaggatccggggccgggacgtcgccgtgccgcggtgctgcgcgcgcgcgcaggagaagcgcccgccgcgagtgcgcaaatccaaggaggagaggcgggagatggtggagtccttcatcaacggttaccgactttcaaatgaaggtaaattcccatcagttaaccttacccataaggaagttggagggtcatattatattgttcgtgaaatcgtgagggatatcatccaagagaatagagtccttggtcctggtggcttggatgctatggcgctgagttttgaagatcgtgatgattcttcagagtcatccatgaagcatgaattgggtcaagacaatatagagatcttagatacgtctggtagtgaagtcagtaagggttatgtacctgaaatatccagcactgatgaatcgattccattgcaagacaatgccatcagcactcagacactgctgggttcatcaaatatcttagaggctggtgttctgaatagtgtggtccaaaatgggagtgcggcagatgcaatattgatggaaacaaatcttgagaaacaagatgaagttccatctggaggatccattgagtttgacttgaatagttctgaagagcaagctcgtttgtttgctcaggtttctgattcagatgaagacattgtactaaacagtcaggcagatgcacaggatggaacagccagtagtgctaccgatggagttattcttcccttagagtcttctgctgtttatgaaagcaatgctgcacttttaagagatcatgagacattacctaatgataatcatgatggatcaactgatggtgccgtggatgatgcaaacctccttgcagcgatcaatggtgttcaagcaaagcaagcttctttacatgagcatgatgcatcaactggaagtgtgtcgattgacaatgctcagagctttgatagtcagtatagtactactgtatctactgatcctataaatggttctaaatcggaggctgaagttgcaaccaagacagttgaagcatctaaagtacacaggctgcaagatgagtttgagcaaccattggttgatgctagctgtgacgggcaagaaaactctgacagccctgtttctcatccagcattagatacaaaggggctgttgcacacagaagatcagcacagtgttgtacagatagatgaaagtgaattcaagatctcaacacctgggatcacaaaggaagaggtccaggcagctgatttcaggcatgaacaaggaattaacaccagaacagcgatcagcaggcatgcactttgcctcctaactttgcgttgcatgcttaccgtttataatttccttcacacatcacaaaaggcagcagtatattaggaaaactttgaaagctctgcagaagaaagatgacaacctattctggcttgtccttagggcatttgttg

SEQ ID NO: 520 - DNA, 1002 bp, Sorghum bicolor
tccgactccgactccaactacccctatccccaccgcgaaccgccggaggaatctctggcgatggcgccgccacccgctacggttgccgccgtccgccaccacagcccgcacctgctcctccgccgcggcggcgggggtctcctcccaccacctccggcccccgccacgctccccttcgccacgcggggtgtggcctccgcgccggcgcgcctgcgcctgccgccgccacggttctcgctctcccctgtcccgaagagcctctccgcctcctcctcctctcacgtccccgtgcgctccctcttcaccggcatcgtcgaggaggttggccgcgtgcgccgcctgggcccgccgctcgcgccgtcgtctggcggcggcggtggcgaggctcccgggcttgacctggaggtcgagaccagggacctcctcaccgggacgcagctcggcgacagcgtggcggtggacggcacctgcctcaccgtggcggcgatcgacccggccgcgtccacgctcaccttcggcgtggcgccggagacgctccgccggacgtccctgggcgggcgggcccccggcgacggcgtcaacctcgagcgcgcgctcacgccgtcgtcacgcatggggggccacttcgtgcagggccacgtcgacgggaccggggagatcgccgcgttccggcccgacggggactcgctctgggtcaccgtgcgcgcgccgccggagatcctccgcctcctcgtgcccaagggcttcgtcgccgtcgatggcactagcctaaccgttgtcagcgtggacgacgagggcgggtggtttgacttcatgctcgtcaggtacacgcaggacaacatcgtgctgcccaccaagaaggtcggagacaaggtgaatctggaggcggatatactggggaagtacgtcgagaagctcctcgccgggagggttgaggccatggctaaggttggctcgtgatcgaccattgctgagatgctggattgctcgtcattctattag

SEQ ID NO: 521 - DNA, 1094 bp, Sorghum bicolor
aaaggatccgaccaagaggcgagggatacgccctgcgcgagtgcgcgctcggcagaacgatgccgctgcactgttccctgcccgcgacctgttcggcgttgtgcctgcgagcagcggcgcggcctgacccccgctgtccgagctcccacgcgcgcctcgtcggcctagctctttctcgcccgcgccaccagaggctcgtgcacaccggctgcgcgcgggccgggacgagcgactctaaggccgtgcagctggtgctgggcggccgtgcgcgcggcgacgatgacgacactgactccgagtccagcgatggcgaggactcccaggatcggatgacggacgaagagcggaagacgctgcgccggaagatacgggagatgatggaccgcgtccctgaaacggcggggctgacggacccggaggagcggagggccaagatgcgggagctgctgaccaagtacgagctggtggtagaggaggaggacccggactggcccgaggacgccgaggatgggatgggcttcagcctcggccagttcttcgacaagatcaccatcaaggccgagaagaaggacgacgccgaggaggatgatgactcggggtatcaaagcgacaaggagattgtttgggaggatgacaattacatcaagccggtgagggatgttaggacacaggattgggatgcgtccgtgttcaccgatttcgggccgatgattgtgcttgtgcataacagatataagagaccgcgtgagaatgagatggcgagggctgagcttactaaggcaattgagatgttttgggaacacaatctgccgtcaccaaggtgtgtggctgtagatgcctgtgccgagcctgaccttgtggacgcgctgaaagtttctggtttccctgagattctcttcaccaatgcagggaggataatacaccgtgagaaagttgtccggtcggcggaggcatggtcgaggatgatggcgtttttctactacaaagcagcaaggccaccgttcttgtgtgaagcagatgggaagggtcaagaaaaggttcctttgatgtcatgagcacaacgtggaggcttagctttgtagtacggtaccttt

SEQ ID NO: 522 - DNA, 569 bp, Sorghum bicolor
tcttgcttcccaccgtacctgcctgccacgccgcagcctccggctccgatgtcgtcgcagcgcccgggccgccaccagcgtcgcgcgtcgcagagcgtgttcgtgctcccggagaacctggcctccctcgacgtcgacgcggcgggcgaggtgggcgcgaattcgaaggccggtggcccagacggcgccggcgccgagcagcaggcgaggccgcccgcggggcgtcaccgccgcgccatgtccgtggccgtggcctccactagggacctcgagctgatcaaggaggacctcggcagctacaagctcggcgcttgagagagggggccggctggcacgtcgcgtcatgtgtatatagcctgtgggttagccgtgcccagacctggctttgatcggcgcttaacagtggcttaattacaaggtctctcctccgttgctctttttgttttcgctcaacacacgcatatgtaatactactactagtactatgtagtaacttttttcattacaaagaggaagtatttggacactttaatcgcgtgaaggtcctgctcagtggcagcatatgacta

SEQ ID NO: 523 - DNA, 1559 bp, Sorghum bicolor
cgtccgaatcccaatggcgtccgcggccgccgcgccaacctccctctccctcgcggcccgcgcggccaccagggcagccaccgccgccgccgccgccgccgccccgctgcgcaggggaggcctcgccgcggcgtgccagccggcgcggtcgctggcgttcgcggcgggcgacgcgcggctcgcggtccacgtcgcgtcgcggtgccggcaggcgtcctccgcgcgcggcacgcgggccatggccaccatggccaagaagagcgtcggggacctcacggaggccgacctcgaggggaagcgcgtcttcgtgcgcgccgacctcaacgtgccgctcgacgagaaccagaacatcaccgacgacacccgcatccgggccgccgtacccaccatccagtacctcatcagcaagggcgccaaggtcatcctctcaagccacttgggtcgccctaagggttttacacccaagtttagcttaggtcccattgtaggacggttgtctgagcttcttggcattcaggtgcaaaaggccgaggatgttattggcccagaagttgagaagctggtggacgccttgcccattggtggggttttgctcctggagaacgtaagattctacaaggaagaggagaagaatgacccagagtttgcacagaagcttgcctccctagcagatctttatgtcaatgatgcatttggaacagcccacagggcacatgcatcgactgagggagttaccaagtttctgaagccttctgttgcagggttccttttgcagaaggaacttgactaccttgtcggagctgtctcaagccctaaacgcccatttgctgccatcgtgggtggttcaaaggtgtcatccaagattggggttattgaatccctgttggaaaagtgtgatatccttctcttgggtggtggtatgatcttcacattttacaaggcacaaggtctctctgttggtgcttcattggttgaggaagacaaacttgatcttgcaacatctctccttgcaaaggctaaggaaaagggtgtctcccttttgttgccaaccgatgttgtcattgctgataagtttgcccctgatgctaacagccagattgttccagcatctgcaattcctgatggttggatggggctggatattggcccagatgctgttacttcattcaacgcagccctggatacatgccagacggtcatctggaacgggcccatgggtgttttcgaatttgacaagtttgctgtaggaactgaggctgtggcaaagaagttggcagaacttagcgccaagggtgtcacaactatcattggaggtggagactctgttgccgctgttgagaaggtgggagttgctgacgttatgagccacatttccacgggaggtggtgccagcttggaattgttggaaggaaaggagcttccaggagttgttgcattggatgaagccatccctgtggctgtatgaagcaagctttcattttgtttcatctccatcttcacgtgccattgtatacttgctacattcttgcttgctcctcgtcagccgctctaaatgtaag

SEQ ID NO: 524 - DNA, 1278 bp, Sorghum bicolor
cactgcaccaatcatcacgcaccggagcgcacgcgggtggggagtcccgaggcgatcaggcgaagcggcgcgccaactgacgccatgaaggagggcggtggcggcggcggggacggggggttcgtgcgggcggaccagatcgacctcaagagcctggacgagcagctggagcgccacctcagccgcgcctggaccatggagaagcgcaaggaggaggcctccgggggcgccgaccagcgcggcgctggcgccaggccgcactcccggcgcccgcggagggaggactgggagatcgacccggccaagctcgtcgtcaagggcgtcatcgcccgcggcaccttcggcaccgtccaccgcggcatctacgacgcccacgacgttgcagtgaaactacttgattggggagaggatgggcataggtcagaacaagacattcaagcactaagagcagctttttcacaagaggtttctgtttggcataagcttgaccatccaaatgtaactaagtttataggagctataatgggtgcaagggatctgaatattcaaacagaaaatggtcacattggcatgccaactaatatctgctgtgttgttgtggagtaccttcctggtggtgcactaaaatcatttctgataaagaacaggagaaggaagttagcttttaaggtcgttgtccaaattgctcttgaccttgccaggggattaagttatcttcattccaagaagattgtgcaccgtgatgtgaagactgaaaatatgcttcttgacaaaacgagaactgtgaaaattgctgattttggtgttgctcgactcgaagcttctaatcccagtgatatgaccggtgaaactggaacacttggttacatggcacccgaggttctcaatggaaatccatacaacaggaaatgtgatgtttatagcttcgggatctgtttgtgggagatatactgctgtgatatgccgtatcctgatttgagcttctcagaggtcacatctgctgttgttcgtcagaacttgaggccagagataccacgttgctgtccaagctctttagcaaacgtgatgaagcgttgctgggacgcgaaccctgacaagcgacctgagatggctgaggtggtgtccatgttggaggcaatcgacacatcaaagggtggaggcatgatccctgtagatcagcggcccggatgccttgcatgcttccggcagtacagaggtccatgatagatggaaccctgctggagctgcggtctgaagaatggcctctagatcttgtgg

SEQ ID NO: 525 - DNA, 1100 bp, Sorghum bicolor
gcaagtcacgtaccgatcgacgctaacgacgacgagcgcgacagcgatggcggcggacccggacacggaggtgcaggcggagttcccgccgctggtccgccagtacaagagcggccgcgtcgagcggttctttaacccggccccgctcccggccggcaccgacccggccacgggcgtcgtgtccaaggacgtcgtcgtcgacccggccaccggcctctgggcgcgcctcttcctcccgcccggcaagaagcagcagctccccatcgtcgtctactaccacggcggcgcctacgtgatcggctcggcggccgacccgtggacgcacacctacctcaacgggctcgtcgccaaggccggcgtcctcgccgtggcgctcgagtaccgcctcgcgccggagcacccgctcccggccgcctacgaggactcgtgggaggggctcaagtgggtggccacccacgccgccgccaccgccgccgcgggcgggggaccggagccgtggctgaccgagcacggcgacttctcccgcgtgttcctggccggagccagcgcgggcggcaccatcgcgcactacgtcgccgtccgtgccggcgagcagcagggccagggccagggcgacctcctcggggtgcgcgtcagggggctgctgatagtgcacccctacttcagcggcgcggcggacatcggcgacgaggggacgacggggaagcagcgcaaggcgcaggccgacgcgttctggcggttcctgtaccccggctcccccgggctcgacgacccgctttccaacccgttctcggaggccggcggcggcagcgcggcgcgcgtcgccgccgagcgagtgctcgtctgcgtcgccgagaaggatgacctcagggacaggggcgtctggtactacgagagcctcaaggccggcggctaccccggcgaggtggagctgctcgagtccaagggcgagggccacgtcttctactgcatgaacccgagctgcgacagggcgcgggagatggaggagcgcgtcctgagcttcctacgcaagtgagcgactctgagcgcgcgcccgtgcaaagcgctcaactgcgcaagtgagatggaataatttctcg

SEQ ID NO: 526 - DNA, 385 bp, Sorghum bicolor
tttgttacctccagcatccgttttctcttttgctgtcgcgacgaagatcctcatcaaggccctgatggctccccgtgtcgtcgcctccgctctgctcttcgccatggcggccgtcctcgtggcctccgcatcggcgcaggagttcacggcgcctgcgtctgcgccggcgccgggaccggtcgctggagccgcctccgctccggcctccgctgtcgccgtggtgtcgtccgcactgctgtccctgcttgtggccaccctgatgcagtagaagcatatctatgtatatcatctaccgcttatgtatgctactatatacatggtcatggacatgcatggcatggagtagtagtaggttttgtttctagatttgagcgggaatttgatc

SEQ ID NO: 527 - DNA, 510 bp, Sorghum bicolor
aaaggatcctcttgaaagggcagagaagggcgagatgacggtggagaaggtggacgcggcgctggcggacttcgacgcccacttcgaccgcctcttcgcttccccggacgccgcctccgacggcaaggtgaagctgctgctcttcctggccgaccgcgagcctgactcctccctcacctggtgccccgactgcaacgtggcggagccggtgatctacgagcggctggaggcagcactgcagggcaaggacgcggtgctcctgcgcgcctacgtcggggacaagcccacgtggcgcgacccggcgcacccgtggagggtggaccccaggttcgggctcaagggggtgcccacgctgatccggtgggaggatggcgccgccgccgcccgcctcggggacgacgaggcgcacctcaaggacaaggttgacgccctcctctccgttccttccatctgatctgagtaggctgctataacaatctgtgattcagttcatgtatgccgggtaccttt

SEQ ID NO: 528 - DNA, 1114 bp, Sorghum bicolor
aaagtcgacgcacggtcccttccttccctctctccggcggcagatggcctcctcctcctcaccggcgcccaccctggccggggaggctctacgccagaaacgcatcctctccagcaagctctacctcgaggtcccctcctccaaggcgccggtggtgtactcgccggcatacgacatctccttcctcgggcttgagaagctgcacccgtttgattccgccaaatggggccgcatctgcaggtacctcaccagggaagggtacctggacaagaaacggatggtggatccattggaagcctgcaaggaggatttgctagtggtgcacacagaggcgtatctgaacagtctcaaaagcagcttcagagtttccaacattgtagaggtccctcctgtctcgcttgtccctaattggattgtgcacaagaagctattataccccttccggaagcaggtgggtgggtccattttatcagccaaacttgcgcttgagagaggatgggccattaatgttggtggaggatttcaccattgttcggcagatgaagggggtggattttgtgcatatgctgacatctctctctgcatccagtttgcttttgcccgtctaaatatctcaagtgtattgatcatagacctggatgcccaccaaggaaatggacacgaaaaagattttgctaatgatggaagggtttacatttttgacatgtacaatgctggaatttatccctttgatttcactgctaagcaatacattgatcaaaaagtagaattagctagtggaacagaaacagatgaatacttggagcaacttgacaaggctcttgaggtctgcaatagtagatttcagccccagttgattgtttacaatgctggaacagacatcctggatggtgatccgttgggcagattgaaggtaagtcctgagggtgtggttaccagagacgagaaggtatttacgttcgcaaaagatcaaaacattcctctgctgatgctgacatcaggaggctacatgaagtcaagtgctcgagtaatagctgattcgatcatcaatctgtccaacaaaaacttgataggattaggcagcgagctgggttgagcaagatgagtcgacaaa

SEQ ID NO: 529 - DNA, 1219 bp, Sorghum bicolor
cccactagtgccgattcagctgatccctcgccgtcgccggccggcgaatcggcaccatggcggtcgtgcgcctccgcggcaacggtgccaacggcgtcgtccgtccccggccccgcgaccgcggcgcccgcggtggcggcggaagcatggcggggcgcgtggccgtcctcgccttctgtgtcgccgggatctggtccgcctacatctaccagggcgtccttcaggagactctatccacgaagcggttcgggccggaggggcggcggttcgagcacctcgcgttcctcaacttcgcgcagaacgtcctctgcttcgtctggtccttcataatgattaagctgtggtcgggtgggagtagctccaatggccgcgcgccgctatggaagtattggggcgtcagcgtcaccaataccatcgggccgacgatggggatcgaggcgctcaagtacatcagctatccggctcaggtgttggcaaaatcttctaagatgattcctgtaatgttgatgggaacacttctctatggtgtgaagtacacacttccagagtatttttgcacctttcttgttgctggcggtgtgtcctcctttgcgttgttgaagacaagctcgaagacaattaagaagcttgccaaccctaatgcacctcttggctatacattgtgcttcctcaacttagcttttgatgggtatactaactcgacccaagatttaataaaatcaaggtacccaaagacaaacccatgggatataatgcttggcatgaacctctgggggaccatatataatgctgtaattatgtttgctgcgccattactgttcagtaattggccatatgcaaatggttttgaggcattgagattttgccaggagaacccagaggtcgcctgggacattttcctgttctgcctatgtggtgccgtggggcagaacttcatctttttaaccatcagccggtttggctctcttactaacacaacaatcactaccacccgtaaattcatgagcattgtggtttcatcagtcatcagtggcaatccattatctttgaagcaatggggtagtgttgtgatggtcttcttaggcctctctatccaaatatatctcaaatggaagaaaaagaagggcagagaccacaaggagtaagcttgattcttgaacctgttccgatttgtaacttcaattggacagatctgttgtgaggttgaccaggataacgt

SEQ ID NO: 530 - DNA, 1365 bp, Sorghum bicolor
acgtctcccctcccatggccaccagctccacagccaccgcctcgctgcacctcctcctcccggcctcccgccgccgccgccacttcgtgcctcgggccgcccactccgagtccaccccgcccggcgccgcctccgtcgaccgccgccgcttcattgcccacactgccgccgcggccgccgtctcgcctctcgtcttgccccgctggactcccgcggcgcgcgcggacggcgcgccggcgctctccgagtgggagcgcgtcttcctgcccattgaccccggcgtcgtcctcctcgacatcgccttcgtccccgacgacccctcccatggttttctccttgggacaaggcagacaatactggagacaaaagacggcggtaacacctggttccctcgctccatcccttccgcagaagacgaagatttcaactacaggttcaactcagtaagcttcaagggcaaagaaggatggattatcggcaagcctgcaattctgctgcacacttcagatgctggcgagagctgggaaagaatacccttgagtgcccaacttcctgggaacatggtttacataaaagctaccggggagcagagcgcagagatggttactgatgagggagcaatctatgttacctctaaccgtggctacaactggaaggctgccgtgcaagagactgtttcagctactctgaacagaacagtttcaagtggcattagcggtgcaagttactacactgggactttcaacacggtgaaccgatcgcctgatggacgctatgtagctgtatccagccgaggaaacttctatttgacctgggagcctgggcagccattttggcaaccccacaacagggcggtggcacggaggattcagaacatggggtggagagcagatggtggactttggctgctggtgcgcggtggtgggctcttcctcagcaaaggaaccgggataagtgaagattttgaggaggtgcaggtgcagagccgagggtttggcatccttgatgtgggctaccgctcacaggaggaggcctgggctgctggtggcagtggcgtgctgctgaagaccacaaacggagggaagaactgggtgcgcgacaaggctgccgacaacatcgccgccaacctgtactccgtcaaattccttgatgacagcaaaggcttcgtgctgggcaatgacggcgtgttgcttcgatatcttggctgaaagagtgctggaagatcggtttcagtgatcgtatgtaacccctttttgtattgtacgtgacgtaacgaaggtatattatggagatacatacaattgttcgatttatacagcatatatatgtgtatgtgtacaacggcatctactgctactcctactg

SEQ ID NO: 531 - DNA, 917 bp, Sorghum bicolor
caaccaaacacctgtaatcgtgaaagactgactaggggtgtggcgccccaaaacacggaatccacccgcgacaacggataacgctgtcctccttcggctcctcccctctcgttcctctcctctcccctccaatggcgaccgccatttcctctctagtaactcctccagccctccaccgccgctgcctaagccctgcctccgtctccgtctccgcccctatccgtatctccttccgggccgccgcggcgtctcaggcgtggcgccggggcttggcgctgcgggtgtcagcctcctcggcggtgctcgaggcgccagaggtggtggcggcgcggaagctctacgttggaaatgtccccaggaccgtcaccaatgacgagctccgcgacatgttcgccgcgcacggcaccgttgagcgggccgaggttatgtacgacaagtataccaatcgcagccgacggtttgggtttgtcacgatgagcactgtggaagaggccaatgctgcagtagaggctctcaatgggactgaggttggtggtagaaaaattaaagtgaatgtcacagagagcttcttaccgaacattgaccgatcagcacctgaatcggaacctgtatttgtggatagtcagtacaaggtttatgttggtaatcttgcgaagaatgtaacaacggaagttcttaaaaacttcttctctgaaaaggggaagatcctcagtgcaacagtctcccacattccggggacctcgaagtcaaaggggtatggctttgtcacattctcttctgaggaagaagttgaagctgctgttgctactttcaataacgcggaattggaaggacaacccatccgtgtgaatagagcttagattatcagaaatttgcaggagcactgaaggagggggagtatcttggcgaatgcatgt

SEQ ID NO: 532 - DNA, 1515 bp, Sorghum bicolor
caatcaaatccaccaggaagggtcgccccgcggctaggccgaccggctctcgccccgccccgcctcgcgccggcgcctctccccgatcccgatctgtgtgcctgcctgcagcctgcgtgggatggagctggaggcggcgccgcggcagcagcagcagcagctggaggaggaggaggaggaggtggtggtggggtgcacatgcggcggcggggccgaggccgcggaccagttcgagcggctccacgacgcggtgctgctcgacgtcctcaaccgcatcggcgacgtcaaggcgctgggccgctgcgccctcgtctcgcgccgcttccacgcgctcgtgccgctcgtcgactccgtcttcgtccgcgtcgactgcgtcatccccgacgacccgacgccctccgccgccgccgccgcaccgggctccgcgccgcaccaggccccggccacggccgcgcgcgggcgcggcggcgcgctcgcgcacatggcgcgcgtcctgctcggcggcatcgccaggcccatccacgcgctcggccagatcctctcccccgccgcggcggccgtctcccggcgctccgacccaccactgcccgcttccccgcccgcgcccgtcgcggacgtctcccaccactcgccctccgaggtgctccgctccttcagggagctgcggcgcctccacatcgagctgcccacgggcgagctcggcattgacgacggcgtgctccttaagtggaaggccgacttcggctccaccctcggcagctgcgtcatcctcggcgcctcgtcggtcttgtccaagccgcccacagggtcgaccacccaggcggaacctgctgcggccgacagcacggccgccgctctggataccagtagggagactgaagagccggggagcctgcctgattctctctacacaaatggagggctcaagcttcgcgttgtctggaccatcagctccctgattgctgcgtcggcgaggcattacttgctgcacccgattatctgtaatcacgaaacgctggagagcttggacctgacagatgccgacggccaaggggtgctcaccatggacaagaggcagctgcaggaactgcgggtgcggcccgtctctccgtcggggagctcgcaccgcacactcatgccggcactcagtatgcgtctgcactatgcaccgctcattgagctgcctgggggaacgctgctgaagggcgcgacactggttgcgatcagaccaagcgaggatgccttgagggagggccaaggggctggggctgcaggtcctgttggtacatgctggatttcagaggcctttgaggagccatatcggactgcggcaaaggtgcttctcaagagaagggcatattgccttgaaatgaactcgttctgagcaccagggattcagttccacatggttctacccttctgacaggatggtgggaagtgggatgcccttcggttaatatagaggaatttatcattcagtccatctgttgtatctgattccagtgaagtggtgac

SEQ ID NO: 533 - DNA, 929 bp, Sorghum bicolor
ggtagaacaagagcagccagagtgaacagaaatggatgcggatggtagctccaagagaagtcgcccagttcgtcgtgctgtgaagaagctcaagttcaaaccgaaggtgcctccacagaagccaaagaaactgagtgcacaaaagccacagcaagaagaccctaagccaattgatcaagacttgatgaagatattgaggactcaccaagtggctgcaaaaagttcactaaataaagaagatgagcgcccaatgcagaataccccctcgacaccaccttctgcagatgttgttaacatgtcaccaacacaattcggattgcagaaacaaaatcaattgccactccaaattcctagatccttccctgttcctgttcattcaggaatgttttacaaagaagatagtgacgacgacgacaacgatgatggtagtgacaatgttgagttgcatgagactcagccaaattcaattgaatgtgaagctttaacacgtccagcagaggagcttgatttgcttcagcaacaaggtagcaaagaaagaatgttcctcttccagctcccaaaatctcttcctttgcccaaaaggacgtccagtaccagtatagttgaaagacaaggaaagcccactggcaaggaggtgaaggaaggatgcaacctgcagcagctgcctcagggttatttgggcaaaatgctggtatacaagagcggcaagatcaaaatgaagttaggagatgtcatgtttgatgtgagcccaggagcagaaactaggatggcacaacatgtagtagctcagaacactcgagacaaacattgttgcttacttggagagattgagaatcggcatgttattgtgactcccgatatggattctttgttgaacgacaagtagagattaggttgtaatctgtagcaactgtagcagctttggcata

SEQ ID NO: 534 - DNA, 1049 bp, Sorghum bicolor
gggcccacctgatcactattacgcgcgagccgcgaatcagacccgtcatcccgtccaaatccttggcctcccctcccactaccagtgaccgccgcctccgcctacccccaccaccaccatccccggcggcccgcgtagcgcgcgcagatggcgacggcggccacggcgtccgcgacggcggcgacccgcttcacgctcctagcgggcgcggggctccgcagccgcatcagccgccgccccaccgccgtgcggttccagcgccagcgggggctcaccaccaccgcgctactgaagaccgccgacctcctgcccaaggcgcagggccagcccgagacgctcgactaccgcgtcttcctcgtcgacggcgggggccggaaggtgtcgccgtggcacgacgtcccgctgcgcgcaggggacggggtgttccactttgtcgtcgagatccccaaggagagcagcgccaagatggaggtcgccaccgacgaggccttcacgcccatcaagcaggacaccaagaagggcaaccttcgatactacccgtacaacattaactggaattatggattacttcctcaaacatgggaggacccgacttctgcaaattccgatgttgaaggagcatttggggataatgatcctgttgatgttgttgagataggtgaaagacgtgccaatatcggggatgttcttaaggttaagccattggcagctttagcaatgattgatgaaggggagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacagatttggtctcggcaacaagcccgcaagcaaggaatatgccctgaaggtcattgaagagaccaacgaatcatgggagaaattggtaaagaggaatattcctgctggagagctctcgttagcctaaccttggcccatgggaagccaccacattctttgaac

SEQ ID NO: 535 - DNA, 754 bp, Sorghum bicolor
tcattaattagctgcagttcaaaggcgccgtccattctagctcggccggtgttcttgccttggcatgcatagccagttggtctgcggcggctgcaagcgtcttctccagtaccgcaggggagccaccggcgtctgctgcccaacctgcaacactttcacagccgccaacccatcaggaccggagatgtctgaactcgtctgtggcggctgcttcaccatgctggtgcactcccgcagcgccaccaacatacgctgccctcactgtagtaggctcaactccacaagatcaggaaaccaaatgggtcacctgtcatgcgggcaatgccggacaactctggcatacccaccgggagcgacgacagtcgggtgcccaacatgccgcaacattaatccagtcagggatgctcggccccagacggttctggtggagaatcctaagacactggatgaaaagggcaaactggtgagcaatgtcgccgttggtgtcacctcatggaaaagatgaccaagaactccttccggaaatcgtcccaggggttgcctatagactaaacccttcgtggacatgtataactactatcatcgtcaacaacaacaacagcagcagctaatgtaaaatcaagtgtgttttgaagcttgatgtcatatatataaaagtaaacaagtaactgttgagcagcaaaagatctgaaaaatgtaaatacgctagccagccgtgtgcgtgcgctagcctgctgtgtactttgagagccga

SEQ ID NO: 536 - DNA, 441 bp, Sorghum bicolor
ccagagccacagccaataactgccatgtccgccacggccaaatgcctcgaggcgacggcagggccgccggcggggtcgggcagcagcaggtgcctgctgttcccagggaaggagcacaggaccagcgtcacggcggcggagttcaagaagtggctgaagcagttcgacgccgacggcgacgggcggatcagcaggcgggagctccgggaggccatccgccgccggggcgcgtggttcgccagcgtcaaggcctggtgcgccgtccgccgcgccgacagggaccgcaacggcttcgtggacgactgcgagatggagagcctcgtcgagttcgccgagaacgagctgggcttcctcatttccaaggagccgacgtcgacgcccaatcgacgggcgcaaccaccactgcggtggtgaaccgtctgttcctctgctgttcattag

SEQ ID NO: 537 - DNA, 793 bp, Glycine max
aaaggatcctaggaacggagcagaacagaactatagtatctcatctctcttgatagtagaagtggtgctgactttcttgtgatcagtgatgctggtgaaatctctctcacttcattctcatgccttctcaagttgcagtttttctgcaagtgaaattggaacaaacccaagttgggttcccttaaagtccttaaatagcctctgctgttcctccaagcctagaaatttatgcagatttttgtgtctgagcactcaaaatggtggcttcagagaaaactctggtgaagttggacttggagatgcagtgataattgtggatcatggctcgcgtcgcaaagagtcaaatctcatgcttaatgaatttgtggagatgtttaagcataaaactgggtatgagattgtggaacctgctcatatggaattagcagaaccatcaataagagatgcttttcaatcttgcgttgaacaaggtgctcatcgcattattgttagtcccttttttctctctcctggaaggcattggactcaggatattccttccttaagtgcagaggcagcaaaggaacatccagatgtgtcatacattgtaactgcaccccttggattacatgaactacttgtggatgttgtgaatgatagaatcaaacattgcttaaagcatgtggctggagatgtagatgagtgttcagtttgttctgggactggtaaatgcaggctctattaatttgtgaaactagattgttttggatgctattaaatgaggctggaagtcgaggaatctgtaggtaccttt

SEQ ID NO: 538 - DNA, 1874 bp, Glycine max
gagattctgtagcttccatgatcctatgatgaccccgggtgagtgttgatgagaaaacaaaggatagagggagatctgtttcagtttgaaacttcaacatctcttcgtcacagtcttagttctttctggtttatctcttctgttgttgttagaacgaacccaacacaacattacacatttcacacagatctggtccattttttgtcactgtcaacagaactatcccttctttcaccaccgccagtgatgataacttgaagaaagaatcagacatggagggtgatcttcaaaggtctctatctttgcgcctaaatcgtagaggagatcgaagtaatcaaaatcctgctaaagattttgaggtgggtttcttttcttcggggagggtacctcaagattaccccatgaagatcgtttggaagaaagggtttgttcggttggttcttgtagcagggatcttgtggatgttattaattcttcttgcattgttgttccatatatggtcttgtcaaacttccgtctcctttttatcagctatgtgtaacaaagatagcaaggtttacaacatgttaggcaatatgggactggtatcaaaacctcacagatgtccaattcctctttccaatgaccctgataaaatagttatcccaactagaagaactcccaacgaaattctaaaaaatctgtcgtatgttatggaagatgaggttccacatagtgaagctcagtcatctcctctatttggaggccatccaagttggaaacaaagggaggaaagtttcaaactaaaatcaaatatgaaggtgcattgtggattcattcaaggtggtggtgctgaaatgaatcgtgtagacatcaaatatgtcaagaaatgcaaatttgttgttgcatctggcatttttgatggctatgatttacctcatcaaccatcaaatataagccttcgctcaaaggagcttttttgctttcttatggtggtggatgaggtatctctgaaattcatgagggaaaatggtactgtcaaagaagacggagctggtggaaaatgggtgggaatatggcgacttgttcttcttaagcatcctccttatgatgaaccaagaaggaatgggaaagttcccaaaattttaacccacaggttgttccctcaagcacagtatagtatttggattgatggtaaaatggagctgatagtagatccattgctaatccttgagagatatctgtggcgaggcaggcatacgtttgccattgctcaacacaagcatcaccgtagtatatatgaggaggctgattcaaacaagaggcgaaagcgatatgctcgaccccttattgatctccacattaaaatctattattacgagggaatgaagccatggagttcaaataaaaagaccaatagtgatgtaccagagggagccatcatcattcgggaacatactgccataaataacttatttagctgcttgtggttcaatgaggttcacctcttcactcccagagatcaactgagttttggctatgttgcatacagattgggggacgcgtttaaattctttatgtttcccaactgtgaatacaattcactgtttgtgttgcaccctcacacaagagagcactcttctcccatagaatgggttaaacagttggatgaacttaagaaaggcaatttaagagaaagtaggggaggactaggcttgtttacgccttatcctggggatcttgattctgttgttctgccaaatgtaacaagaacatcaaaagcaggctgacattttgattattgttttaacatattcattttgttatgtattttttttcaagaatttcttgatgtttattttgtttaatcttaatgaaagtaaagataaggcgcc

SEQ ID NO: 539 - DNA, 921 bp, Glycine max
gcttcatttgtaaatgactaaatggcaatgagctcaattcataccttgtacgctttttctttccgtttgtgtttcccaaattcatctccacaatttaagcctctgaatgccattccactaagaagaacaaaacactacaacaacaacaacaacaacgttaaatttccccgagaaagaacaaggaccagagcaacccttgatgatgttgaaacagaccaactttcctcaatcccacttgttgaaaatgagaaagccaaaaaggatgtagaggaaagtgtgaaagtgttaaaagatgcagctaagacaagaaaggtagcagcagaggagattctttctgcattgtctatcattgagaaagcaaaagttgatccttctgccttttttgaaacccttggtggaaaggaatcccctgggaggacctggatgctaatttttactgctgagaaacaactaaaaggtggtcgatattttcctctcacagctgttcagaggtttgatgctgctgcaaagaggatcgaaaatggaatatatcttggacccattggacagttaacatttgaaggcagactttcatggaaaaagagaatactggcttttgtttttgagaacattcgaataaaagttggacctttgcaacctctagagatcagtctaggaaaaaaggaagacaaagaaccgagtaccaaggatcctttcttcatctggttttatgttgatgaggaaatagctgttgctcgaggcaggagtggaggaactgcattttggtgtcggtgtcgtcgtgccaataactgattgtttttaactttctttccttctctacttctgagttttgatggaaagatacatgtatatatgtaaacatttaagttcagttggtggtaaacatatttgtacttgtttattgtatagttacttgtttgc

SEQ ID NO: 540 - DNA, 2066 bp, Glycine max
aatgcagcggttcgttgcggcggcgtgcggcgtcgttgatggccctgcagatgacttggcagccgagtctcctgagtcagaaacgcaaaaccggaaccggtcctcccttagggctccgtaacctaggcaactcgtgctacctcaacagcgtcctccagtgcctcacctacactcctcctctcgccaatttctgcctccgtctccaacactcttctctctgtgattcttctgggtcttcgtgtccgttctgcatactggagaagcagattgcacggtcgctgcgattggatctcacgcacgacgcgccgtccaagatccagagctgcatccggatcttcgccgagaacttccgctgcggccgccaggaggacgcgcacgagttcctccgctacgtcatcgacgcctgccacaacacctgcctccgcctcaagaagctccgccgcaaaggcgcagaggccaatggcggcggcgacgaagctggtggcagtacagtggtgaaggagattttcggtggcgccttgcagagccaggtgaagtgtctgtgctgtggatatgagtcgaataaggttgatgagataatggatattagtcttgatgttttccatagtaactcgcttaaagactccatgcaaaagttctttcagcctgaggttttagatggcaacaataagtacaagtgtgatagttgtaagaaattagtggccgctaagaagcagatgtccatacttcaagcacctaacatccttgtgatacagctaaagagatttgagggcatattgggtggcaagattgacaaggctgttgcatttgaagaggttttggtgctttctagcttcatgtgcaaagcaagccaggatccccaaccggaatataagctctttggcactattgtgcattcaggctactcccccgaatctggtcactactatgcttatataaaggatgcaatgggtcggtggtattgctgtgatgattcttgtgtaactgttgcaacccttcaggaagttttgtcagaaaaggtttacattctttttttctcgcgaactaaccaaaggccagtgtcaagtagtaattctcttgcttcaaatggtgtaaagcctcattccaatgggagccaaacatctgaatgcccaaaggttggtgtaccaccaaaagcagtgcatgcaaaatcgaattctgagctatcttcttggaaggatataccaagagtttctaagactgctaaagcaccttccagctcacgagtgaagtttgacattaatggaagctcttcttctaaaagaaattctgctcctgtgagtgtgaatgggaaagttgatgtttgtaggaatcagccttcagcagtaaatgggcatgtgaaagattcagcttctttggagaatggtaaggaagattcttcattacccaccaggaatggcattgacgaaaataaagtttctgttgacaaattgaaaagaaaggagtcaacagtttcaaatggacacactggtaatcagacagttgatattcattctgtaaagtcagatctcaaggaagatactgacagaagcaggataatagcaggtagagtgcctgacaattttaagcaagaaagcaatggcctcaacaacaaacctacaatattggggaataagagaaaactacagggggacccatgcattttacttgcacatgatggtcagtctcaagcaagagttcaagaactgaaggacattcttgggaaagaggcaaagtcagttttgaggtcaattggctggactgataaggtctacgaatttatgcgttcaaagaagttacgtgcacaagaagctggaaatttgacaaatggagatgaaataaggaagttgttaataggagatgcgcagggagctttcatatccaagattcccgagtcattgaaacaggatatgattcaacgactccaatcatttagccaagaaaaaatacaattttcaggaccttgatcagagcatgaatgtcgatctgtcgtgctagcgaggcgtggtgtgaatactctgtattactaattattgtagtgatggtggcacccttgctgggatgctcag

SEQ ID NO: 541 - DNA, 660 bp, Glycine max
gcaatatgatacgaaatgcagcgattaaggagttccttaaaaaaaagtatctcaattcacgggctgccattgaagatacttatttttccaccaaggatacttttgagagacatcgcgtggttttcaccgttggaacttccattgcttccgttgccactgcttggttcggttattccttgcgccatttacatgacatcaaagttgatcaaaggcttcaatctatcgaaaattctatgaaaaacaattccaatctccaacattcccaaatcaaagacattgtcgcgggttccgcttccggagcttttagtatccctgcttgtgttgccactgctggaacctccttaatcatcgggtatgccttaggatggagaggtggaatctggtatgcaactaagaagttccgaaaggagcagatgaaaatgctaggacagattacacctaaaagatggcaattgcttgggaagataaagcctagagggtttcaattccagttccttagaaggaaacttacaagattcaaagtgtctgacactgccacaaaaaatctgaaacgagtataaagggtgtttctaccgcacatattgctgtaaaatccgattagtatactactataaatggttctttcaagcaccaatattgatagagatggctgcggatact

SEQ ID NO: 542 - DNA, 945 bp, Glycine max
aaattgcagagagtgggaattgaagagcaatggcttcagtagcttcatcatcatcattttctacaaggcttcttctgcattcacacacacctctagtatgcagaagaagatgcagacccaattttctgaggatggtgactcgctcctgtctcgatgacagctctgctctcctccgagcagcgcaacacactgtggatacatacgtgaaaagtggcatggttgtaggattggggtctggtcatgcttctggtatggccattcagcatttgggtagccagcttcgcactggtaatttgaaggatatagtagggattcccatgtctgtttcaagtgcaagtgaggcagcaaaggctgggattccattggatacctaccaaggaagttctcaaattgattttgcatttgatgatgctgatgttatagaagaaggaacacttgttgctatcattgggcgccggaaattgcaaggtggggaatccataatccaggaaaagtctataataaattctgccaataaatgtgtgttcattatcgaagaaaaccagtacaaaggaggtctggaaggttctattccagttttaattcagtctctcaactggatgacaattgctgaagagattgatgatatgtttctgggtgatgctgaggtctggagaagaccatctatagggcaagcaggtccactaggaggtgacttcccagtagtcaccaaagaaggacataatattcttgatgttatctttacatctccaatagaaaacctcgctgaagtagcaaaaagccttgataaagttgatggtgttgtggaccatggtgttgtttctaaaatcccatgcacagttgtaattgcttctcagactgggctgaacattttggacaaattaactgcagatatagtgggttaggcttcagagcttatagctctgctttgcacatgaatgtgta

SEQ ID NO: 543 - DNA, 1153 bp, Glycine max
cagcacaacacaattcactaagctaaaatcacttcatcatggcttcctcgtgtgcttcctctgccattgcagctgttgccatctccacaccaagttcccagaagaatggatcactcttgggaagcacaaaagcttcttttcttagtgggaggaaactgaaggtgaacaactttacagcaccagttggagcacgatccagcactacagtttgcgcagttgctgagcctgataggcctctgtggttcccaggcagcacccctcctccatggctagatggcagtttgccaggagattttggctttgatcctctaggtcttgcatctgatcctgagagcctgagatggaatgtccaagcagagcttgtgcactgcagatgggccatgttgggagctgctggcattttcatcccagaattcctcacaaagattggtatcctgaacaccccttcatggtacactgctggagagttggagtacttcacagacaccaccacactcttcatagttgagctctttttcatcggttgggccgagggtagaaggtgggctgacatcatcaagccaggctgtgtcaacactgaccccatctttcccaacaacaagctcacaggaactgatgttgggtacccaggtgggctttggtttgacccacttggctggggaagtggttctcctgagaagatcaaggagttgagaacaaaggagatcaagaatgggaggttggccatgttggctgtgatgggggcatggttccagcacatttacactggcactggtcctattgacaacctctttgctcaccttgcagatcctggccatgctactatttttgctgctttcactcccaagtgagaagtgttggaacaactctatgattgcaagccttggagaaacattggcaaacctttttaactaagttgtaacgcttaaatggttttagttgggagtgtttatgttggtgaaagcttgtaaaatggctacttctattgtcatgcatagattgaagattcaatgtacaaatacctatttaaggtttagatgcatttaatgtaaattcaggaagtaatcacagtttttgcatggatgatagaactgcaacaatatttgatggtaactagcgcaggggatattagatggtccttgttaacctgctg

SEQ ID NO: 544 - DNA, 856 bp, Glycine max
aaagtcgaccaagactcattcttcctcattccgaaaaatggcgtctttgcagcaccccacagcttccctccaatccaaacacatcctaatcccccgaaataccctctcccagaaacccatcctcaacctctccctccatggtaccaccttcacccccctcaagctcaaattcggcgttaccaccaccaccaccgccgccgccgccacccgccgctccaccggcgccacgggagccagaatgtcagctaccgcagcctccagctacgccgcggccctcgccgacgtggcggccgcgaacaacaccctcgacgcgacaaccgcggacatcgagaaaatcgacgaaatcttctcggacccgcaggtgtcggactacttcgcggaccccaccctggccgtggagaagaagcgccagctgatagacgagattgcggaatcctcggagttccagccccacacgagaaacttcctctacatcctcgtggacgcgcagaggatagacctcatcaacgagatagcaaaagagttcgaactggtttacaattccttgaccgaaacggagctggcggtggtgacgtcggtggtgaagctggagtcgcagcacctggcgcagatcgcgaagcaggttcagaagctcactgggacgaagaacgtgagaattaagacgctccttgaccctagtttggtggcgggtttcactgtcaggtattcgggctctaagttgattgacatgagcgtcaggaagcagcttgaggatattgctgctcagcttgagctgggtgatatctcactcgccgtatgacatttccctcccttccgttgcgttgctgccttccttctgtttgtttagggatccttt

SEQ ID NO: 545 - DNA, 2106 bp, Glycine max
tctgttctcttcaaaatggagactaataatgcatgtactatgcattctcattgcatagagatgtccatggaagtgcaccaagttgtgccaccacctcacaagagcacccttcagaaactcaagggtaggctcaaggaaactttcttccctgatgatcctctgcgccaattcaagggacaacctcttaagagaaaactgatccttggagctcaatatgtgttccctattctccaatggggtcctaagtataatctcaaactcttcaaatctgaccttgtttctggcctcactattgctagcttggccatcccgcagggaattagttatgctaagcttgcaagtcttcctccaattgttggactttattctagttttgttccaccacttgtctatgctgttcttggaagctcaaaggaccttgcagttggacctgtttctattgcttctcttgtgatgggatccatgttgcatcaggaagtgtctcccacaacagatccaattctgtttcttcagctagctttcacttcaacattatttgccggtctctttcaagctttgcttggaatcctaaggctaggcttcataattgattttctatctaaggccattcttattgggttcatggctggagctgctattattgtctcactgcaacagctcaagagcctgcttggaatcacacatttcactaatcagatgggtctgattcctgttatgacttctgtttttcacaatatacatgagtggtcatggcaaacaatattgatggggatttgcttcttggtactactactattagcaagacacgttagcataaggaaaccaaaactattctgggtctcagctggagctcctcttatgtgtgtcatcatctctaccctcttggtttttgcaattaaggctcaaaatcatggcatcagtgtgattgggaaattgcaagaaggaataaatcctccatcatggaatatgttgctctttcatggaagtcacctggacctagtcatgaaaacagggcttatcactgggattttgtccctcactgaaggtattgcagtaggaaggacatttgcagctctcaaaaactacaaagtggatggaaataaggaaatgatggcaattgggtttatgaatgttgttggctccttcacttcctgctatgttacaacaggtgctttctctcggtcagcagttaacaacaatgcaggcgcaaaaacagctgtgtcaaatgtagtgatgtctgtgacagtcatggtgacactcctttttctcatgccattgtttcaatacacgcctaatgtcgtgctgggcgcaatcatagtcacagcagtaattggcctcatcgatctccccgctgcttgtaacatttggaagatcgacaaattcgattttgttgtgatgatgactgctttcttaggtgttcttttcatctctgtccaaggaggccttgctcttgctgttggattatcaactttgaagatactcttgcaaattacgagaccgaaaacagtgatgttggggaagataccaggaacagacatatatagaaatcttgatcaatacaaggaagctgtgagaatacctggatttcttattttaagcattgaggctcccatcaattttgccaacatcacatatctcaacgagagaacgttaagatggattgaagaagaagaagacaacataaaggaacaattaagccttcgattcttagtattggaaatgtcagctgtgagtgctgttgacacaagtggaatctcacttttcaaggagttgaaagcaacactggaaaagaaaggtgttgagcttgtgttggtcaatcctcttgctgaggtcatagaaaagcttaaaaaagcagatgaagctaatgatttcataagagcagataaccttttcttgacagttggagaggctgtagcttcactttcttcagcaatgaaaggccaatcatcaaccattacagaaggggcacacacaattgtgtcacataattgataaaataagactgcaaaatatataagcaaaagttaaaagaaaaagaaaaaaaaatagaagcagcaacaactacaagactagcatagaatttgcctaatggcaataccaatcatt

SEQ ID NO: 546 - DNA, 833 bp, Solanum lycopersicum
tgttccgattgtataattggtcggcgggagagacgacggacggcggcttctctcaacggcgccaccagaggaaattgaccggagataatcagaagccgataaattcctgcaaggcatggctgccaaactgcctttaccgagctgtcccacaatctttaagcatttgagtgtagatcatactagatcaagatttaatggagctgtctgcctttggggaactgcacattcattgggcagaatcatgcatttcgggctatcttttactaatattgtccaaccttattctttcagaattttcaagaggcgggcatggtctataagaagtgctgcagatggcagtggactagattcttctcctacaaccagcggtagcagtggaactcgacttattagggccatagaggctcttctagtcaaactagatgcgagaattaaggtgttgagaaaaaaccttccaatgaagttgctgtttttcttagtgggtttctattgtgcaaccgcatttgccactgtaatagggcagacaggtgattgggatattatttcttctggattggctgtggctgtggttgagggcattggagctctcatgtatagatctattcctttaattgatggggtaagaagcatcatcactatgttcaattactggaaaactggactgactcttggtctattcctcgactctttcaagtattaacgcggagatgaggagagaagtgtacataaatcataatgccattgaaatttcatagtttatgttgtgtgtttttgtaggcaaattcatgttgtcaagagggtaactatagtctgttgtacagtgtctccaatga

SEQ ID NO: 547 - DNA, 1856 bp, Solanum lycopersicum
ttctcataaccggaaatggtgagtgtagctactgtggatgcccaaaaagcagagatattgtcttctgtgatttctacgaatcaaaatcaatcttcggaagagctacatgtatttagatcgaaattaccagatatatcaatttccaataacataccgctccatgtttacttgttcgaaaggctatcggagtttgaggagaggacatgtattatcgcgggaagtagtggagaaacattcacgtttggcgaaacgtatctcatctgccagaaaattgctgctggtttgacaatggtagggatcgaaaagggagatgttatcatgacttttctacagaactgttcggaatttgtgtttaccattctagcatcgtctatgattggagctgttatcactacggctaatccgttctatacgaaatcggaagcgtttaagcagttgaaagcttcgaatgcgaaattgatagtaactcaatcgcagtatgtggataaattccgtgatcccgcggaaaatgatccgaaaattggggaggatttttcagtcgttacaattgatgatccgccggagaattgcttgcatttttctgtactatcggaagctaaagcagaggatatgccaaaaggagttgttatccaccctgacgaccccgtggctctgccgttttcgtcagggaccacggggttgccgaaaggtgtgatactgactcataaaagtttgataacaggggtggctcaattagtagatggcgacaacccgaatttttacttgaagcacgacgacgtggtgctgtgtgtgcttcctctgtttcatatattcgcgctgaattcagtgcttttagtctcgttaagagctggggctagtgttctgttgatgcaaaaattcgaaattagtgcgctgttggagctgatacaaaaacaccgcgtctcagtcgctgctgtagttccgccactggttcttgcattggcgaaaaatccaatggtggattcgttcgatttgagctccatacggctcgtgctgtccggggctgcgccgctggggaaggagctggaggaagcactccatagaagagtaccgcaagccatatttggacagggatatggtatgacagaagcaggaccagtagtgacaatgtgtccagcatttgcaaagcaaccattttcaactaaatccggttcatgtggctctgtgattcgaaatgcggacctcaaggtggttgacccagaaaccggtagctcacttcaccgtaaccaacccggtgaaatttgcattcgcggttctcaaatcatgaaaggttatctcaatgacgatgaagccactgcacggaccattgatgtcgatggatggctccacaccggcgatataggatatgttgatgacgatgatgaaatatatatcgtcgatagagtcaaagagctcataaagtttaaaggtttccaggtgccaccagctgagcttgagtctcttttaataagccatccagatattgcagatgctgctgttgtgccacaaaaggatgatgctgcaggggaagttccagttgcatttgtagtccgttcagcccaaggttttgatcttactgaagaagctataaaggaatttattgccaaacaggtggtattctataaaaaattgcacaaggtgtattttattcacgcgattccaaagtctccatctggaaagatactaaggaaagatttgagagccaaattgatcgcgacaccacaactataatgcactattcaaaagaccgtctttacgaaaaaaagtatgtaattgtatcgaagatcacttatacttaaaagtctttaacagtatggtatcaagtcttatagatccaatgactagttctgtgaatgttg

SEQ ID NO: 548 - DNA, 889 bp, Triticum aestivum
aaaggatccgcattgtctccactcgctccgtccgtcggggaaaccagcagcagagccagccagcgagaggggagcaggggagagcggcagaagagcagagggccggaggcgatggggctgggcgtgagggcggcgccgttcacgtacgtggcgcacgcgctggccttggcggccgccgccatggtgctgtactggtgcatccacttccgcggcggcctcgccttcgaagccgacaacaagaacctcatcttcaacgttcatcctgttcttatgttgattggctttattattcttggcagtgaagctataatggtatataaggtactacctacggtgaaccatgatacaactaagttgatccatctagtactccatgctattgcgcttgtgctcggtgcggtcgggatatactgtgcttttaagaatcacaatgaaactggaattgcgaacctgtacagtctgcattcttggcttgggataggaacaatatctctatatggtattcagtggatatttggattcttgaccttcttcttccctaaggctgcgccaaatgtgaggaagggtgctcttccttggcacgtacttcttggaatcttcgtttacattttagccctggcaacggcagaacttgggtttctggagaagctcaccttcctccaaagctcaggcatcgacaaatatgggccagagtcatttctggtgaacttcacggcattggttgttgtgctattcggtgcctcagttgttgtagctgctgttgccccagctcgccttgaagagccacagggttacgctcccatcccagaaaactagtatgtgtgaagtgtactgtatacacaaaaattcacaaagtttgctctcaccatagtgcttcgatggtaccttt

SEQ ID NO: 549 - DNA, 1060 bp, Triticum aestivum
cgaaagaggagagagccatcagccatgggaggaggcgtcatgcgcaccgccgcgaaggtcggcctcgctgggggcgccgcggcggcggcgggacgcttccgcaacgtcgccccgtccttcgccacggcccccgcggccgaggccgccgcggcggcgccgctgctgtccgcggccggggagatccccgcggtggcgccggccgggtcgcagtgggcgtcctgggaggtggacgactgggagttcgcggactggaggtccgagtcggcgtccgaggcggacgtggcggtggtcggggggccgaggctggtgttcgccccgccgtcgcgggaggaggccgaggaggccaccgccgagctccgggaagctattgacagggtttattttaaagagactccagtagaagttgttaaggaacatgatcaagagcttagcaagctgggagccgatgcattaattcctgctatgccgggacatgtagtgcaggcttttacattgttaaaatcaagcccagaggctcagagcgttgttgcctcgcttgcatcagataaaaatgtgtgggacgcggtgttgaagaacgagagggttatggaattttacaagagtcaccagcaaactctggtcaatacttttcctgagggcaccgactctagtgactcagtagagtcaccggagaaatttgaagaggcatccccagaatatgcactacccactgcctcacctttgtcggactttgtggacaatgcgaagaagacgatgatggagatggttgacaacataaccaactttttccaagacctgttccacaacccggcagaagccgaggctggaccgggctcatcctctaaaaagccttcgttcgcggagatggcggctggtggatctttcatggctcttgccatggcggtcatcctagttgttctgttcaagagggcatgaacatatactacaaagttcggacgctcttgatgcctattggtccttaaatctgtcgaaaataactcgtgttatgatgaactatggatgtattggacagcgtgtgtctcctgccgtactgtgttag

SEQ ID NO: 550 - DNA, 716 bp, Triticum aestivum
tcgagatggacggccgggacgccacggcggacctgcaggagtgggagctcctcctcgcctcccccaccgccgccgcggcgcccgggccgtacgccgccggcggggaggcggtggtggaggacgacgccgccggggccatcaagtacgactacttcgacctcggctccgacgccaagtacgccaggagggcgtccctgtcggcgggggccgaggaggaggccggcgaggcgagctgggtggagccgcaccccggcgccctcgccttccccgcccgcgaccgcgccgcgctctggtccgactcgtcgtcggacggggagcggcgcgaggacgccgaggccaccgagccgctggtggagacgccccgggaggcggcgggggtggacgagggggcggtggcggagggagggcccgcggcggcggcggcgcggtggtggaggctgcccgtggaggtgctgcggctgtgggcggcgcgcgcggcgaggagcgcctggtcggtgcccgtcgccgtcgcgctgctcgggatcgccgtgctcggccgccggctgtaccggatgcggcggcagagcaaggccgtggcgcgcgtgcggctcgtccttgacgataagaaggcatctcaattcaaggcccagccgatgttacggcgagctccgatgataaagcctatgcttcccggcaatggagtgaccccatggcctgtgctggggcacctgtgatga

SEQ ID NO: 551 - DNA, 2988 bp, Triticum aestivum
agtgtaatggccacacagagtgctgttcggttaattggaggggcaggggctggtggctggactaaggatttcggagcattcgactctccactgggaaatcttccaggagaagggctggggtttgtggagaatggcagtgggatttatgggggctggggggaatctgtcccaaatcgaagtggaagcgcacctcctagcatggagggatctctggctgctcttggtaatcttataggtcagcggagtggaaactttgacaccagtttaggtaacttggacaatgtgactggcagttccacggctgaggagcagttacgtgctgatcctgcatactttgactattatggttccaaggtgaatttgaacccaaggcttcctcctccactaatctcaagggagagccgccgcttcatgaaccgtgttggcaaggttaaagaatggagagtggtctcccaagatgacagcaataaaggctccttatttatacctcgatctactctatcaactcacaaggaagaacctgaagatgataagtctccaaggttggattcgagttctgcagatgatgaacagatgaatcttgtggattttgtgcaggagagcttccagcagaaccccgattcgttgtatgataactcttcacatctatcaagcagcagtattggtgatggcatagctgtccattctaatattgactcatcaaggaatttgccacatgatgttgtcaagccgtcagggttgaattcgtggacacctgtacctttggccagtgtactgagaagtactcttagcaacaatctttcatctacatctgttcccagttcatcatgttctgataataaccctactgtacaaatttctgagcaacagcaagaaaagcagagcatagacatgaagcctggaaatgatgtgcctgtcagtggggcagttgttactgaacttgatgttgtggagtctagcatgaagaatttgaagttatgtttggatagcccgactacgtcacaagttaagcagcagtggcagggcaatttcttgcagcagtatggcttctcacctctagtccaaggcgaccatatgccaatgactcctcatggagcacatctgcccaatgttccttttgttgacaacgtgtctcatactcagctaaaactacccactggtgacatgcagcaacttttacctcaacttggtatgccaacacccttttatacaccgaattcttttggaagcccatattatcagaatttgcatccagccagtgtattggcaaatccttatgtgactgctgggtatgctttgggtggttcaggtttcccacccgttatgactagctattctccccagagttctgctgcgacacctctagacagtcctattactccaagctttagtggtaggccatctggttttccttcagcagggaatcttactgcaggaaccgagtttgttcagccatataaaatgtatgggcaactcggggttcccatgcagccacctattcccgacccgaacttttttcagttctttcagcatccctcttttccacagtatgctagtggaaatcaatataatacattggctccaaggggtagtgtttttggaaatgttgctgataattttgatccacgtaagttatttcctcaagctcaatatccatctgatcagaggcttcaacttccaaaaactggaatttttaattctcctacaaccctaagaggaggaactgttccaaattatcatggcatttcaccctatgttggagcgccattgacttatccaacaagcccagtgtttcaggggcaacctttctctggaattcccccctctggtagaaatgattctgcgaggtttcagtccgcctcaagaagtatcactgctgtttctgggtttcaagggcagcgagaaagggagaaatttgataacccgaaggcatgcactttcctggaagaactgaagtctaacagagcacgtagggttgagctatctgatatcacaggtcgcatagtagatttcagcgctgaccaacatggtagccgtttcatccagcagaaattggaaaactgcactgctgaagagaaggcagccgtgtttgcagaagttcttcctcatgcttcatctttaatgactgatgtgttcgggaattatgtgatccaaaagttttttgaacatggaactcctgagcaaagaagggatcttgccgccaagcttgctggtcatgttgtacctttgagccttcagatgtatggatgccgagtaatacaaaaggctctggaagttatggaacttgaccagaaaatagatctggtccgcgagcttgatggaaatattatgcgatgtgttcgtgaccaaaatgggaatcatgttatacagaagtgcatagagtgtgtccccacggaacatattggttttgtagtatctgcttttcggggacaagttgctagcctttcaatgcatccatatggttgccgtgttattcagagagttttggagcattgtggtggtgattcacgaggtcagtgcataatagatgaaatattgcagtccgcttgcatcctcgcacaagaccagtatggcaactatgtcacacagcatgttgtggaaaaaggaaaaagtcatgaaagggctcaaattatcagtaagttggctgggcaggttgtcaccatgagccaaaataaatttgcatcaaatgtgatagagaagtgtttccaacatggagatattgcggaacgagatcttctaatcagagagattgtggagcagactgacggaaatgataccttgctggcaatgatgaaggatcagtatgctaattatgttgttcagaagatacttgaaacatgcaacgatgagcagcgggaacttctggtcagccgtgtaaagggtcacttgcaagcactgaggaagtacacctatggcaaacatatcgcgagccgagtcgagcagctttgcggtgaaggagatgccgagtgcgactcataagcgacgtaa

SEQ ID NO: 552 - DNA, 637 bp, Triticum aestivum
cgcagagtcaaccccggcgcggcggccgaggccagccatggaggccgcggcggccacggggctccgccccttcgccgcgccgctcggggccgcgacgagggcgggcgcgggcgcgggctggcggtgcgcgccgggccagcggcggcttgggaggggcgcgcgcgtggcggcgaggctggacgggggcgtcgggaagggggtgcccaccaccaactacgtcgtgccgctcgacaaggccaccgggatcacccgcccgctcgtcgagatcctcagggacctcaacaagcgcgtccccgacaagatcatcgaccccgacaccaacgccgtcccctggtaccatgccaacagaatgctgagcttttatgcaccaggttggtgtggtgaagttcgtgatgttacttattccaacagtggaactgtgaccgtggtctatcgagtgattctgaaaggaacagatggagaggctttcagagatgccacaggcacggcaaaggtgcatgagggacgcaacgatgacgctgtcgcggctgcggaggaggcagcattcagcaaggcctgcgcacggtttggtttcggcctgtacctgtaccaccaggatgagatcctgtaggggggacgtcacagctttgagatttga

SEQ ID NO: 553 - DNA, 511 bp, Triticum aestivum
accccatggccttcatgcgcacctcctccaatgcatcctctggcatgggagttgctcctgatatcagggagacattcctggagcttcagatgaagaaggcatttcgctatgttatcttcaaaatcgaagaaaagcaaaaacaggttgttgtggagaagacaggggctacaactgagagttatgatgatttcctggcttgtctcccagaaaaagactgcagatatgccctttatgattttgactttgttactggggagaatgtgcagaaaagcaagattttcttcattgcctggtcccctgacacatcccgcatccgcgccaagatgctgtactccacctccaaggaccgcatcaagcaggagctcgacgggttccactacgagatccaggcaactgacccgaccgaggtggagctcggcgtcctccgtgaccgggcgcactagggcggatcgatgatcacccgtgggcttcagtcggatgcaaattcatgctgtccgtggtaatgctgttg

SEQ ID NO: 554 - DNA, 478 bp, Triticum aestivum
aaaggatccgagagatgaaggaggcgacggcgtcggggggcggcgcgacggcgggggcgaacgacccgaggcagccggggacggcgaggccgtacgcgccgcccaagctgtcgtcgcaggacctgcccgtcgactacgcgggcttcctcgccgtcgtcttcggcgtcgtcggcgtcatgctccactacaaggtttgctcgtggatcgccatcatcttctgcgcgcagtcgctggcaaacatgaagaacttcgagaatgacctcaagcagctctccatggctttcatgtttgctgtcatgggtttggtgacgaactatttcgggcctcgcccaggcggcacaaagcgctgatctgcataccatgcgccgtatgaagtttcctgttcaatttttggtgcctcggagccactggcatggtggtgcccacccacatttctgaatccttgagtcaggcaggtgtcaaatgtaccggtaccaaa

SEQ ID NO: 555 - DNA, 923 bp, Triticum aestivum
cctgctttctgttctgcctgcctcccaacaatggctctccccctcgttcgcctcctcctcccgtcgctccacgcgtgccagccgccgctccgccaccctgagtactccgccccacctcgccacagccacgtttccttcgctgtccccgctgccgcccgctcctccggcaaccgcttggcgtttgctgtctgcgctgctagcgcctcggtcgccccggcgcctgcggaaactcaggcggatgcggaggatgagcagcccgtggggccgaagacgcggcttatcgcgatgaacatcccgtgggatttcacgcccgacgacattcgcgttcttttcgagaagcaaggcaccgtcgtcgacgtggagctttcgatgcacagttccaaaaaaaacagaggattggcatttgtaaccatgggttcagaagatgaggctctttcagcactcaagaatctcaatttgtctactttgaacgatagaacgattaaggtggactttgcaaaacctaaaaagaagcaacctgctgtgccgtcagctcctgtggagaaaaatgttgtgtttgtcgggaatttaacgtggagagtgagatcccgtcatcttcgggagttatttgcctcaaccccaggtgtccaatcagttgaagttatctttcataccaccacaccaaggcgatctgctggctatgcatttgtttccttttcctcgaaagaggaggcagaggctgctatttctacctccaatggcaaggaattgatgggacgatccattaacgtgatgttcaaagaggacactgtcaaaaagaacaagtcttctgattcagaggaagagaagttggaggaggcagaatcttctgaggagagtgatagctaagaatggattattgtgagaaccacagaaagaagttcaatgagttgatctgcaggact

SEQ ID NO: 556 - DNA, 1555 bp, Triticum aestivum
gcctggatgagctgcttctcctgcttcggcccggccctggaggcggagggccgcaagccggtgcccgacgccaaggacccccgcgccaaggacggcgcggtctcggatcgcgccggatcagataaattgaggctgcagggtggatcagaccctaagaataatcatctaaccatccctcgggatgggagcagccaaaacattgccgcacagattttcacttttcgtgagcttgctgctgccaccaagaacttcagacaagattgcatgttgggtgagggaggtttcggacgtgtatataaaggtcgcctggagagtgggcaggctgttgctgtgaagcaacttgatcgtaacggtctccaaggaaatagagaattccttgttgaggtcctcatgctcagtctcttgcatcacactaaccttgtcaatctaattggttattgtgctgatggtgaccaacgcctccttgtttatgagtttatgccactgggctcattagaagatcacttgcatgatgtgccacctgagaaggaacctcttgactggaacacacggatgaagatagctgcaggtgcagccaagggcttagagcatcttcatgacaaggccagccctcctgttatttaccgggatttcaaatcgtcaaacattcttcttggtgaagggtttcacccgaagctgtctgactttggccttgcaaaactcggtccagttggtgacaacactcatgtctcaacacgtgtgatgggaacttatggctactgtgccccagaatatgctatgactgggcagctcacagtgaaatcggatgtctatagctttggcgttgttttccttgagctgattacagggcgcaaagcaatcgacaacaccaaaccccaaggagagcaaaacctggtggcatgggctcgtccactcttcaaggatcgcaggaagtttcctaagatggctgacccaatgcttcaaggccggttccccatgaggggtctgtatcaggctttagctgttgctgccatgtgtttgcaagagcaagccacaacccgtcctcacataggagatgttgtcactgctctctcatatctagcttctcagacatatgatccaaatgccccaactcaacatactcggagcaattcgtcgaccccaagggccagaaatgttggtgggcggaacagcgaacagcgcaacggccgctcgccaaatcatcattctcccaggacatcaaagcacggaggggaggtcagccggactagttctactggtggtgattctggccggaggtcaggattggatgaaatggacatggcaggatcacaggcaggcagtccagctcagacaggaaggaagagagaaaccccaaggactgctgacaggcagcgcgccatcgcggatgctaaaatgtggggggagaactccagagagcggaagcgaccgaacggcagctttgatagtacaaatgagtaaactagacagttctctttcacgacgtcgctctagcagggggtcgacgagtttgctcatcagcaccagacgggccaggtttaggaacacggtcttt

SEQ ID NO: 557 - DNA, 1157 bp, Triticum aestivum
atctcttcttcatcttcggctcctctcccccgatctctcgcccgcgacctgctccgataccctgcgaagtacggactccggcgagcttacggggctcgcgcggcgagctcgcggccgcgatggacgaggcgggcacctcgtcgtccgcaggctccgccccgcgcggagggcgcccggcgagatcgggagtattctataagttcacccagcaggatcttccagcttggaaaccggcaatgacaccaggatacgtgatagccattttcttgataattgggattatttttgtaccgcttggactaatttgtcttcaagcttcaaacagagttgcagaaatcgttcaccgttatgatattgattgtgtacctaatgcttacagaagcaataagcaggcctatatcaaagacagctcgatttcgaaggaatgcattcagaaagtgaaggtacaataccacatgaaagctccaatttatgtgtattatgaactcgacaacttctaccagaatcatcgtaggtatatcaaaagtagaagcgacaagcaactacgctatgggctgaaatacactgatagctcatgcagtccaatagaaaagagcgacggccttccaattgttccctgtggattgattgcctggagcttgttcaatgatacttatgattttacccgtggatccatgggaatagtggttgatcggaaaaatatttcatggagaagtgatcgggagcataagtatggcaaggatgtctatcctttcaactttcagaatggatctttgattggaggaggaaaacttgaccctgatataccactaagcaatcaggaagatcttatcgtgtggatgcgcgcagctgctcttccccagtttcgaaagctgtatggtgtcatcgaagaggatatacaagctgatgaaatcattaccatgcacataacaaacaattacaatacctacagctttggtggaaagaaaagcctggttcttacaacatcaacctggctaggtggcaagaatgactttcttggatatgcatatcttatcactggttccttgagcattttcttgtcgattctctttgctctgatccatgtgaaaatcccaaggccacatggtgatgctgcttacctatcttggagcaggaaaaacggcaataactaatga

SEQ ID NO: 558 - DNA, 1875 bp, Triticum aestivum
atctcggcggcttcctaccccctcctcgccccgatctaactcgccggcggccatgtcgcagccggctgccgccgccgttgcggcgcagccgcaggggcaggccgcggctgggcggcagggaggcggcctgggccagagcctcgccggcatcgtgcggatggcggtgttctggtacttcgcgtccaagttcttcggccccaagcgcgcccccacggagccggggttgctcatgtccaacctctttcagaagggagagccaatggatatgtggatgtatttatcggagaatgataaatttagcgactttggtaatgaggatgcactcatctggcatgaaacaaacataccatatgcagtctggacacctaccagtaccagaacacacacactgacatactatccaacggaggctctcaagcacaatggctctttgtatgctcatgtttatttttcccgttcgggttaccctgtggaccctaccgatcctgaatatgagcaaaaatctgcatttggaaggacacatcctattgtggcatacttgcggaaatcaaaagctggtcacaagaagagcttgcttggagattcggatgagtccgaggaaaagctaccccctaaggagaacaaagagtccgaagacaaagaggagggcccagttgaatatatttcttattggaaaccaaatgtgacaataaatcttgttgatgacttcacacggtatccccaaaacaacattcctccaaatgttgctccatatttgaatgtggatccaactacaaacagctactatccaactgtattcttcaatgaattttggctgttgagggacaaattgacagcactcaacaagactgtgaaggaactgaccttgaaccttgaagttagtcctatcagcatgaccaagtggcaattatttctacagattgagcagtctttccaagttcatcgtagttacggaagtatgcttgaaggcgaggctgatgagctcaagagggttttccttgaaggaaatccatatctactgggattgaccatgattgtatctctgttccactctctgttcgatttcctggctttcaagaatgatatccagttctggaataaaaacaagtccatggaaggtctttcagcgaaatctgttgttctgaacttcatttgtcagctgattatatttctgtacctgcttgacaatgatacatcatggatgattcttgctagctctggagttggtgtgtgcattgaattctggaagataggaaaagcgatgcatgttgagattgacagaagtggaaagattcccatgttgagattccgggatcgtgagtcatatgcacagaataagaccaaggagtatgatgcgcttgcgatgaagtatcttacatatgtccttctagtccttatggctggttttgctatctattcactcaagtatgataaacacaagagctggtactcgtggatactctcttccctcacaagttgtgtttacatgtttggtttcattatgatgtgcccacaattatttatcaactacaagctgaagtccgttgctcacatgccatggagacaaatgacctacaagttcctcaacactataattgatgatctgtttgcatttgtgattaagatgccgtggttgcatcgtctctcggttttcagagatgatgttatcttcttgatatacctctaccagaggtgggtatacccagttgacaagaagcgtgtcaacgagtttggctttggaggggaagacgaaccagcagcaccccaaactttggaaggagcagcggctgcccaacagatcgaggccaaggctgagacgagcacggaggacaagaagacaaagtgagcctccgcaagcttcaatcgacacagtag

SEQ ID NO: 559 - DNA, 1616 bp, Triticum aestivum
acatcactcgggatctcctcccctaacccctcctcatcgggcaggatttttttcctttctctctagggggctccgccccgcatctccccgctccgatcgatggcgtcgtcctgcatcccgacgggcatccggctgccggacctggacatggtcaaggcggcggcggtcggggcgtcgtcggcgccgggcgcgggggcggcgccgctgcggccggcgcactcctcggcgtcctcggcgctctccgacgcctccaactcctcctcggcctcctcgctctcgctcaagcgggcgcgcacgccgcggaagcgccccaaccagacctacaacgaggcggccgcgctgctcgcctccatgtacccctccgtcttccccgccggggacagggcgccgccgtcgccgaggctcctcggcctcgcctccgcgctcgccgacgacccctcccgcgcggacctgctcccgcccttccccgtcctcggcaacgccgcctgcctcctccgcgacgccgccgcgccgccgaccacgccgcggagccccgtcctcgccagggcctgcccgtcgccggcggccgtcagcagcgccttcaccgagttccgcgactccgcgccgtcccccgggacccctgacggcgccgccggcgcggacgggcccggggagctcgactatgaggatgatgacgacagctttgacgcagactctttcctcctcggcggcctcgacgagggcgccgccgccgaggggatcgatggcatcatgggcaaactcagtatggaaagcggcagcgatgcctcttccattaaccgtgtcctctccagctccggcatagacccctacatcagaaacctcatggtgctcggactcgggttccggcgctcccggtccaacatcaagcaggcgctcaagcggcatgacgatgacagcgaatggtggatgtgccctgccattccattgaaggacattatgccggcgcctcccccatcgatggaaccaccgccgccggtggagaagaagaagaagaagactaagaagaaggcgttgaaggacattgccgctgggccgtgcattacatgtgttaaggaggaaattcctgaccctgcttatggggatgatggaatttttggaccgaaggcgcccaagacaggattgggcctgagcctcaacactgaggaggtgctgaaggcgtggtatgacagaggctccgtgttcgctgacggcaacatacctgatgcatcatccactgatgggctggctaaactttcagacattgaactgtttctagagaatggtgctgctggtgctatcagggaaggcagcatacagaaattgaagcacaagcagaagcagtgcactcccctcctctcaaataagactcggtaccaagcacggaaggtgcacgccgagtctcgtcctcgggtcaaggggaggtttgtcagccaggcggctcttctgcagaaagccgcggagaaagagacctaggggaggacgttcttgctcccatgaacattctgtcttgggatttcatttcattccccctagaagtgaagcagatgagggcttcttttcttttctgcacttatgtgatcatgtagagagggtagagattgcctgtagagtggctt

SEQ ID NO: 560 - DNA, 739 bp, Triticum aestivum
aaagtcgaccaagaaaaccagacaccatccggcgacgccatgaagcacctcctcctcccctcccagctccctctcctcctccacggccgcgcctccaagcccctactcctccacgcccgccagcgccaccgccacgccccaagcgcggcacccgacggcaactccggcgacacctccacggccgcgtccgagccgcctcccacgaacacccagcccagcccgccaccctccgcacctccgtccaccaactccggcaccaccagcgtcaagacccgcctccgttcaaggaaccaggcccgccgcgtccaggagccgtacctgcccccggtggaggtgaagatgatgcggggcaagggcaaggcgaacgcttccgcggcgccgaggagggagaaggagaagcggaagaagacgtgggacgagatgagcctcggcgagaaggcctacgagctgtacgtcggggagaagggggccctcttctggctcaacaagttcgcctacgcctccatcttcatcatggccggcgcctggatcctgttccgcttcgtcgggcccgccaccgggctctaccagctcgacgcgccgccgctggcgcccacggacgtcctgcgcggctcctagcgagagcgagtgcctaggtttcttgatagatagctcggcgggtaagataagggatgggtgaccggaaaagaagatcgatggataattgctgcttacaatggcttcgatggtagaattcttt

SEQ ID NO: 561 - DNA, 1742 bp, Triticum aestivum
caagaagcaggatgaggagcctgctgggggaggagcgcagcttcatcatcgagagcgacgacgacgacgaggaggatcccgcccacaggggcgacggcgttggccatggggatgatgggtcgtcgtcggactcgtcgtcgtgcgccaccccgcgcggcggcggcggcggcggcggggacagccagcccaactcctacaccaaccaatggccgcagagctacaggcaatcgatcgacattctgagcaacgtgcagtcgccgagcctggggttcctggggaccccgacgctgagccggctgtccaactccttcctcaacagctccttcctcaacaactcgttccgaggcaaaacccccgagatcgtctccaacctcgtcaagccgctcatacgccccacgacaagcgacgagcaacagcaacagcaacagcagcatgaggatatccggaagagctcgcagtacctcctgccgtcgaggaagccgtcgctgcagcagatccccgaggatcagaagccgctggtggttggtcatgaggtttctccctaccagcagtgctcttacacccagggagctatgaacggaataaatgttctgtgtggtgtcggaatcctgtcgacgccttatgccatcaagcaaggggggtggctgggactcgtgatactagttgtatttgctctgctcgcatggtacaccggtgtgctgctgcgccgttgcctagacagcaaggagggccttcagacgtacccggatatcggccatgctgcctttggaaccacgggtcgcatagccatctcgataattctgtatgtggaactgtatgcctgctgcatcgagtatttgatactggaaagcgacaatttatccaagttgtttcccaatgtacacctgagcattgggggcttgacgataaactcgcatgtgttcttcgcaatcttgacgacgcttgttgtcatgccgaccacctggctccgtgacctcacctgtctgagctatatttcagctggaggtgtggttgcatcaatccttgtggtcatctgcttatgctggattggggttgtcgatcatgtcggctttgagaacaaagggacggcgttaaacctcccgggaattcctatcgcgattggactgtacggttactgctactcgggacatggggtgttcccaaacatatactcttctctgaagaatcgcaaccagtttccttccattcttttcacctgcattgggttctctaccattttgtttactgccgccgcggtgatgggatacaaaatgttcggcgaagccaccgagtctcagttcaccctcaacttaccagagaatttggttgtttccaagattgccgtctgggctacggtggcaaatccaataaccaaatatgcattgaccataaccccactggccatgagtctggaagagttgctgccgcgaagccagcagaagtactccaacataattttgcttagatcagccctggtggtgtcaaccctcatcattgctctgtcagttcccttctttgcgcttgtgatggctctgattggttctttattcgcgatgcttgtgacctacattcttccttgcgcctgctttctggccatcctcaaggcaaaagcgacttggtatcagactgcgacatgctcattcatcatcgccgtaggggttacctgcgcctgcgtggggacatactcatccctctccgggattgtccagaactacgcaacctgattctccctacatacataa

SEQ ID NO: 562 - DNA, 652 bp, Triticum aestivum
aaagtcgacagaggaaagcaggaggaggcgacagacaggtgcccgcccgcccgccggagatggcgatgaccgtggaagtgctcgctggacttgtttgtatgttctccacgagtgttcttttgcaaatcctggcatgtgcgttgtacaacaattggtggcctatgttagcagcgctcatgtatatcattgtgccaatgccatgcctgttctttggcgacggatccacacggttcttgagtagcggagagggtggagcgtggatgaaagcagccaagttcctgaccggcatgtctgccatgggaagcctcgcaatcccggcgatcctgaggcacgctggcctgatcgagacgggggccatgttcatcgagttcacctccttcttcatcctcgtgtgcacggtactgtgcttccacagggccaccctggacgaggagtggtaaaggctcgcgcaggaccacaaggagtgcctgagagaagaacgcctgttaggatgtcgaaaagaaatcccttggtgggagggagctaacgtggaactgtgtgtacaaagaagcgtgcttcaagcgcttgactactgtatttacgatacgcggacccgagattcggtaatctagttggtaatccgtgctgaacaggtcgtgtaaaggaattcttt

SEQ ID NO: 563 - DNA, 625 bp, Oryza sativa
aaaggatcccagaagtatcgcggaaactgacgccttcttccgggagcaactgagcaaagggttcttattaataccatggatcagaaacctaaggatgattttgatttccttgaaccatcagtactcttagatgagacacactatcaaacgggtttcaagaatggttatagtgagggcttggtgtctggaaaagaagagggaaggcaggttggtttaaagaatggttttcaggtaggtgaagaactaggtttttatcagggatgtctggatgtttggacgtcgttggtttcaattgatcaagatgcattctcagctcgggtcaggaaaaacattgagcaactagctgcactgttgagaagctatccgttgtcgaacccagaagacgagcaagttcaagatataatggagaagataagactgaaattcagggttatcacagcaagtttaggtacaaaactggagtatcaaggtcgccctacatcatccaagcaggatgttgaggatctgtaactagtttagctttcattgtcaaattaccatgttgaaatgatatatgagacccaaacatgtttatgtaggtttcggttaacgaatacttgttcgagtgaatgctgctaggtacctt

SEQ ID NO: 564 - DNA, 582 bp, Sorghum bicolor
aaaggatccgtctgttgcatgcctaaactaggctcttgttcatattatggatcagcaacctaagattgaggttgattttcttgacccaacattactcttagatgagacacattaccaggagggatataaaaatggctataatgatggtttggcatctggaaaggaagagggaaggcaggttggtttaaagatgggtttccaagtcggtgaagaactgggtttctttcagggctgtctggatgtgtggacgtccgcaattctcattgatcagaacgccttctcagctcggctcaggaagaatattgagcagctagctgcactggtgagcagctatccgctgtctgatccagagaatgaacagattcaagacgtgatggagaagataaggctgaaattcagggccatcactgcaagcttaggcgtgaagttagagtatgaaggtcaccccacatcatcaaagcaggatgttgaggatctgtgagcgcgatggacattacattttagtttctctgtctttgctttcttaagctctccaaatcttgtcttcaacttattgggatcatgaggagctacggtaccaaa

SEQ ID NO: 565 - DNA, 2399 bp, Zea mays
cctcgatgggcccggccgcgcagccgccggacgccggcggcggtggggacccggaggcgtggtacggcagcatccagtacctcatcaacatctccgccgtgggggccgcctcctgcgtcctgctgttcctcctcgttaagctccggttcgaccaccgccgcatcccggggccctccgcgctcgccgccaagcttctcgccgtctaccacgccaccgcggcgcagatcgctctccactgcggcgccgacgccgctcagttcctcctcttcgagcgcgcctccttcctcatcctcgccgccgtcgccgctgccgccgtcgccgcggcgctcccgctcaacctcctcgcgggggacgccgccgtcgtcgaccagttcgcttccacgaccatctcgcacatccccaagtcgtccccgctcctctggctccacctcctcctcaccgccgccgtcgttgccatcgcgcacctcggcatctctcgcatggaggacgcgctacgcatcacgcgcttccgcgacggcaacggcaaccccagcgaccccaactccagctccgtcgccgtcttcaccataatgatccagggcatccccaagacgctggccgcggacaagaccccgctcaaggactacttcgaccacaagtaccctggcaaggtttaccgtgtcatcgtgccatttgatctatgcacgctggagcatctcgtcgagcaattggggaaggtccgtaacaagatctcttggctggaggcaaggttgggcgcccgcgacctgtttgatgacattgtgcacgataacgacgacacagtgcagtcagaagagcattggtttgtgcgaaggtgcagagggctgtgggcaatggcaggggagaggctagggttcactgacgaggagagattgaggaagttgcagactaagaaacttgtgctcgcaagcaggctatctgattataaggaagggtgcgcccctggcgctggtgtagcttttgtggtgtttaaagatgtctacaccgcaaacaaggcggtaaaggatttcaagatggagaggaagaagacaccgattggtaggtttttcccagtgatggagctccagctcgagagaagtcgatggaaagtggagagagcaccaccggcatcagatatctactggaatcatctaggtcttagcaagatatcttcacggctgaggaggattgcagtcaacacctgcctaattttgatgctcctgttcttcagttcacccttggcaatcatcagtgggatgcaaaacgcggcacgaatcatcaatgtggaggctatggatcatgccaaatcatggcttgcctggcttgaaggttcaagctggttctggaccataatctttcagtttcttcccaatgtgctcatctttgtgagcatgtatatcatcatcccgtcggtgttgtcgtacttctccaagtttgagtgtcatctgacagtgtcaggggagcagagggctgcattgctgaagatggtttgcttcttccttgtcaatctcatcctattgcgtgctcttgtggaatcatcacttgaaagttggatacttagcatggggcggtgctacttggatggtccagactgcaagcagattgaacgctatttaagcccatcctttttatcaagatcatcgctttcttccctggcattcctgatcacatgtacctttctgggaatatcttttgatctgttggcaccaatcccttggataaagcatataatgaagaaatttaggaagaatgatatggtccagttggtccctgaagagaatgaagactacctacccatgcagaatggtgaagaaactaataatttgacagcacctctaatgcctgagagagaagacggtggccttttggataatatcgaggggcatgatctttccctgtacccactaaacaggagcttccatatgccaaagcagaaatttgacttcgcacagtactatgcttttgacattactatatttgccctcacactgatctactccctgtttgctccgctcgtggttcctgtgggtgcgacatactttggctaccgttatctcgtggacaagtacaacttcttgttcgtttacagagttagagggtttcctgccggcaatgatgggaagctgatggacagagtgttgtgcatcatgcaattctgtgtgatcttcttccttgctgcaatgctgctcttctttgctgttcagggtgactcgatgaagctacaggctatatgtactcttgggatgttagtgttctataagttgcttccctctagaagcgatcgcttccagccatctttgttagaagggatgcagacagtgaatagctttgtagatggtcccacggattatgaagttttttcacaacctgacctggattggagtctgtatcaatcctgatga

SEQ ID NO: 566 - DNA, 1592 bp, Zea mays
cccccatggctatggcgacgacggaggccaccacgctgacggcgctgctcaaggaggcggcggccgccttcccgacccgccgcgcagttgccgtaccgggcaggctggagctcacgcacgccgccctcgacgctctcgtcgacgcggcggccgcacgactcgccgccgacgccggagttctcccgggccacgtcgtcgcgctttccttccccaacaccgtcgagctggtgatcatgttcctggcggtaatccgcgcgcgcggcgtggcggcgccgctcaacccggcctacacgcaggaggagttcgagttctacctctccgactcggaggcgcgcctcctcgtcaccaacgcggagggcaacgcggcggcgcaggcggccgctgccaagctcggcctcgcccacgccgccgccagcctccacgacgcggccggccctgtccacctcgccggcctcccggcccatgctccggagaacgggtcccacggcggcggcgcggcgggctctctctcccccaacgacccgtcggacgtggccctgttcctgcacacctccggcacgacgagccggcccaagggcgtgccgctgaagcagcgcaacctggcggcgtcggtgcggaacatccggtccgtgtaccgcctcgccgagacggacgccacggtggtggtgctgccgctgttccacgtgcacgggctcctctgcgccctgctgagctcgctggcttcgggcgcgtccgtggcgctgccggcggcggggcggttctcggcgtccacgttctgggccgacatgcgggcgtcgggcgccacctggtacacggcggtgccgacgatccaccagatcatcctggaccggcacgcgtcgcggccggaggcgtacccggcgctccgattcatccgcagctgcagcgcgtcgctggcgccggcgatcctggagcggctggaggcggcgttcagcgcgccggtgctggaggcgtacgcgatgacggaggcgtcgcacctgatgacgtcaaacccgctgccggaggacgggccacggaagcccgggtcagtggggcgcgcggtggggcaggagctggcggtgctggacgaggaggggcggctcgtggcggcggggagccccggggaggtgtgcgtccgcggggacaacgtgacggcgggttacaaggggaacccagaggcgaacgaggcggcgttccggttcgggtggttccacacgggggacatcggcgtggtggatgaccaagggtacgtccggctggtggggcgcatcaaggagctcatcaaccgcggcggggagaagatctccccgatcgaggtggacgccgtgctgctaggcctccccggtgtggcgcaggcggtgtcgttcggggtgcctgacgacaagtacggggaggagatcaactgtgcggtgatcccgcgggacgggtcggcgctgcgggaggaggaggtgctggcgcactgccggcggaacctggcgtcgttcaaggtgcccaagaaggtgttcatcacggacgacctgcccaagacggccaccggaaagatccagcgccgcatcgtggcgcagcacttcgtgcagccgaccagtgcctgatga

SEQ ID NO: 567 - DNA, 2480 bp, Zea mays
cagccatgtatttcgccaaactcgatgactcgcccatgttccggacgcagatacaatcacttgaggagagtgctgaattgctgagagagagatgtttgaagttccataaaggttgccgtaagtatactgaaggactaggggaagcatacgatggagatattgcatttgccagctcacttgaaacatttggaggaggccacaatgatccaatgagtgtcgcttttggtgggcctgtaatgaccaaatttacaattgccttaagagaaattggaacatacaaggaagtcctgcgctcccaggttgagcacatgttaaatgacagattactgaattttgttgacattgatttgcatgatgtgaaggatgctcataagcgctttgacaaggctagcctctcatatgaccagattcgtgaaaagtacctatcattgaagaaaggtacccgaccggacataacaacagcaattgaagatgagcttcacagtgctagatcttcatttgagcaagctcgtttcaacctggtcacttcactttcccatgtcgaggcaaagaagagatttgaatttttggaggctgttagtgcgacaatggattcacatcttcgttattttaaacaaggatatgaactattgcatcaaatggagccatatattaatcagattcttgcttatgcacagcaatcacgagaaagagcaaacaaggaacaagcttctctcgtagagaggatgcatgagtacaaaaggcagatagaccgggaaagtcggtcttctataaatggtttgaatgattcttataatggtgatcgaatgcagacaattggcagaagttcacataaacagatcgaggcagttatgcagtcaacttcaaaaggcaaggtagagaccatccgtcaaggttatctttcgaaaagatcttcaaacttgagagccgactggaaaagaaggttcttcgtacttgatagtcgaggaatgctgtactactatcgaaaacaaattactcggccacctgctggttgttccatgcaaagaaacgttaacccccctgaacatggttctgggttgttgagcagattgttctcttctcattaccatatacatgatgaaaagtctgtcgcacgtcatactgtaaatttgttgacatcgaccattaaagttgatgctgagcaatcagatttgaggttctgtttcagaattatttcacccacaaagatctacacattgcaggcagagagtgcagtagatcagatggactggattgaaaagataactggtgttattgcctctttactgagctcacaatcgccagaacagtgttttatgtcaagccctaagggcagtggtcatgataggagtaccagtgatggaagctcctttacaagttcagtggaatttgaaccttccgtaatcgatgatttagtactggagaagtactctggaaatgggcagcatgatgtaataagaggcacacatcatcacagaaccagcatgaaacctgaaaaaccaattgacttgcttaggaaagttgatggcaataatatgtgtgctgactgtggtgctttggaacctgattgggcatcattaaaccttggcgcacttctatgcatagagtgttctggggtgcaccgaaatcttggagtgcatatatcaaaggttagatctctgacacttgatgtcagagtttgggagccatcagtaatcaatctctttcagtcattaggcaacatgtttgtcaacaatatttgggaagacatgttgccagatgataattcaagtgctgatggatcagacacatcacagtacctctctgttagcaagcctaaacacaaagatgtattctctgccaaggagaagtttattcatgccaagtatgtagacaaagagtttatacggaagcgtagcatggatgagaatcaattagctgagcagatgtggaatagtgtagctgcaaatgacaagaaaacagcatacagtctcattgtgagatcacgtgccaatgtaaatttagtttacggagagatgccttctagcccatttttgactcttggaaaggcacttcagcaagagcaaccggtttcaccgcctgatggaagtcctaaatttttcgattgcaattcacatgacaagatttctcctcgggagcccctttcccctgctagcacgagttcacgcacagatgacatggaggacggttgcgaaggtctttccttgctccatcttgcatgccgtgttgcagacgttgggatggttgaattacttttgcagtatggtgctagtgtaaatatgaatgattctaggggtcggacaccccttcatcactgcattttgaaaggaagacatcggcatgcaaagcttctcctctccagaggggctgattcacaagccatggatcgagatggtaggacagcattgcagtatgcaatcgatggtggaacaagcgacgaagacattcttgcattgttagaggatcatagtagatgatga

SEQ ID NO: 568 - DNA, 1771 bp, Setaria italica
cttcgcttagcttacctgctgctgccagctggatcggatcagcgtcggcccggcgatggaggcgggggcgtgggcggtggtcgcggcggccgtggccgtgtacctggcctggttctggcggatgtcgcgcgggctcagcgggccgcgggtgtggccgctggtcggctccctcccggggctcgtgcggcacgcggaggacatgcacgagtggatcgccgccaacctgcgccgcgccgggggcacgtaccagacctgcatcttcgccgtgcccggggtggcgcgcaggggcggcctcgtcaccgtcacctgcgatccccggaacctggagcacgtcctcaaggcccgcttcgacaactaccccaagggccccttctggcacggcgtgttccgggacctgctgggcgacggcatcttcaactccgacggggagacgtgggtggcgcagcgcaagacggccgcgctcgagttcaccacgcggacgctgcgcaccgccatgtcgcgctgggtgtcgcgatccatccacggccggctcctgcccatcctgggggacgccaccgcggacggcaggagcgtcgacctccaggacctcctgctccgcctcacgttcgacaacatctgcggcctcgcgttcgggaaggatcccgagacgctcgcgaggggcctgccggagaacgacttcgcctcggccttcgaccgcgccacggaggccacgctcaaccgcttcatcttcccggaatgcgtgtggaggtgcaagaagtggctgggcctcggcatggagaccacgctggcgcgcagcgtccaccacgtcgaccgctacctgtccgccgtcatcaaggcgcgcaagctcgagctcaccggcggcaagaagggcggagacgcccccgccccggccgccacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctcgtctccacgcaccccgccgtggagcgcaagatcgtgcgcgagctctgcgccgtcctggccgcatcccgcggcgccgacgacccggcgctgtggctcgccgcgcccttcgacttcgaggagctcgaccgtctcgtctacctcaaggccgcgctctcggagacgctccgcctgtacccgtccgtgcccgaggactccaagcacgtcgtcgccgacgacgtcctccccgacggcacgttcgtgccggcgggttcgtcgatcacctactccatctactcggcggggcgcatgaagacggtgtggggcgaggactgcctcgagttccgcccggagcggtggctgtcggccgacggcgccaggttcgagccgcacgattcgtacaggttcgtggcgttcaacgccggcccgcggatatgcctgggcaaggacctcgcgtacctgcagatgaagaacatcgccggcagcgtgctcctccgccaccgcctcgccgtggcgccgggccaccgcgtggagcagaagatgtcgctcaccctgttcatgaagcacgggctccggatggaggtgcgcccgcgcgacctcggccccgtcgtcgacgagctccgcgccgccggggagtacgacgcggcggccagggccaccgcggcctgcgcgtagaatgatcgatcgatgcatcaccccgccggcgaatgcatgctccgagaggatcgtgtcagactgggatggaaggaaggaacagtttag

SEQ ID NO: 569 - DNA, 1340 bp, Zea mays
cggtgatggcagcgccgtccggcggtgggggcggcggtgcgggggagggctcctcctcggccgccgcagctatgacgatcggggcccacggggtggaccaagtcacagaagcgatgtggcagatgaatttaggagatgccatggaactggggccatacccagagcgtgttggtgatccagactgtagctattacatgaggactggcatgtgcaggtttgggatgacctgtaaatttaatcacccagcagacagaaagctggctgttgctgctgcaagaatgaagggagaatatcctcaaagaattggacagcctgaatgtcaatactatctgaagactggcacatgcaagtttggagcaacttgcaagtttcatcatccccgagaaaaggctgcaatggcaactcgagttcagctgaatgaactgggctacccactccgcctgaatgaaaaggaatgtgcttattatttaagaacagggcagtgcaagtttggaagcacatgtaagtttcaccatccacaaccatccactatgatggttgccgtacgtggctctgtttattcacctggacagtctgcaacttctcctggccatcatgcttaccagggggctgtaacaagctggcccttgtcgagatctgcttctttcattgcaagtccaaggtggccaggtcattcaagttatgcacaagttattgttcctcctgggcttgttcaggtcccagggtggagtccttatgctgcgcagattggttcttcatcctcggatgaccaacaacggacacctggagctgcccaatactatactggctcacgccagagtggaacacctggcataggcgatcgaggaatgttttcatcctaccaagcaggttctgttcccgttggactttatgcagtacagacggagaatgtatttccagagagacctgaccaacctgaatgtcagttctatatgaagaccggagactgtaagtttggttctgtatgcaagttccatcatcccagggagcgaataattcctactcccaattgtgcactaagtccattaggcctacctttgcgcccgggagaaccaatatgcagtttctataatcgctatggcatgtgcaagtttggtccaaattgcaaatttcatcatccgatgggaaaccctatgtatggccatgcttcatcaccgacaagtgaggcccaaacatctcggcgtatgctggcacatgtaccatcgcatccagaagtatcacctgacagtggctcgggaaggtctaggaggattgttcattcagattcccagcaaataccctctgttgaaaggatcaccgagagagaggcgtcctaataa

SEQ ID NO: 570 - DNA, 806 bp, Zea mays
cggccatggcccgacccttctcttccccacacatcccgtcttcatcctgggtgactcgccgccctcctccctggacctcctcaccgtccgtctccaccacgagaactagcgcctcgtctattaccgcgtgcagaccgcgccgcagggcagtcgcgccggcggcctccctccacctcggcccgggggagatcgccgagctcgcgcgcaacaaggttttgattgcggcgacagtggcgagcgcgatcgggcagctgtccaagcccttcacctcggtcaagaatgggggcgtcggcgccggccttgacctcagaaccgtcttccgctccggagggatgccctccacccactccgcgagcgttgttgcagttgctacttcgcttgggctagaaagggggtttgcagactccatatttggaatgtcagtggtgtttgcagcaattgtaatgtatgatgctcagggagtaagaagagaagtgggcaaccacgccaaggtcttgaacaggttttggatcctcaaagagaaggcacctctggagtattctgaagtggacatggcagctcctgagtttgtttcggtctccgaggaagcgagctccaatgcgagcccctccttgaagcgcggttgtagcaccgaatcaccaagggtgaatgggctccgtgggtctgagctgactgagctgaagcaggcttacgtagaggaggattaccggttgagtgaatctgttggccacacggagcttcaggtcacagtcggcgccctgttgggttttgctgtaagcttagcagtgtatgcaacactgtaataa

SEQ ID NO: 571 - DNA, 819 bp, Zea mays
agagctagcttcggagattggccaaagtccatcataatccactgccggatcgagaggagacccgagacccctagaaagaagaccagcaagcaggtcgcgcgagcccaatagaccaccaagggagatgtgcgcgcggccggctactagtgagatgtgcctccatcatagcacaccatgtgatgcgggaggagcctgctgttccgcctctcatccccctacttcttccaagatgcaatcatgctgccccaagctcctcgggccctcggccgccatgattgcctcaccgcctctcaagagtcgcctccacctacttccaagaggaagaggccggagaagctatagtccgtgaagaaatcaagcggaggggcggcggtgtaggaggggccggcggaggagagagagggccgggggaggtgacagaaagctagagagagagatgcatgatggagcatgatgatggcgtggttgatctcttcgatctagcacttctatcattcgagtcaagaagccatcatcagatcggtgcagtcctccctcctcctcctcctcctcctccttccagctcctctttatcagcttctctgtaacgctgcgccgccatggctttgggggaatcaagcgccttggtccgaagaaatccgtcttcttttcctagctaggatctacgtacttgtgcaagagtatgtcatgcatgctacgctatatgttattcctacatgttcttggtcgatctgtcgctacatatggtttgtgcagacatcaatactcgtctgtctttgattgatttgttttgacaccactctttgatccggagtttgg

SEQ ID NO: 572 - DNA, 575 bp, Zea mays
cgccattcatcgctaccgcggggtctctagtcctcgccgcgtggtataccttccccgcgcgcagattgaggtgggggcatccgccaccgccgagctctggagccccagctcgagctcttcatcgccatgccgcgctgggcacggccatgaatttgccggggcggagccgtgctcgacgaacgctgatggctgggggttgccgccgtgggtgtcgcgtgtgcacatcatcgcgggattcgctgtgcgtagtccagggccgctctggagcgcatatgaccggaggatggctccaaatcttcgttggggtcatcgggggaatccggaatcgctcgacatggcaaagtccgccgcccccgtccactttcaaacatggctagacacattcaacgtcttcaccatcgcgcgaggacacgtgtcatctgaaaagcaagttggtacctggaatctcaagtgccaggagatgatcaggtggttcaggaggagccgcctaacactgaggagttcgatctgatctaggtggcgtgtctcggtcgacattggcgccgacgatccttagttcgttttatatttatctc

SEQ ID NO: 573 - DNA, 726 bp, Sorghum bicolor
gtcttcactccccagcctaactcaggaacgcgccgctgctggcctgccgctcccccatcgaccctaccgtcgtaccgccatggccacggtgccctgttccacccacagagacatctccatgccactcctctcgtgtgtcctagttgtgctacaggcactgctgccgtcgcgggaagcgagccccgccgtcgtcgcgcagctgtctgcaggcgccgccaccgcgccgtcgcagggcgccgccggcaacgggggagatagtgcaggcgcttcctgctgcttttccatgcgagcgagttgagggcagccgcacgcaccgacgcacaggctcgtgaagtcccgatccgttctgaacacatgtatctgaaggagaaagaagacggcgcccaacgcctctgctccaaagcaggcaccacagaagcagaattgtcctgctggctgtgatccgaaatgccagtttgaagtgttctagagccagatccactgatctggaacatttggtgatacattgtgttgctgaaacttgacatattctgctgctgcaacttgatgaactatgctactgcaacttcatatatggatgctgctgctgcaacttcatgcaattttgggaacctgtaatttgttggtggcttatgtgccatggtgcattgcacgatgtggtgctttatgtaactttgtatctcatcttatgagaataaacttgagatcttatggtgctggattgag

SEQ ID NO: 574 - protein, 373 aa, Arabidopsis thaliana
MACSNLTTMWVSSKPSLSADSSSLSFRSVLKCPTNTSSPPSRASSVSPLQASLRELRDRIDSVKNTQKITEAMKLVAAAKVRRAQEAVVNGRPFSETLVEVLYNINEQLQTDDVDVPLTKVRPVKKVALVVVTGDRGLCGGFNNFIIKKAEARIKELKGLGLEYTVISVGKKGNSYFLRRPYIPVDKYLEAGTLPTAKEAQAVADDVFSLFISEEVDKVELLYTKFVSLVKSEPVIHTLLPLSPKGEICDINGTCVDAAEDEFFRLTTKEGKLTVERETFRTPTADFSPILQFEQDPVQILDALLPLYLNSQILRALQESLASELAARMSAMSSASDNASDLKKSLSMVYNRKRQAKITGEILEIVAGANAQV

SEQ ID NO: 575 - protein, 375 aa, Arabidopsis thaliana
MEKKSVPNSDKLSLIRVLRGIICLMVLVSTAFMMLIFWGFLSAVVLRLFSIRYSRKCVSFFFGSWLALWPFLFEKINKTKVIFSGDKVPCEDRVLLIANHRTEVDWMYFWDLALRKGQIGNIKYVLKSSLMKLPLFGWAFHLFEFIPVERRWEVDEANLRQIVSSFKDPRDALWLALFPEGTDYTEAKCQRSKKFAAENGLPILNNVLLPRTKGFVSCLQELSCSLDAVYDVTIGYKTRCPSFLDNVYGIEPSEVHIHIRRINLTQIPNQEKDINAWLMNTFQLKDQLLNDFYSNGHFPNEGTEKEFNTKKYLINCLAVIAFTTICTHLTFFSSMIWFRIYVSLACVYLTSATHFNLRSVPLVETAKNSLKLVNK

SEQ ID NO: 576 - protein, 624 aa, Arabidopsis thaliana
MSRVLISKIVGKQTQSLVSNQKDRVSQWGSYRTAFTAALRSPQLRTYSSSGRIPSNVYCTFAFRDLKGSFLSNHLSRSYTTAPARNVVSHHAQIAWRRLHYKYSERISTIAQAFSLSLTRSHLLIPGIVAVTCGQVAWAQRAPGSGINHYASDKSLYTRAKNGPIFLSSLLFSVIEGFILIGRAFYIACLFTPTILMGLVVESCGPRFRKIWLEMVHRTLERAGPAFIKWGQWAATRPDLFPKDLCSQLSKLHSNAPEHSFAYTKKTIEKAFGRKLSEIFEEFDEVPVASGSIAQVHRASLRFQYPGQKSKSSLVAVKVRHPGVGESIRRDFVIINLVAKISTLIPALKWLRLDESVQQFGVFMLSQVDLAREASHLSRFIYNFRRWKDVSFPKPVYPLVHPAVLVETYEHGESVARYVDGMEGHEWIKTRLAHIGTHALLKMLLVDNFIHADMHPGNILVRKKASRGGLFKTKKPHIVFLDVGMTAELAKNDRENLLDFFKAVARRDGRTAAERTLKLSRKQNCPNPEAFIEEVEEAFKFWGTPEGDLVHPADCMHELLEKVRRHRVNIDGNVCTVMVTTLVLEGWQRKLDPGYDVMHTLQTMVLKTDWAKSLSYTVDGLMAP

SEQ ID NO: 577 - protein, 375 aa, Arabidopsis thaliana
MMDNINFEFSNASQGSRLQLQQQPPQPFNLQDLNMIQYNQPSSPWTTETFSGLTPYDCTANQSFPVQCSSSKPYPSSFHPYHHQSSDSPSLDQSVSMIPMQPLPDQYMKPLYQRSCSNDFAATNASSASYSLSFEASHDPQELCRRTYSNSNVTHLNFTSSQHQPKQSHPRFSSPPSFSIHGGSMAPNCVNKTRIRWTQDLHEKFVECVNRLGGADKATPKAILKRMDSDGLTIFHVKSHLQKYRIAKYMPESQEGKFEKRACAKELSQLDTRTGVQIKEALQLQLDVQRHLHEQLEIQRNLQLRIEEQGKQLKMMMEQQQKNKESLLKKLPDAEASLSLLDPHIHSPPSPFLVHDAEALMLTSYEDTQLQSTKS

SEQ ID NO: 578 - protein, 492 aa, Hordeum vulgare
MQATGSVTWVVGAQASVLGRCSGGVPYPSPSSSASSVRSQGLGTVRCSVQAQEKKPRVRKTKEERREMVESFVDTYRVSNSGKFPSVNLTHKEVGGSYYIVREIMRDIIQENRVLGPGDLNAKTLSFEDCPDSSELSNRHELGQDNIEILDMSDGYHGNKDSVLEMSDKGEAFSLQTNFISTEQFLTSSDILESGILNSVLHNGNVEDATCLEPNLEKQDEALRGKPRESQTKSSEMQAPSLAHVSDLHKETELNNAGDAHDETTSSITDEVTLSSEPSVVSQTNGALLHEHVTLPDDCGGITNTAVDEAIGCSENNGVLQTDRILIQEHEILPETASIKTEVVKIADSQFRSATSATQMDAYTLNTSAATMESAASIDHHDVLEPPLINASPNQQRMSEDLASHPAMDTKGFLQKEDNHNMVEKDGSEFKISVSGITEEEREASKANHEHVISATTAISRRTGKGQQKKEDNLFWLIVRAFVVSMSKLWAK

SEQ ID NO: 579 - protein, 536 aa, Hordeum vulgare
MAAATTMTWHEELATLVGDTGVRLPAAAAPAPNSGAAAVGGGWYGEEEEGKVEEGWAQQARGFAESTAEMLRELGLGVWDVAAQSLAGAEDSELARRLRRPAAAAGKRLSFMNEYLPEDRDPARCWAVVAAVAFVALLVLGVGSGDDTPVEQPKKLYISPPNAKRFQLPDGRHLAYEEKGISAGRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMVNPYDSKMTKDEKRKIWDRWSTKRKLMHILARRFPSLLRLFYHRSFLSGKQGQPESWLSLSTGKRDKTLLEAPMFSAFWEKDVAESVRQGDAQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPVPEPSEVAREPTEETSPAYEEEEEEVAEQEQETSGLA

SEQ ID NO: 580 - protein, 350 aa, Hordeum vulgare
MASTSSSPLSLVLLRPLPCRSLLLSKHRKPFPTPRTGRLAASAAAAGAQQRLLRPPETGRWSGSSRSGRDFACLSYNNPPPPSSKDSNEWPILRRWDVPWEWQTVVLSMVGCGVSFALTGLVEQSILQYVGYSAAGATIDEKAEILFLGQLSVTAVVLGVIFSITNTFRPFPDDVFRYDVKEPFKLQNGWLLWAGIGLFGAVISIALVGAAMSYLNGAPPEREKDSLVLLLPLIGSSTLSTAYLVGITGVLAPILEETVFRGFLMVSLTKWFPTPVCVILSAAVFAFAHLTPDQFPQLFVLGVALGFTYAQTRNLLAPITIHAFWNSGVILLLTFLQLQGYDIKELLGAS

SEQ ID NO: 581 - protein, 71 aa, Unknown
  Sequence found in Organisms: Hordeum vulgare, Brachypodium distachyon, Leymus cinereus x Leymus triticoides, Pseudoroegneria spicata, Secale cereale, Triticum aestivum
MGGGMEVNKNRWIEEWNAGRENLELNFRFTRRSLAVIGLFGLAVPILVYKGIVREFHMQDEDAGRPYRKFL

SEQ ID NO: 582 - protein, 262 aa, Hordeum vulgare
MRRYSPQYRSPPRRGYGGRGRSPPRRGYGGRREQGSGSLLVRNIPLSCRPEDLRVPFERFGPVRDVYLPKDYYTREPRGFAFVEFVDPYDASDAQYHLNRSLFFGREITVVVAAESRKRPDDMRNRARVRGYSGEPERRNSRYGRSRSRSRSYSPRYRGRPRSRSRSYSPAPRRRDDYSASPPRSHHTQSPRRLPKGHEEDERRSYSPAGRGGGERDADTNGKRRSPPSDIDRSPLRSRRHSSGSPVGSRSRSPEASPARSD

SEQ ID NO: 583 - protein, 172 aa, Unknown
  Sequence found in Organisms: Hordeum vulgare, Triticum aestivum
MVKYSRDPSNPTKSAKACGKDLRVHFKNTRETAFALRRMPLGKAKRYLEDVLAHKQAIPFRRYCRGVGRTAQVKNRQPNGQGRWPAKSAQFVLDLLKNAESNAEVKGLDVDNLYISHIQVNQAQKQRRRTYRAHGRINPYMSNPCHIELILSEKEEPVKKEADNVVAPRKAI

SEQ ID NO: 584 - protein, 307 aa, Unknown
  Sequence found in Organisms: Hordeum vulgare, Leymus cinereus x Leymus triticoides, Pseudoroegneria spicata, Secale cereale, Triticum aestivum
MERLQRIFGAGGMGQPPSDSPLLDSSEQVYISSLALLKMLKHGRAGVPMEVMGLMLGEFVDDYTVRVVDVFAMPQSGTGVSVEAVDHVFQTNMLDMLKQTGRPEMVVGWYHSHPGFGCWLSGVDINTQQSFEALNPRAVAVVIDPIQSVKGKVVIDAFRLINPQTMMLGQEPRQTTSNVGHLNKPSIQALIHGLNRHYYSIAINYRKNELEEKMLLNLHKKKWTDGLILKKFDAHSETNEQTVQEMLSLAIKYNKAVQEEDELSPEKLAIANVGRQDAKKHLEEHVSNLMSSNIVQTLGTMLDTVVF

SEQ ID NO: 585 - protein, 91 aa, Hordeum vulgare
MAIRGIPSAREMTMEEFKEWLKQFDVDGDGRISRAELREAIRRRGGWFTTLRAGRAVRRADRDNSGFIDDAEVENLVAFAKKDLGMRISAW

SEQ ID NO: 586 - protein, 287 aa, Hordeum vulgare
METLLSPSALLGPLRGSRKLAAPAAVPCSRSAVSCSLKKQTQTQAGVAWHGDGGVGSWASFLHHGLAAAALSLALTLSPAPAPAVASEFDVLNDGPPADTYVVDDAGVLSRVTKSDVKRLARDLEARKNIRINFVTVRKLTSKADAFEYADQVLEKWYPTVEEGSNKGIVVLVTSQKEGAITGGPAFVQAIGDAILDATVSENLPVLATDEKYNEAIFSTAKRLVAAIDGLPDPGGPAFQESKRESNFKSKEETDEKRGQFTLVVGGLLVIAFVVPMAQYYAYISKK

SEQ ID NO: 587 - protein, 114 aa, Unknown
  Sequence found in Organisms: Hordeum vulgare, Secale cereale, Triticum aestivum
MKLVRFLMKLNNETVTIELKNGTTVHGTIIGVDISMNTHLKTVKLTLKGKNPVTLDHLSVRGNNIRYYILPDSLNLETLLVEETPRVKPKKPTAGKPMGRGRGRGRGRGRGRGR

SEQ ID NO: 588 - protein, 216 aa, Brachypodium distachyon
MATHVPGSLFSFLVVLLFSCALTAGALRFDLYSGHTKCISDDIKVGAMAVGKYHIVQPEDSSQLPDPQRISLRVTSPYGNSLHYSENVQSGNFAFTASEAGDYLACFWAPDFRPPSTVAFEFDWRGGVAAKDWSTVAKKGQVDIMELELKKLEDTIKSIHEEMFYLREREEEMQELNWRTNSRMAWLSFLSLGICLPVAALQLWHLKNFFERKKLL

SEQ ID NO: 589 - protein, 189 aa, Brachypodium distachyon
MAAISAAFSGCCSSSCLSQPGLLPTTKSRRHFKVTAMAPKNKVNKYDEGWSKQWFGAGIFAEGSEEASVDVFKKLEKRKVLSTVEKAGLLSKAEELGVTLSSLEKLGLLSKAEDLGLLSLVETAATVSPAVLASLSLPLLVAAIGTVVLVPDDSSLLVTLQTVVATLFAAGAAGLFVGSVVLDGLQEAD

SEQ ID NO: 590 - protein, 645 aa, Brachypodium distachyon
MAMASTSSCSSRPPLLHPASRTPNPSRLPPLVSRASSSPRPLLLSFAPPARGRFRAAAVQQSDFEDGEEEWDGEVEEEYYREEEEVEEGEEMDVEAMEEEARAAAADLAARLDRELRVDGDVREKRRTMRDKTSTSKHIPDNNLPKVAIIGRPNVGKSALFNRLVGSNRAIVVDEPGVTRDRLYGRSYWGDQEFMVIDTGGVITLSKSQAGVMEELAITTTVGMDGIPLASREAAIARMPSMIEKQAVAAVEEATVLLFLVDGQAGLVAADIEIADWLRRNFSHKCIILAVNKCESPKKGQMQALEFWSLGFTPVSISAITGTGTGELLDMVCSELKNFEGLEGLDDVEEDENRVPAISIVGRPNVGKSSILNALVGEDRTIVSPVSGTTRDAIDTEFTTEDGQKFKLIDTAGIRRRAAVASAGSTTETLSVKRAFSAIRRSDVVALVVEAMACVTEQDYKIAERIEKEGKACVIVVNKWDTIPNKNNESTTHYELDVREKLRVLDWAPIVYCSAINGNSVEKIISAASLVEKERSRRLGTSILNQVVREAVAFKAPPRTRGGKRGRVYYTTQAAVRPPTFVLFVNDAKLFPEPYRRYMHKQLRSDAGFPGTPIRLLWRSRKRADKQRRKSNNTEARGSLVGASS

SEQ ID NO: 591 - protein, 1084 aa, Brachypodium distachyon
MEASASSTPQALTLLTSSPRFLSLHPSARQRGRGSGGGLLLRPPPHRRLELGYRANRPLGCSVSGSTDVSVDVLGGPVAAAAALLAALQLLWLRWRGARDGESPEVLCTQDKSIVNKELRTTTRSVYDSNYAPCATHENGFSELSVSGGMTPEVECQAGIPCVDTVNTTTRAVSAITRGTSLQTLFDVSGKEEASCSTSAEKTSSTENIMNVLAMPHSLSQGQHTKYISNRMGWQGGLSRHFLSLSEQKEHAQIDKGPSDSKTDSENAHLLQCQQSDQEENLDLTSLSSFKRTVECPLNFVPQARTGNLFKSRKAIEFTDPYEGGSYLTPGKLVPVACLREGPASKQKKAVKDHDAAKTIGWTISEILSKENLENFIPAKTLGLNGTVDTSDYIRRYNSSLMDGRLKDCVDLLENMEQKGLLDMKKIHHASFLIACKKQRAVMEAVRFCRLIANPKMSTFNMLLSVCAHSQDFDGALQVMMLLKEAGLKPDCKLYTTLISTCAKCGKVDAMFEVFHEMVSAGIEPNVNTYGALIDGCAKAGQVAKAFGAYGIMSSKKVKPDRVVFNALISACGESGAVARAFDVLSEMTAEPSESKGWKPILPDHVTVGALMKTCIQAGQADRAREVYKMLQEYNIKGTPEVYTIALRSCSLTGDLGFALKIYEDMNKIGVIPDEMFLSALVDVAGHARRADAAFEIIKDVRAKGFHVGIMAYSSFMGACCNAKDWKKALQLFEEIKISRLTPTVPMMNALITSLCDGDQVQKSIEVLNELKEFGVRPNEITYSVLCVACERNGEAELGIDLFEQLKVDGIGLNPTIVGCVTGLCLQKFSNDLSLGNIIVRFNLGKPQIDNKWTTSAIMVFRQAITAGLLPSSDVLSQVLGCLRFPHDSSLKSTFIDNMGISCDMPHHPNTYSLLEGFGEYDVRAFSILEEAALLGAVASASTKHSQIVIDARKSKMYTAEVSLLMTFKSLKHRLAAGARLPNVTILLPTEKKQVDLDEREKTLKLAGRVGQAVGSLLRRLGIKYQGEESHGRMRINGLTLRRWFNPKFTSTPSTGTPAELLPLPSRLAKGIADQQRDIRSLSL

SEQ ID NO: 592 - protein, 57 aa, Brachypodium distachyon
MATFDPWPVFFRREWKRNWPFLAGFAVTGFLITKMTAGFTEEDLKNSKFVQEHKRRA

SEQ ID NO: 593 - protein, 405 aa, Brachypodium distachyon
MASSYNYPTTTSPATTTNPSFPAPSAPPLYPTLTMADLAPVEIPTTPDGAPPPSEDVLLRLPGAQLHLIDRRRSHPLAAGDLSLRRIRAGDASLAATALLGPIQWPLARDVAAVKLDPRHYSFSLAVPASHDDPSPDPLHYGLTLSAPDPRLDAVLGAYTSFSVHSVAGSEALAGGARGEVEAAAYWTAVAPNVEEYGGAVAKAIARGAENVAKGIIWCGVMTVDRLRWGNEVLRKRIQPGDTDAEVSPEMLRRIQRVKKVTKMSEKVASGILSGVVKVTGYLTSSLANSKAGKKFFSMLPGEILLASLDGFGKISDAVEVAGKDVLSTSSTVTTGLVSHKYGEKAAAATNEGMDAAGHAIGTAWAVFKIRQALNPKSALKPTSLAKSTIKAGAADLRAKSSKSK

SEQ ID NO: 594 - protein, 470 aa, Brachypodium distachyon
MQTPTMYTSMAARATSAAANLPAPPPRQCYYHLLPPAGRRSVWALSASPKKKNPWLDPFDDGPDEDFDYTGVYSGGKQDEDPRPPEDPSNPYGFLRFPMGYNPELDSLASKVRGDVRRACCVVSGGVYENVLFFPVVQLLKDRYPGVLIDVVASARGKQVYEMCKNVRYANVYDPDDDWPEPAEYTHQLGVLKNRYYDMILSTKLAGTGHALFLFMSSAREKVGYVYPNVNGAGAGLFLTEMFKPPTTNLSDGGYNMYQEMLEWLGRPGKGVPQQPIPPLRVSISKKLRGIVEDKYSRAGVEKGKFVVVHGIASDSVANMTSRGDDDCLLPLEQWAEIAKAISSQGNGLRPLFVMPHQKHREEIEDIVGRETSYLFITTPGQLTCLINDSAGVVATNTAAVQLANARDRPCVALFSSKEKAKLFLPYAEDKKSCTVVASATGKLADIDIEAVKNAVKEFEPAPSFALAQK

SEQ ID NO: 595 - protein, 1062 aa, Brachypodium distachyon
MGKGGQDEARRPDGSDGSGSEPAVAAFPVWARTPSECLAELGVSADRGLSSEEAAARLQKYGPNELERHAPPSVWKLVLEQFNDTLVRILLAAAVVSFVLALYDGAEGGEVRATAFVEPLVIFLILIVNAVVGVWQESNAEKALEALKEIQSEHATVKRDGRWSHGLPARDLVIGDIVELRVGDKVPADMRVLQLISSTLRVEQGSLTGETSSVNKTSHKIDLEDTDIQGKECMVFAGTTIVNGSAVCVVTGTGMATEIGKIHSQIQEASQEEDDTPLKKKLNEFGEALTAIIGVICILVWLINVKYFLTWEYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRDFKVDGTTYDPSDGKIHEWPSLEMDENLQMIAKIAALCNDASIAHSEHQYVATGMPTEAALKVLVEKMGLPGGYTPSLDSSDLLRCCQWWNNDAKRVGTLEFDRTRKSMGVIVKKADSGKNLLLVKGAVENLLERSAYIQLLDGSVVLLDDGAKALILSRLSEMSASALRCLGFAYKEDLAEFATYDGEEHAAHKYLLDPSYYSSIENNLIFCGFVGLRDPPREEVHKAIEDCRAAGIRVMVITGDNKETAEAICREIGVFGPSENISSRSFAGKEFMALPDKKKLLRQTGGLLFSRAEPKHKQEIVRLLKEDGEVVAMTGDGVNDAPALKLADIGIAMGITGTEVAKEASDMVLADDNFSTIVSAVGEGRSIYNNMKAFIRYMISSNIGEVASIFLTSALGIPEGLIPVQLLWVNLVTDGPPATALGFNPPDKDIMKKPPRRSDDSLITPWILFRYMVIGLYVGIATVGIFVIWYTHGSFLGIDLAGDGHTLVSYSQLSNWGQCPSWEGFNVSSFTAGSRTFEFDANPCDYFQGGKIKATTLSLSVLVSIEMFNSLNALSEDGSLLSMPPWVNPWLLLAMSVSFGLHFLILYVPFLTQIFGIVPLSFNEWLLVIAVAFPVVLIDEVLKFVGRCLTARARKQLGKRKEE

SEQ ID NO: 596 - protein, 265 aa, Brachypodium distachyon
MPAAAARCGCPLLLRQQPAAGLRRSFSSYSGMRRVCAAAGGGSGSEGRPPAYGGLLLDAGGTLLQLARPVAQTYAALGRPYGVTKREEYIKQGFKRAFSAPWPKTLRYQGDGRPFWKIVVAEATDCTNNDYFEEVYQYYARGDAWRLPDGAYRTLHDLKDAGVKLAVVSNFDTRLRKLLKELNVSDLFDAIIVSSEVGYEKPAPEIFRIALDQIGVEASKAVHIGDDETADKAGANAIGLECWLWGEDVKTFSEIQDRILARNPQ

SEQ ID NO: 597 - protein, 509 aa, Setaria italica
MMAAEPSPLSAAAGDLETLALDSSSSAASASTDPLLRPPSSQTAAAANHDAFVIDDFLDEEDDFSPAPAPSIARHPAPRPDAAPPVFARITVSDPKKHAEPSGGGAAAGVIPGSGSYFTYLITTRLAGGGGGGEVCVRRRFRDVVALADRLAAAHRGLFVPARPDKSVLEGQVMQRHDFVSQRCAALQRYLCRLAAHPAVGHSPDLRTFLTEPGAIPAFQGEAPRYWTTTVNAAAPLVQAKAGRDLFGMFKGLKQTVVNGLVATKPPPVEQETDTEFLAHKARFEDLQQQLTTTSQQAETLVKAQDDLRETTGHLGMTLIKLAKFEREQATCNSLRRRAGEIHNFANHVLKMSRSQIKLNSEIVKHLGSIHEYLEAMISVNHAFTDRSNALHHVQSLSADLFSLHTRAGRLESSSARDMGHEWSTYQKVEGLKETIRSAEAAKSDALREYESIKENNKIEIKRFDKERRRDFIEMLKGFVVNQVSYSDNFANMWTKVAEETEVYANRGN

SEQ ID NO: 598 - protein, 87 aa, Unknown
  Sequence found in Organisms: Setaria italica, Elaeis guineensis
MASRWVRPEVYPLFAATGVAVGICGFQLFRNITGNPEVRVNKAGRAAGVLENHEEGRRYAMHGLRSFVHDKTPEIMPAINKFFTEPK

SEQ ID NO: 599 - protein, 503 aa, Setaria italica
MAQLPSGSVVSGEAELVPTLSSLEPVYGEGSQLDEARLRFARLGDRFQAVYGARPALFARSPGRVNLIGEHIDYEGYSVLPMAIRQDMIVAIRKSDSGQVRVSNVDDKYPVCVYPADPDKEIDIKNHKWGHYFMCGYKGVYEYCRSKGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPRGGTFVIAHCLAESKKAETAATNYNNRVVECRLAAIVLAIKLGMDTKKAVSSVTTLSDVEGLCVSFAGKEGSSDPGVAVKKLLHEEPYTAEEIEKITGESLTSVFKSSQTSLDVIKAAKHYKLFQRASHVYSEAWRVYAFRDTVSSKLSDEDKLKKLGDLMNESHYSCSVLYECSCPELEELVKVCRDHGALGARLTGAGWGGCAVALVKEPIVPQFILNLKEKYYKSRIDRGVIQQSDLGLYVFASKPSSGAAILKL

SEQ ID NO: 600 - protein, 195 aa, Setaria italica
MVHVSFYRNYGKTFKKPRRPYEKERLDAELKLVGEYGLRCKRELWRVQYALSRIRNAARHLLTLDEKNPRRIFEGEALLRRMNRYGLLAEGQNKLDYVLALTAENFLARRLQTLVFKAGMAKSIHHARVLIKQRHIRVGRQIVNVPSFMVRVESEKHIDFSLSSPFGGGPPGRVKRKNQNKATGGGGDGGDEDEE

SEQ ID NO: 601 - protein, 700 aa, Setaria italica
MGFGGLVVVSDPYLQRRFTQADLRALQAKYAALRDASPSGRLRIRDLPAAISSLRGATVAAKGDAEKENSAPEAGPGPGLTDEEWASVLKAVARADERPQQDASFELFLRVYAEMQLRLKAAGASAGGKKAGGGIARSSSSSAVAFLTAATTTLLHTISESEKASYVGHINAYLAEDPFLKSALPIDPATDHIFHITKDGVLLCKLINLAVPGTIDERAINTKRVLNLWEKNENHTLCLNSAKAIGCTVVNIGTQDLAEGRPHLVLGLISQIIKIQLLADVNLKSTPQLVELVEDSKEMEELMSLSPEKILLRWMNFQLKKGGFQRTVTNFSSDIKDSEAYACLLNVLAPECSAKPSAMSVKDLLHRARLVLEHADRMGCKRYLTPKDIVDGLPNLNLAFVAHIFQKRNGLSKQMKQVSFVDGLSDDAQVSREERSFRLWINSLGISTYINNVFEDLRNGWVLLEVLDKVAPGSVNWKMANRPPIKLPFKKVENCNQVLKIGKELKFSLVNIAGNDIVQGNKKLILAFLWQLMRYNILQLLKNLRFHSNGKEITDNDILAWANKKVKDSGKHHSRMESFKDRSLSSGTFFLDLLSAVEPRVVNWSLVTKGEKDEEKQMNASYIISVARKLGCSIFLLPEDILEVNQKMMLTLTASIMYWYLKRPTSHSLDSENGSSCETSSTTTSDDSASESSFDDNAAR

SEQ ID NO: 602 - protein, 92 aa, Setaria italica
MSAMEPRKSSYLVAVVFASLLLSSMAGGHRKLVNKDDAESMETSESMQQLQGDDEAAAVVHERILKQVKMDDYGRYDPTPTMSKPHFKDIPN

SEQ ID NO: 603 - protein, 482 aa, Setaria italica
MSSPPLLGKEGLKAAYCRVVVTVPLAAAALVAVARLGPEELAGRVRDARPVHLFLAAFLPAAAATVYLMLRPRAVYLVDYACFRTASNCRVPFSTFLEHAKQVPVLNERSIRFMTKLLERSGLGEETCLPPAHHYIPPYKYCTLDAARGEVDLVVFGALDDLFAKTGVSPGDIDILVVNCSLFCPTPSFVDMIINRYKLRSDIRSTHLSGMGCSAGLVSVGLARNLLQVAPRGAHALVVSTETITPNYYVGSERAMLLPNCLFRIGGAAALLSNSPAKARFRLRHVVRTLTGAQDSAYTCVFQEEDDRGNVGINLNKDLMTIAGNALKANITAIGPLVLPASEQLLFALSFIVRKVLSGKFKPYIPDFRTAFDHFCIHAGGRAVIDELQRSLNLSDQQVEASRMALHRFGNTSSSSLWYELAYIEAKGRMRKGDRVWMIGFGSGFKCNSAAWECIEPAANAEGPWATSIHRYPVDIPDVLKH

SEQ ID NO: 604 - protein, 569 aa, Setaria italica
MRSPVSERSLIIESSDDEDTHSGAAVATSGRRRVVHDEEEKGAGSDSDSSSSSSSCATPRRGPCSSSPYAQQWPQSYRQSIDILSNVQSPNLSFLGTPSLSRLSNSFLAVTDSFRSKTPEIISNFVKPLLSPTTSDEQQQHEDTRKSSQYITPSRKPSLQQIPEDQKPLVAGHEVSPYRNCSYTQGVMNGINVLCGVGILSTPYAIKQGGWIGLVILALFALLAWYTGVLLRHCLDSKEGLETYPDIGHAAFGRTGRLVISIILYVELYACCIEYLILESDNLSKLFPTAHLTLGSLTLNSHVLFAILTTIIVMPTTWLRDLSCLSYISAGGVIASILVVICLLWVGVVDDVGFENKGTVLNLPGIPIALGLYGYCYSGHGVFPNIYLSLKNRNQFPSILFTCIGLSTVLYSGAAVMGYKMFGEATESQFTLNLPDNSVVSKVAVWTTVANPITKYALTIIPLAMSLEELLPTNQQKYSNIIMLRSALVVSTLLIALSVPFFGLVMALVGSLFAMLVTYILPCACFLAILKTKVGWHQIAACSFIIVVGVCCACVGTYSSLSRIIQNYT

SEQ ID NO: 605 - protein, 72 aa, Setaria italica
MFAAASEMCASIMPHHVMRGASAASPPPTTSKMQSCCPSKLLGPSAAMIATPHLKSRLHLPPRGRGRRSYSR

SEQ ID NO: 606 - protein, 247 aa, Setaria italica
MAIDHATPLGLKSRYAMGGDECDDDAENQRWPPWLKPLLSTSFFVQCRVHADAHKSECNMYCLDCMNGALCSLCLGHHRDHHAIQIRRSSYHDVIRVSEIQKVLDITGVQTYIINSARVVFLNERPQPRPGKGVTNTCDVCERSLLDCFRFCSLGCKIVGTARGYRPKKKHGGGDSKKKKRAALKDVRCDSEDSCTGSSGGSSDKSSVVQCFSPSTPPPTSASCRPWNKRRKGVPHRSPFGSLIVEF

SEQ ID NO: 607 - protein, 91 aa, Setaria italica
MRMLSRSWRSASLFPVIVFALLFSTSFAGRQCNFLTDQDALRHQGEAAGAEQKEAVVPLVHGRMLNVKTNDYGSYDPSPTTDKPHFKLIPN

SEQ ID NO: 608 - protein, 453 aa, Setaria italica
MQAAAGSVSWVAAQPSVLGRCGGGGGGAQSASVKGRAGGGGGGGGGGASVRGVGVVRCSTRAQEKRPPRVRKSKEERREMVESFINSYRVANDGKFPSVNLTHKEVGGSYYIVREIVRDVIQENRVLGPGGLDSMALSFEDCPDSSEVSMKHELGQDNIESLAMSDDGQAGQGSVSESSSSEESFSLQNNSINTDILLGSSNILEAGVLKSIVQNGTASGTAFLETNLEKQDEVPSGGSIEVGLNSSEELNSQEDAHEGMGSVATDILPSEATDVYETNGALLREHEMLPNDSHGGSNDSVVDDGNLLAAANGALQEKQASFQEHDPSNESVQGDVQSLDCQISTTLSANPINGFDSEAEVTTKTIEASDTKGLLHTEDQHSVVQVDGSEFKKSTSGFTKEVVEATDARHEQGMSTTTVISRRTSKAQQKKDDNLFWLVLRAFVVAISKIWAK

SEQ ID NO: 609 - protein, 379 aa, Setaria italica
MGRSRGGKGAGDSKSFPSPASSSASSSEFEFTVTLSPASKQRSAAQLCPADELFYKGQLLPLQLSPRISMVRTLLLSSASTSSASDSTSTSNSSRDSNGSTSSSFSADCAALLLPDSAASSSRPSSATEDDRHLHPLSAAASFAGLPPAKRTGKQYLSSFATRFSSVFHRGGAPAAKKQPSKSLAKEVIKKYAKKVKPLYEKLSQIPKNQNNVNVNVNGASAGANNQPQQGFKKPFTFSIRKKRADDDHAVVAAAAAVDADVVSGKYAHSNSFSGNLRFPRQKRCAASCPSSMRSSPSHSGLLTFGGAGGAGFPDVPAAAAAAVAGGIGVGPVSLSTASSMEELQSAIEGAIAHCKNTMGGAVSVCPRKAATGDEICAF

SEQ ID NO: 610 - protein, 172 aa, Setaria italica
MKRENCTTIPRRSVERSRGREKGRRVLESSLSAAEPAHQPGMDAKNVGNEQEAQQKLDAVTGSVPRPNQETLKQFADSDAGNISPANGQEADVNMEAAISTEDVMRAGGFGAKDDIGSLLPTAIDSTDFEASLRDARDFEGEKEAPSHPGLGWKGEKADDGSKPSDVPQQLP

SEQ ID NO: 611 - protein, 774 aa, Setaria italica
MFLLPRQWLLLLAAVLATAAAVARGQAPLASRADLGGLYSLRASLGLRARDWPLKSDPCAAWSGVACRAGRVVNVTVAGLRRTRLAALAPRLALDGLRNLTALERFNASGFPLPGEIPDWFGSSLPPSLAVLDLSSAAVNGTLPANLGASGNLTIVLLSGNGLSGAVPAPLLSDRGPRVLDLSRNNFTGGLPNVSAVAGGASMFNISGNSLYGVAGYAIAALRRRFQVVDVSSNYLDGALNGSDGVVITTTNCFHGVPGQRSRVDCEEFYRKQGVNLVDAPAPSPLPSASPLPQPSPEVKRKKQGISKNVLIGVLVAAGALMVLFLAVLLFCLVKMSSRGRSRGRGVEINEEGTGTRSARRRDSSVNPVASSPSAVSPRANGGPKKDVSAIAGDFSYEELVDATGGFGDDKLIKHGHSGDIYHGVLENGSHVIVKKVGSKGINKHASELDFYSRYSHDRIVPLLGYLSKDDEEFLAYKYMPKGDLTDALHKKPVDTADGLPSLDWITRLKIATGVAEAMCFLHDECSPPLVHRDIQASSVLLDDKYEVRLGSMSDICAQQSGGSQNVFSRILRSSKSLDKHTSGPPATCSYDVLCFGKVLLELVTGNFGISGSNDAASEEWLANTLNQINGGDKASVTSIIDPLLLVDEDHQEEVWAAAIIAKACLSAKPSRRPSARHVLRALESPLRVVRQSSSSRSDSARLRSSSSRSSWQSVFLQGNNHRVQSLDRRHSVRSHGSGGEASFSFSFKRAVAAAPEVAPEPVAAALDEEAVVV

SEQ ID NO: 612 - protein, 521 aa, Setaria italica
MATAPANGDSESGPQRNYQVVVAATRDMGIGKDGVLPWKLLGDLKFFKELTLATSDPAKKNAVIMGRKTWESIPVKSRPLPGRLNVILTRSGSFDFATVENVVICGSMKSALELLASTPYCLSIEKVFVIGGGQVLREYLNRPACEAIHLTDIQSSIECDTFIPPIDFSVFQPWYSSFPVVESNIRHSFVTFVRVRKSLAETHESNGKESTEVDTKNDKFETENFSFLPKMIFDRHEEYHYLNLVEDIIRSGAQKNDRTGTGTLSKFGCQMRFNLRKNFPLLTTKRVFWRGVVEELLWFISGSTNAKVLQEKGIHIWDGNASREYLDSVGLAHREEGDLGPVYGFQWRHFGAEYTDMHADYTGKGFDQLMDVIDKIKNNPDDRRIILSAWNPSDLKKMALPPCHMFAQFYVENGELSCQMYQRSADMGLGVPFNIASYSLLTYMIAQVCDLSPGDFVHVIGDAHVYRTHVRALEEQIQKMPKPFPILKINPSKKDIDSFVASDFKLVGYDPHQKIEMKMAI

SEQ ID NO: 613 - protein, 261 aa, Setaria italica
MGRVIRAQRKGAGSVFKSHTHHRKGPARFRSLDFGERNGYLKGVVTDVIHDPGRGAPLAKVTFRHPFRYKHQKELFVAAEGIYTGQFIYCGRRATLSIGNVLPLRGIPEGAVVCNVEHHVGDRGVFARASGDYAIVISHNPDNGTSRIKLPSGAKKIVPSSCRAMIGQVAGGGRTEKPMLKAGNAYHKYRVKRNCWPKVRGVAMNPVEHPHGGGNHQHIGHASTVRRDAPPGQKVGLIAARRTGRLRGQAAATAAKSDKAT

SEQ ID NO: 614 - protein, 221 aa, Setaria italica
MSRRGDWVYENNGGTCVAIAGADYCVVAADTRLSVGYSILTRDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSSLIMPVLDNQLKSPSPLLLPARDAVTPLSESEAIDLVKDVFASATERDIYTGDKLEIVVINKAGTKREYIELRKD

SEQ ID NO: 615 - protein, 171 aa, Setaria italica
MCDLVARTGRHLQRYEDGRRLVAGCIPFRYRDIKDEQKKLVEVLMINSQSGPGLLFPKGGWENDETVEEAAAREAIEEAGVRGDLVKLLGFYDFKSKQPEGMCRAAVFALHVKEELASWPEQSTRQRSWLTVPEAAERSRHPWMQEALVTGFSAWLENWSNGGGCVDRSER

SEQ ID NO: 616 - protein, 55 aa, Unknown
  Sequence found in Organisms: Zea mays, Setaria italica
MGLFRGSFTLLVGMGCGVYIAQNYNVPNVKKLFNTYVFLAKHIEETYRKPKKDDD

SEQ ID NO: 617 - protein, 209 aa, Setaria italica
MSGLAFCEVAAKLPCWSECSGSRLLAAYRVRRGAVSCRWEKPGTFSLLWASPSYRRNSRQMQWAIRTMSDDSSGQPGNSTRLFSAIQSFWNKFSAKLKKARKGLATKIMFFLIGFYCATAFATVIGQTGDWDILSAGLAVAIVEGIGALMYSASFGFLGRIRNMVTMFNYWKAGLTLGLFLDSFKYEVDGLLDSCNPFNFEINIFTGLW

SEQ ID NO: 618 - protein, 185 aa, Setaria italica
MSLLTSPTPFGVAAVHRRAAALPLLPASGRAALHVALARRGGVSSRTQRRLEERGGKKRRGGVAAPDVDEDAAEAGAAEWEGEPLGFEVSTEPMPEVPDPETPDFWEGPQWEALGFFVQYMWAFGVVFGLIACGVAVATYNDGATDFKDTPAYKESQTQEFPEESESSSADVFEGNPTEVAPALE

SEQ ID NO: 619 - protein, 86 aa, Setaria italica
MASMKLLSLTCILLLSGLVVFGEIGGVAAAAEPCPVVCIQGGYITCDNYPYQKLDGCDCECAPKDGINCVLHHLVTGDTFKCPAQA

SEQ ID NO: 620 - protein, 473 aa, Setaria italica
MKLRLRSMEARGGAAAVETHRVDLPPTATLGDVKTLLAAKLSALPVPAESVRLSLNRSEELVSPDPAATLPALGLASGDLVFFALSPLTALAPPAQALPRNPSPGSGSVPTAMAVDGGKGSEKPSTGGSSLQARAVVVNPSVPAASSPADVVMAETVDATKGWSSFVLRDLKREMGNVVGAEGTAGGRLVAALHAALLEFGFHITNPMGSRLSLPPDWPPVASKPLAIKYTIPELSPMLHVAEEGKVAVLNFSLMPNFVIVYGYVPGAQSEVRRLCLELPRLEPLLYLDSDQLSAVQERGILDLWTVLKDEMCLPLMISLCQLNGLRLPPCLMALPADLKSKVLDLLPGDDLARVECTCKEMRNLAADDSLWKKFVQFRNSGEGPRGSMSAKAIFAEAWQANKKRQKRPHPTFWNYGWGNNPYSHPLRLPLIGGDSDRLPFIGNQGSVGRNFGNQRRNIVPNCILDGHRHNFL

SEQ ID NO: 621 - protein, 658 aa, Zea mays
MGMGSDAAALFPFSTSTTATSPRLCGATAVSHRRIFSDVAEDVTVSVDGQSFLLHKFPLVSRCGRIRKMLADSSSSNSKDADGHQKLELANVPGGAYAFELAAKFCYGTNFEITAANVAQLRCVAEYLEMTEDQHADNLVARAEAYLAEVALRSLDGALEVLRRCDDGGPVAEQVGLVARCVDAVAASAGKEQLVSGLAAHLETCDCAAAARCREDWWVEDLSLLRIDHYRRVIAAMRRSGVRPETIGASVAHYAQTWLKGVDVEQRRRQRACWDGSGPFVGDGQRMVVETLVDVLATENVAAVTLSFLFGMLRVAVEVDASLDCRIELERRVGMRLEMAALDDLLVPAAQTSDSMFDVDTVHRILLSFLQRIDEDSSGDLSSPPCGYDSDGLKSPSHGSVLKVGRLMDGYLAEVAPDPYLKLQKFMALIELLPDYARIVDDGLYRAIDIYLKAHPSLTESECKRLCKLIDCQKLSQDASSHAAQNDRLPIQMVVRVLYFEQLRLKSSFSGGGSGCVGLGGADGSFSQRFVCSSSGVPSSCVSPQRDNYASLRRENRELKLEISRMRVRLTELEREQGLMKQQGRMRGGDGGGGGGRGGGGEHGRAFLASLSRGIGRITMFGGGPAAADRRRKKSGGRSSQCSDGKARRRQKASFAYD

SEQ ID NO: 622 - protein, 140 aa, Zea mays
MRSSSHCESYCAPPLCYLPCLPKSKDVAVGDPESGSPSPAAVAEDKPPVVQKIEESVAATGGDGVGDGDKCYREVAVAPKSCLKRANCEDSSKNAVKGNVKWKDLLGKDLTLTQVKEFEPSESGDSDDEEYAGACACVIQ

SEQ ID NO: 623 - protein, 126 aa, Zea mays
MAISVTAVAALPAFSAQRSLPQPSRQRVVAFIVVRPVRAHRRFVGVAASSPPTPPDLAKKVSESIKQAQETCADDPVSGECVAAWDEVEELSAAASHLRDRQKGADPLEEYCKDNPETDECRTYED

SEQ ID NO: 624 - protein, 553 aa, Zea mays
MAKKKEKAVNVSGKPRHSNDVNRPNDKKGAGGGAGGGSRSAATVRRLKMYKTRPKRDRAGKVLRNDFQSKELPNTRIEPDRRWFGNTRVVGQPQLEMFREELQSRLSDNFSVILKERKLPLSLLQDHQKQAKAHLLEVEPFEHAFGPKGKRKRPKLTALDYESLLKRADDSQDVFEQKYASSKLPREEEEDGLRDLVRHTMFEKGQSKRIWGELYKVIDSSDVVVQVLDARDPMGTRCYHLERHLKENCKHKHLVFLLNKCDLIPAWATKGWLRTLSKDYPTLAFHASINKSFGKGSLLSVLRQFARLKNDKQAISVGFVGYPNVGKSSVINTLRSKSVCKVAPIPGETKVWQYITLTKKIFLIDCPGVVYQNNDSETDIVLKGVVRVTNLADAAEHIGEVLRRVKKEHLQRAYKIQDWSDDNDFLVQLCRTTGKLLKGGEPDLTTAAKMILHDWQRGKIPFFVPPPQQSDGGASESAEPIGITKEDGVSSDRTAAAMKAIAGIISSQQNMNVPCHKENNADNEDTTENADNEDIESSDNEDNDDIEPAERSE

SEQ ID NO: 625 - protein, 504 aa, Zea mays
MALRRALLRSVNFSPDSKAAIEYFYSFSRAQSACSLNGAGLCPASRSFSTQAATTSSTPQPPPPPPPPEKTHFGGLKDEDRIFTNLYGLHDPFLKGAVKRGDWYRTKDLVIKGADWIVNEMKKSGLRGRGGAGFPSGLKWSFMPKVSDGRPSYLVVNADESEPGTCKDREIMRQDPHKLLEGCLIAGVGMRASAAYIYIRGEYVNERLNLEKARQEAYAAGLLGKNACGSGYDFDVHIHFGAGAYICGEETALLESLEGKQGKPRLKPPFPANAGLYGCPTTVTNVETVAVSPTILRRGPEWFASFGRKNNSGTKLYCISGHVNKPCTVEEEMSIPLKELLERHCGGVRGGWDNLLAVIPGGSSVPLLPKHICDDVLMDYDALKAVQSGLGTAAVIVMDKSTDVVDAIARLSYFYKHESCGQCTPCREGTPWLWMIMERLKVGDAKLEEIDMLQEVTKQIEGHTICALGDAAAWPVQGLIRHFRPELERRIRERAERELLAASA

SEQ ID NO: 626 - protein, 451 aa, Zea mays
MPQVMVVARNFMDMVAALPAGKLDMLYDSAFICEAVLRSLPPLAKKYALQMLYVLAPVTAAAMEEWVLDEYAAKHKVAIDKLLQLRVFVEVRDRRRDVSYKMNQKFQGNMQKYLVDGGSLPREPLPLSVTGRLPTPADLEAYALDQWECFLLQLINSSQVEKGSSFSSSMMKTFQRGLLSSRDGEASKLTENGFQFLLMETNAQLWYIMREYISSAEERGVDPTELISFLLELSFHKLGAAYSLNTLTDVQRIAIRDLAELGLVKQQQGRKDSWFIPTQLATNLSASLSDSSSNKEGFVVVETNFRMYAYSTSKLHCEILRLFARVEYQLPNLIVGAVTKESIYGAFENGITAEQIISFLRQNAHPRVADKIPAVPENVTDQIRLWETDLNRVEMIPSHLYEDFPSKEWFEQCCDYARDNGYLLWEDPKRMRLIVRGEFHPEMREFLRRQR

SEQ ID NO: 627 - protein, 112 aa, Zea mays
MGRDELLRRSLVALAAAVALTGLATASLRKAAATYGFGILAIAGVLLPDWEFFDRDYSQWLTPMPASRRTAAAAAADREHDVWKFKPYPLRVAMLTTIYGFGLHKWWTYVSS

SEQ ID NO: 628 - protein, 353 aa, Zea mays
MATTTAAARWSFPARLQLLTSRRFCFPASSAAPPSSVAGFSWADALRVAGDGGRGDESDLSGYFRKVKSCNRGMDKKGQFVKFSVEDQVVGYIHKGFIEHIRDFHDVFTIVMDDNGSNTVEHVSLQSSLRTPEDRTHAIGSVIKSLGELIPGIRNELYPVTSSYGMPVYFSLERAAAPYFGIKAYGVHMNGYVEKDGQKFLWIGKRSDVKQTYPGMLDHLVAGGLPYGMSCKENIIKECEEEAGITRSISTNATSVGAVSYMDIEGFRYKRDVLFCYDLQLPADFVPNNEDGEVDSFRLVPVIHAANIIRRTDFFKPNCNLVIIDFLFRHGYINPDSRCYLDLLQSLRSGDCS

SEQ ID NO: 629 - protein, 261 aa, Zea mays
MPPAAAALLRCAPAVPFAARSSAVSRSGMARRLVAASAAAGRLAPAYRGLLLDAGGTLLQVARPVAETYASIGRRYGVTKTKKRIMEGFKRAFSAPWPKTLRYQGDGRPFWRIVVAEATDCTDGDYFEEVYQYYAHGDAWRLPTGADAALRELKDAGVKLAVVSNFDTRLRKLLKDLNVSEMFDAIVVSSEVGYEKPSPEIFNIALDQIGVEASKAIHVGDDETADMAGANATGLECWLWGKDVTTFSEIQERILTTDGPQ

SEQ ID NO: 630 - protein, 65 aa, Zea mays
MAPRVASALLFVVAVLVASAAAQESMAPASAPAPGPVAGAASAPASAVAVVSSALLSLLMTALMQ

SEQ ID NO: 631 - protein, 435 aa, Zea mays
MASSCIPAGGIRLPDLEMVKAAPPAHSAASSTLSEASSASAVSSSATSSSVASLSLKRPRTPRKRSSQTYNEAAALLASMYPSVFPVARGGAAPRRLLGLASALADDSSCSDLLPPFPVPGGHAAFLLRDLTPRIPAAESCPSPAAVSSVFSEFRDPAPSPATPDDAAAAPDERRDLGFDDDDGFDADSILCGVDQSAAEGIDGIMGKLSMENNGASVSGSSVDSNMPGSKMHPYLRNLMVLGLSFRQDQNIIINQALKRHSVDPEWWMCPAIPVKDITPAPPPSVAMAKVTDKKKTKKKSLGTIYEEGSPEPANGDDDGALALPETGLGLSLNTDGVLKAWCGRGSAFADGNGPDLPLSPAHVVVKHEDNDLFPKNGTGAVIREGNILKMQRKQKPCTPLPSNKQSRYYRPRVKGRFVSKACFLQRQQALEKES

SEQ ID NO: 632 - protein, 116 aa, Zea mays
MCSGSWSWSSSKKRKRPSLVVVNLKRQQLQKTPPPTPPRASVAIRRKRLRLRRLRAGAEAMEMVNLKLYLENRCIIAENEKLRERASALRRENLALLQDLSKTPAVPEAGAGAGAA

SEQ ID NO: 633 - protein, 212 aa, Zea mays
MHPVPVPSQPFTATPAKKLVSRSTAVRKAIHFVNLRTAGRSSGNLAMNSVPKPALGSETSWREDFAVGDKDAVVIVDHGSRRQESNLMLNDFVEMFRAKTSYRIVEPAHMELAEPTIKDAFGKCVQQGASRVIVSPYFLSPGRHWKQDIPALAAEASKEHSNIPYIVTAPLGLHELMVDIMNDRIKYCLRHVAGDVDECTVCAGTGKCRLYS

SEQ ID NO: 634 - protein, 197 aa, Zea mays
MAASNGGGGPGPISAEAEAALGEAIKLVFGRWTALQMAVENQWGGRDSRAKADQLGESILFWFCRTKGPYYFEDLVDMMYDKISESFNAYFEDNSIEEVAEQFLIIHEECLQNNFSSIEKLRNSRVPGNAVSQSRQIVGDDDDDSDSSDDGDDTSMVADEEAGPEEMAVDRPRPPKPTPDADGWTVVPPRRGGRSKK

SEQ ID NO: 635 - protein, 1086 aa, Zea mays
MPAKYLGPGALAEDRRQDLHRQVGCVTGILQAFDRRHPLASSSHKRLLPPTGHAVSSNPSKEGDCTRYSPQIVLENSSKTWADSQRAPATELSQTSYSSSPSSSFSSVDDNKSTQQDLSSTDRMLFPERPFKSSPKLKSYFDSDTGLDYPDDAPTKSKDMPIVQSSLPTLGIRNLVKDSIYMDSRELSVRICTKEVTDHPSNCGDQPRELNGPPRDSTQEKSKGLVDINESLRVLAKLREASWTPAESVHHARLSYDAPRFSYDGKEAASKLREVPRLSLDIKESHLRNGEIDSRLNPSLSSTDRSSNTVIGSNAAFEIQQKQPACKRLPSVVAKLMGLEELPEHNQSIASSHACKTVQGSKQEAMFNPLSISSHNEHALRQQRNHDSTVRNLPNSKFPVETAPWKQQERIILPRKLPKGSKGAHGREQPAASVISDIEKRLKDLDFRQSYKDLRALKHILDSMQAKGLLENKNREEISMPKLSDGNHNGQEIASVNMRVNSNTNNVCMPEESNAESSFKSPIVIMKPSKCANLFNEVDSSVFPLGGSSDPPQQQTSNSTYRRKASTRNRTAKEQHAKFSSKVPTSQPLVSYDRRSYGRNDDSSNNQKSSSLLVTESSSRRQQLPRDSSISMKKNKHSTTPRLQQRKLGSERRARPPIPCAESNKSQNQSGDRNNAETVSPRSKFRRKLLCPQEGDDDMPSGLNNRTRSLNQHGNDMSTRSDGSITVASELDIISNDRSTEVDISNFDQGIGTPSGRNPQKVKTSYDASKDVPSVDPSAGISERPSPVSVLDSSFDHEDLFPSSRNPNSLAVDDERQTLGEEPWKPSVTKATEVGMQSKNNKLANVVSLLQKLQQLSVSKDEDAPPVDHMAFLCETESPDHRYVSEILLASGLLMKELGSGQAGLQLQLHSSGYPINPDLFHVLEQRKAGWASIPDGIHQSRSGAKSDPKRAHRKLVFDTANELLLQKFEKETTVYAVSSSTGAKDHPPAKALSGQQLLKFVSSEIEGMGTERSSTCQMEGGVIPDAEILQRLQGWTSFSRELPGMVLEIERSVFKELVDEVVHGESADGPEMKAAGRRRRRRLFA

SEQ ID NO: 636 - protein, 100 aa, Zea mays
MVLARAMVMEHRKKSNYLVALVLASLLLSAMAGGHRKKLLNKDDASESMETLESTQQLQEDDEMAVVVHERILRQAKMNDYGSYDSSPTMAKPHFKDIPN

SEQ ID NO: 637 - protein, 93 aa, Zea mays
MGTLACPWRSGHLFAFITFAVLFFSTSFAGRQYSFLMDQDALRQQEGEGARTEQKEALVPLVQARRLSVKTNDYSSYDPSPSMDKPHSKLIPN

SEQ ID NO: 638 - protein, 268 aa, Zea mays
MDKDGSSERSRPDHGDVKMLKFRPKVPRQKQKPKQQDPKPIDEDVMKILRTRQVAAKSAPNTEDECSPQKTLSTPPSADVVCLSPAQLGVQKQNQLPLQIPRSFPVPVNSGLVYEEESSDDDDDNDSDNVGLLETQPDSIESEALTCPAEELDLLQQEGSKERMFFFQFPNSLPLPKRSSSAGKEVMEGSNLQQLPQGYLGKMLVYKSGKIKMKLGDIIFDVNPGVESRMLQRAVALNTRDKHCCLLGEIENRHVIVTPNVDSLLNDK

SEQ ID NO: 639 - protein, 535 aa, Zea mays
MATTEATTLTALLKEAAAAFPTHRAVAVPGRLELTHAALDALVDAAAARLAADAGVLPGHVVALSFPNTVELVVMFLAVIRARGVAAPLNPAYTSRDGNGEFPEEFEFYLSDSEARLLVTNAEGNAAAQATAAKLGLAHAAASLHDAAGPVHLAGLPVPALENGSHGGGAAGSLSPNDPSDVALFLHTSGTTSRPKGVPLKQRNLAASVQNIRSVYRLAETDATVVVLPLFHVHGLLCALLSSLASGASVVLPAAGRFSASTFWADMRASGATWYTAVPTIHQIILDRHASRPEAYPALRFIRSCSASLAPAILERLEAAFGASVLEAYAMTEASHLMTSNPLPEDGPRKPGSVGRAVGQELAVLDEEGRLVAAGSPGEVCVRGDNVTAGYKGNPEANEAAFRFGWFHTGDIGVVDDQGYVRLVGRIKVKELINRGGEKISPIEVDAVLLGLPGVAQAVSFGVPDDKYGEEINCALIPRDGSALREEEVLAHCRRNLASFKVPKKVFITDDLPKTATGKIQRRIVAQHFVQPTSA

SEQ ID NO: 640 - protein, 137 aa, Zea mays
MASAASSAVGAGKSLFQGLRRFLKKPWEITGPCASPEYRSALPGALEYRVKCPATVRDDRDKAIVPTSDPETVYDIKYFTRDRRRSRPPVRRTLLRKPDLESYMATKQFDPTNDFPVPYVNTTVEEDDNTVGGGYQK

SEQ ID NO: 641 - protein, 478 aa, Zea mays
MPRTTVLESPGCPPLRALTTDILGLVKVVEAHARPAGAAKVVETWGAPDASCAIVAASLADRATDPVLAVARKNGVVELLNPLNGDTLAAVKAVGPAPNDGGAEGDPLTALHLFTRQASDSILGTFLACTEQGKASIRSITKENAASGSHIEPSATWDVCGGANVQFCSVDHGENYVMFGGKGIEVSLWDITSCSKTWSAKSPRTNSLGIFTRPWFTAGTFLCKDDHRKIVACTNSHQVRLYDTALQRRPAISVEFKESPIKAVAADPNGHDVYIGTGTGDLASFDMRTGKLLGCYFGKCSGSIRSIVRHPDLPLIASCGLDSYLRIWDTNTRQLLSAVFLKQHLTTVVLDSHFSVEEPGEMKSKQLESSVETETEVRKEKKKKSKAITEDETEAQIRKEKKKKKSRTIEEEEQAGLVDHSDINDEVYARKEKKKKKSRGIEGGKERERNRETRSNKTTKSGETSKPQKKRSKKQLVA

SEQ ID NO: 642 - protein, 129 aa, Zea mays
MAKYNVVQKNKRQCNQDRKRAAHGEPGTGKLKQRTAPVSMSGKRKKKLERRLNRKQKEAAMIKALENNMGDVDMVSVEESSEAAKGKSQVKFSVKKNSRIQIKRLKGKGRKKAKNAKPPAKEKVDAMVE

SEQ ID NO: 643 - protein, 159 aa, Zea mays
MSHFAAAAVKSPLAVAAPAAGDAKSPLFCPKPRRPAAPLRCHQGGDAGMDLLDLLLSKGEESGLSAASPLFCGSPPRRASNPVVHDSRFGVDCPPLPVPMPVAAAAVHRPSAAPPMSPRGGNGCARARFAFQPAAVRVEGFDCLDRGRGGRGHGITAMA

SEQ ID NO: 644 - protein, 2054 aa, Zea mays
GAVLVHEESNAPEQPNQEASNVVASEVLGEVGAATPFLKSEIQTSQRCILTETRSLNKAVESIPMLETGEQATGGSNQKPLLELPNSACSTAHHEEASKSVEDGNSIGIQGACTSRNTEAIQCDETWYDDNICVVCRSREISDILKSCGGKGCKRHYHLSCMDPSLDVSLGIWLCIMCMKKRIQFGVYSVSEGIESLWDVKEGVVNSKQYFVKYKNLAHVHNQWVSESDIVDSTPQGSDLISKVSKKIHKEKTIRWKQEWAEPHRLLKRRLLMPQKEAEVFFNSLGDKFVYCNVEWLVKWKDLGYEHATWELESSSFLCTPEAEELKRSYEDRFKTARKASDPSKVDKAKGGIFQQLERLPDGCPPGLDDDHLRSLNQLREFWHNSCGAIFIDDQERVIKTILFVASILPHICQPLLIVSTTTTLSLWETKFNRLAASINVVVYNGEKDVRKSIQDLEFYQDGSVMLQVLLSHPDAILEDIEVIERINWEAVIVDDCQNSRVSKWLEQLRRLPTNFRMVLLSSSLKESIAEHISLLSFLNPEENGTLSVSNGVSFDTAGTLVVLKEKLARYVAFERKTDSSKLLEYWVPARLSPVQLEMYCYILLSNSPALRSHSKTDSVGALRNILISLRKCCDHPYLVDQSLQSTLTKDHPVTDILDIGVRSCGKLLLLDRMLQQIRIQGLRVLILSQSGGESGKPMGDILDDFVRQRFGYESYERVERGLLLQKKQTAMNMFNDKTKGRFIFLIDSRACGPSIKLSSVDAIIIYCSDWNPMNDLRALQRVSMESQSEPVPIFRLYSSFTVEEKALILAKHDHILDSNIVNITPSLSHCLLSWGASFLFNRLEELQQHSYSNVSGDELFMDNVDLEFLTKLLSKVELRTESGNTAISQAYLCGSFYSRAIVVAGEREGIPSVDGDLPKFWAYWLSLLNGRSPQWQYISEPVQRSRRKINNMEQQLKNTDKQLKITTEETDEARVKRRRIGEIMDSSAIDSPGKNKDTILPGNNTPPSSHQISVEDTWQELERSNLHATQKGLHVQLKPEISKLYKLLQLPEKVKSLCEEFLEYILKNHQISQEPKGILHAFNLALCWRAASLSKHKINHTESLALAVKNLNYECKEELVDFVYGKLKILKKKFARRAGEVSKQNYMVSVSDISTCEQVTSVRLRNDELVPSQVTLTDGNFENGSHHEATGDFWTEEMVSGEKELLPDPVTHEGEHLLRDELLSKIMDKRIKLVDKVFSLRGRSIYDKHSNQVSFLDMHRQKVVDKLRRACSLVVEHLRSSQNHIAQEDRDGKIKLIIEWFTMLLYAFLEHMKCQRNRLDMQQSASRIKESQLKEETLQAARCGQLDQNFDQHIPSPDFEFAMEEFRHFREVVGSCYVDPAALVPESLDDNSAMEIMLVQSATDAEVIEEVLNRPTEVLVQGPASEVVGPSVDVICNCSDGINSQRDASLAVHSLEPSSDDLRSTDHVEENTVGSQIQGGTSKHLGDAAMEVETGNRNTALADSPHFDKPALTAPSRQATLLVSRETEMLSNLVDQCAQQSLVSAQPLQDESEQADLSSAASTQPLQSERQQLISVSNNLLERAQLDQSQPNYQTDAAPGCAQSTELFPVTSMMFNHAPIDSEPLKNELHKLRLHMDTLNKVHEMKKTQLQTACSQELEKVKRKYDLLIKEHDSTHLQQKKALGDFYEKVQRNQSLAEDFRAKFISLSAAQGAAKGHTPPVRHTPQATQVVSSTSSIALSSACRPPVPRPRVQAPQVDQPLLSLSQFSRPSLQVVQPPNLELGNLFRATSTTLSHMPPQRGSYGVQSELAPRSPAPHLQFRSPRAHSMAPGNQQQSPAISVDAMSSRTQPVLAASTSPSDIHVGPLAASALSSLHSVLPSTSLPSSLHPSHLAQRVPPTPNPTLQAGAPKGSNATMPSIPTGMQLPDSGSLSLDAWLTANLGLNDASTAPAKDTASLGLSSDAPRAAPDTNTASLGLSSDVPRGTAPATNTASLGLSSDVPRGTTPATTTTSLGLISDSPRVIAPASSNSPGAIASATNGGSEIDVVCLSDDE

SEQ ID NO: 645 - protein, 157 aa, Zea mays
MGFVSFVGRVLFVAAFLLSAYQEFNEFGADGGPAAKALQPKFNVFVKNISAHLGVAVPHIELKHVIAATIALKGLGSLLFILSSSLGAYLLLLYLALITPIVHDFYNYDTEKEEFARLFAKFTQDVALVGALLVFLGMKNSIPKRQGKKKAHKAKTN

SEQ ID NO: 646 - protein, 231 aa, Zea mays
MATYLNAPPAATTTTASCRHAFSGGSLRLLRPSRPTLHVTCQAAASSQQPSSPSRRSACLLGIACAVLLRPRAASAAETDDEPANNGWWLTEFPLPVPKIVNKEINNAETGTRSFLKNGIYMADIGPSFAAHAYRLRSTAFDLLALEDLLGKDASNYVNKYLRLKSTFMYYDFDKLISAAEDKPPFVDLANRLFDSFETLQEAVTAKDDARIGDRYAETKLILQELMAKMA

SEQ ID NO: 647 - protein, 256 aa, Zea mays
MAIDDESPLRVNTRGGAMGGGERDGAENQRWPPWLKPLLGTSFFGQCKLHADAHKSECNMYCLDCMNGALCSQCLAYHRDHHAIQIRRSSYHDVIRVSEIQKVLDISGVQTYIINSARVVFLNERPQPRPGKGVTNTCEVCERSLLDTFRFCSLGCKIVRTSGDFRIRKKHAIVAKKKREKKHAPQQKQHRGAADSADDDDDDSSTSTSGGSDKSSVVQSFTPSTPPATTANSFRAGKRRKGVPHRSPFGSLVVEF

SEQ ID NO: 648 - protein, 474 aa, Zea mays
MARRSRGSGSVTDAASKADAAAMRMVSRRGAVRLVLVSATAWAMLGLVALAFHLRPCSSRVAFLSALCKKDSKVLSVLDSMGLSSKPLHRCPIPVADDPNVVVIPKRTPNTIVKKLAYITVDKQDKDPSPLFGGRQNWKQREESFKLNSTMKVHCGFMKNSGADMDIIDVKYIQKCKFVVASGIFDGYDIPHQPSNISRRSQKLFCFLMVVDEVSLDFIQKNTTVKIDSAGGKWVGIWRLLTVHRLPFDEPRRNGKIPKILTHRLFPQAWYSIWIDGKMELIVDPLLILERYLWRGKYTFAVAVHKHHRSIYEEGDAIKRRKRYARPLVDLQMKMYYYEGMEPWSPKKKMPGDVPEGAVLIREHTATTNLFSCLWFNEVNLFTPRDQISFGYVARRLGDALELFMFPNCEYNSLFVLHRHTREHSSKVEWAKTVDEIVEKGLRESRGGLGLWTPYPADLSSVELPAVRRTSPAG

SEQ ID NO: 649 - protein, 170 aa, Zea mays
MDQVLNKVGSYWFSKRASKEIDSIGDDISSISSSIGGSAKWMVNKIKGKMQKALPDLLKEYDMPAGLFPRDTTNYEFNEETKKLTVYIPSACDVGYKDSSVLRFFTCVTGYLEKGKFSDIEGMKTKVLVWTKVTAIKTEGPKVHFTAGVKKTRSRDAYEVVRDGITIDKF

SEQ ID NO: 650 - protein, 375 aa, Zea mays
MPAIPTAPAPCPVRFLLARRHSLHISYPSPCSNHQRLPPRLLRLPARPRAAPMSAEARAPASPVAPPAHPTYDLRAVIALALAEDAGDRGDVSCLATIPSDVEAEATFIAKADGVIAGISLADMIFNQVDPSLKVEWFESDGNFVHKGLQFGRVYGCARSIIVAERVVLNFMQRMSGIATLTKAMSDAARPACILETRKTAPGLRLIDKWAVLIGGGKNHRLGLFDMVMIKDNHISVAGGIANAMRSVDQFLQKEKLTIPVEVETRTIEEVKDLLKYAAENKTSLTRIMLDNMVVPLGNGDLDVSMLKDAVRLINGRFETEASGNVTVDTVKKIGETGVTYISSGALTHSVTALDISLKIDTELALQVGRRTNRA

SEQ ID NO: 651 - protein, 499 aa, Zea mays
MQAAPGSVSWAASQPSVLGRCGGGAPSASLKWRAGGVGGGECRVRGRDVVVPRSCARAQEKRLPRVRKSKEERREMVESFIKSYRVSNEGKFPSINLTHKEVGGSYYIVREIMRDIIQENRVLGPGGLDAMTLSFEDCADSSKSSMKLELGQDSIEILDMSGSEVSKSHVPEISSTDESFPLQGNAISNHRLLGSSNILEVGVLNSVVQNGSVADAIFMETNLAKQDEVPSRGSIEFDLNTSEEQARLFAQVSDSDEEVTLNNQADAQDGTTNSGTDRVILPLESFAVYENNASLLRDHETLPDDNHDGSTDRVADDASLLAATNGVQAKQASLHEHDASTRSVLIDNAQSLDGQFSTTVSTDPINGFKLETEIATKTVETSQVHRLQDEFEQPLVDASYDGQENSDSPVSHPALDTKGLLHTEDQLNVVQVDETEFKNSTSGITKEEVHAADFRHEQGINTTMAISRRTLKAQQKKDDNLFWLVLRAFVVAISKIWAK

SEQ ID NO: 652 - protein, 107 aa, Zea mays
NNMCVDCGASEPDWVSLNLGALLCIECSGVHRNLGVHISKVRSLTLDVRVWEPSVINLFQSLGNMFVNSIWEETLPDDNSSADGSDTSQYLSVSKPNLFMRILVYFV

SEQ ID NO: 653 - protein, 920 aa, Zea mays
MTTNTKRAYKLQEFVAHSSNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNTIRFTPDGRWVVSGGEDNIVKLWDLTAGKLLHEFKCHEGQIQCIDFHPHEFLLATGSADKTVKFWDLETFELIGSTGPETTGVRSMTFNPDGRSLLCGLHESLQVFSWEPIRCHDTVDVGWSRLADLNVHEGKLLGCSFNQSCVGIWVVDLTRLEPYTMGTSTKVNGHSELKTVSSGTLPLQNDSGSRANIGRSSVLQNTENNLKTTSGRLSASQNSDSAPKETNSAPSSGLIPSTPHRAGVGSHNRSVGNSAFQSGGTTLKRSSLRNNSASNVHNFSKADVVPVIVPRTSSGGELATDSRSDAADVAPVLPKVTRRVEPATDSRKESNDVELVVPRASSRMEIADLAPISSSKSGRRLESAPDSKEESADTAPVVVSNPRANVRMEIVSDSAPALSKSNRKLDSGTNSKKESADAVIVPRTNSRMEMISDSRREPSAGRISPFRIQSRYAEPRKLAHARTDSNKVDSRSKITETEDFNCQIFLPRRNSVFQTISSEEPREDVKCGPVDRVGFSNSSEPNASVRNENYVPRMRKPGDNCYIEVSRAGRARSSVSNWEGRDQPPSHEEPTTSSSTLAPTGHPYSSRGSNQASEAPIIASDEDVLSLIMERHDLFLSSTKSRLMKLQIIHQMWERNDIRGVLSAMDRMGDHAVCADMASVLMEKSETITLDLCTSILPVVTDLLESKIDRHLVVALELLVKLVRTFGPMIHSTVSSGPCVGVDLEAEQRRERCNLCFIELEKAKNKLPSLTRRKGAVANAAQELALVFQEIMS

SEQ ID NO: 654 - protein, 133 aa, Zea mays
MDGKSFSNEQQAQQKNPDAVTNSVPSQGQEPLNTFPDSDDGNTNTGPLNGHAAAHVNMEAAISTEDVIRAGGFGAKDDIGSLLPTAIDSTDFEASLRDARGFEGEKAAPSHPGLGWKGEKADGGTKLADVAEQ

SEQ ID NO: 655 - protein, 446 aa, Zea mays
MVSSDPDGNGGAPDVSELFCHYNSLYFRDSLGSCAVSWTEDPLPDCDVSTCDYYPGGGGCIILLSKSLCGSHNGSDLKNALLHEMIHAYICIKDNNSNHSDHGAKFQKLMNTINLSSVADPHRPVDGYSITLLHEIHKKYYHYKCQSCADFIKSTNMRGPSGDDCIERKGVDDPCHNSNCHWHRHKQQCSGNYCRVQESSPGGPELKCLEAVEAFNEGKVEEPACTSWHTTHTSNKSRRSNKNEREDASVEFLHVAHNAVVCSGLDSSSKDRSNKKIKISKDVNSDLGRTETVQEAPKRRRTAVLDNQECSRRKKRKQSNRCGSYSVIIEWLNYYCLSESDEDEVPLINKRTERRRRQRLHEMYLARESNDVEFGSSTSHKVGSCSLAPKDNNKGESVPASQPEERSCSSHPVSSNGVAGNQAGHEHMSSPTDSPIRGEIVDISDG

SEQ ID NO: 656 - protein, 197 aa, Zea mays
MELCVSTPPSSVRATAAPISFAPPRRGASASTAVPPHRRIPTRGWRCASAAVPGPVPSEEPASASYAVVVTDKPDTPADDKAEEVSAAPSGSAEAPMAELVPSEASSSPDDGGLDEILSKLNIEVTPTLILTGFGAFIALWILSSVVAAVDSVPLLPKLLELIGTAYTIWFIARYLLFKESRDELFAKFEDLKQRII

SEQ ID NO: 657 - protein, 802 aa, Zea mays
MPDVMAAALTGFSPRGVIPSRGRASLPGVARAYAERRLVAENTSLPNMHKEQLETIIRNQLRKPQLPPSSYDTAWVSMVPVRGSHQTPRFPQCVEWILQNQQDDGSWGVSQSDSSVSKDVLLSTLACVLALKRWNVGRENIWRGLHFIGRNFSVAMDEQFTSPIGFNFTFPGLLSLGIDMGLEFPVRQIDVCGILHRREMELKRLAVDSSFGRKAYMAFIPEGFGNMLDWDQVMKFQRKNGSLFSTPSTTAVALIHKYNDQALQYLNLLVNEFGSAVPAMYPSRVHCQLSMVDALEKMGISQRFVSEIESILDMAYNCWLQNDEELMMDIATFAMAFRLLRMNGYDVSSDELSHVAGASTFHDSLQGYLNDTKSLLELYKTSKVTLSENDLILDRIGSWSGNLLKDKMCCSRVQKDSIFGEIEYAVNFPLYSTLERLEHKRNIEHFDAWGSLMLTTKSSSFRINQEFLALAVEDFSFSQRVYRDELRHLDSWVKENKLDQLQFARQKLTYCYLSAAATVFSSELSDARISWAKNGVLTTVVDDFFDVGGSKEELENLIALVEKWHGHHAVEFYSEQVKIVFSAIYTTVNHLGAMASAAQGRDLTNHLVEIWLDLLRSMMVEAEWQRCQYVPTVEEYMTNAVVSFALGPIVLPALYFVGQELLEHAVKDEEYDKLFRLVSTCGRLLNDYQSLEREGNQGKLNSVSLLVLHSGGSMSIEAAKKAMQKSIDVSRRDLLRLVLRKESAVPRPCKELFWKMCKILHLFYSQNDGFSSPKEMVSAVNAVINEPLKVQNSTTFLSSSSR

SEQ ID NO: 658 - protein, 334 aa, Zea mays
MAPSKPLFPVAVPAPDPSDEVVREFGPLLRIYKSGRIERPLVAPPVEPGHDAATGVQSKDVHLGSYSARLYLPPSAGAGAKLPVVVYVHGGGFVAESAASPNYHLFLNRLAAACPALAVSVDYRLAPEHPLPAGYDDCLAALKWVLSAADPWVAAHGDLARVFVAGDSAGGNVCHHLAIHPDVVQAQRARQAGAPPLKGAVLIHPWFWGSEAVGEEPRDPAARAMGVGLWLFACPETNGLDDPRMNPLAPAAPGLHTLACERVMVCAAEGDFLRWRGRAYAEAVAAARGGDLGEAAGVELLETMGEGHVFFLFKPDCYEAKEMMHKMVAFINAP

SEQ ID NO: 659 - protein, 716 aa, Zea mays
MKALASPAASFLPGIPSPSHLARALPRSAAAALSRPPSGRSIAAAAAAATGDHWGADHQHYHGGRAGASEAGPTASARGVKCDVDVVSWRERRVLASVPVAADVDTLWQVITDYERLADFIPNLVQSVTIPCPHEGRIWLEQRGLQRALYWHIEARVVLDLQEIPDSVCGRELHFSMVDGDFKKSEGKWSIRSAPRSSSAVLLYEVNVIPRFNFPAIFLERIIRSDLPVNLRALACRAEKIYLENQGCGSRKFFVEDLKPSYTSQLNNFHSTTVETSKFKQAPPRSGVSSVLPSPSSELISKWGVYGNICRIDKPCVVDEIHLRRFDGMLEHEGAHRCVFASITVKAPVREVWNVLTAYENLPEFVPNLAISRIVLRDNNKVRIMQEGCKGLLYMVLHARVVMDLREKHEQEISFEQVEGDFYTFKGKWRLEQLGDQHTLLKYMVETKMHRDTFLSESILEEVIYEDLPSNLCAIRDYIEKAGAKSSNSTGHSNVPTDPDPDVDHDESRQSEQTCVSCSSSTMKQRPKVPGLQKDIEVLKSELDNFIAEYGQYGFMPKRKHLRSHGRVDIEKAITRMGGFRKIASIMNLSLSYKNRKPRGYWDNLENLQEEISRFQKIWGLDPSYMPSRKSFERAGRYDIARALEKWGGVQEVSRLLSLELRYPRRQADPDDERQSESPSGMMKKHGVKPDEGNVSPNAQKWLLKLKDLDVNWVEY

SEQ ID NO: 660 - protein, 537 aa, Zea mays
MGEPLLASLSMENSNSHPCTLLSMDPAGSHLASAESSGGGSAATNGVGNGVDRELFVIPRRESAHPVPPDINLPLSADHSPLPPSWSLDTFDILDVTLGTHNYESEVALTLPKPTGNGNGSAAIGVGARKYAKRGDSIWGAWFFFNNYFKPALVEKSKGKMVRDASRNISGFDKSDLRLDVFLVQHDMENMYMWVFKERPDNALGKMQLRSFMNGHSKHGEPSFPFSADKGFARSHRMQRKHYRGLSNPQCLHGIEIVASPNLSAVPESDLKRWAELTGREHNFSVPSEASDFESWRNLPSTDFELDRPHPPAAKSATHGQKKGLNGSGLNLSTPPSSDDGMDLSPKCAKRRKDFFGHGVEEDCVMANNSCSDREQEAEAHTGEPSWMHEFTGVAKHASGPVTAAKTIYEDEEGYLIVVSMLFSDPHSVKVSWRNTLTHGIVKITCVSTARMPYIKKHDRTFKLTDPFPEHCPPGEFVREIPLATRIPEDAKIEAYYDETGTGLEIMVPKHRVGPEEHEVQVCMRPPHLGDNDLVLS

SEQ ID NO: 661 - protein, 166 aa, Zea mays
MASLWRAVMDSVSGSSPSALDAAPGSGVEFWHGAERAGWLNKQGEYIKTWRRRWFVLKQGRLFWFKDPAVTRASVPRGVIPVATCLTVKGAEDVLNRQFAFELSTPAETMYFIADSEKDKEEWINSIGRSIVQHSRSVTDAEVVDYDSRPQPPPQLMTSEESAPAA

SEQ ID NO: 662 - protein, 277 aa, Zea mays
MSSGEDGYCSSDSPRAESPDQPQAAAAADADADAESPRAGAGPNKRDLHASSPAAKRSRRSVEKRVVSVPLAECGEGPPPSDSWAWRKYGQKPIKGSPYPRGYYRCSSSKGCPARKQVERSRADPAVLLVTYTFDHNHEAPRPKSSCCHQQGRPPAPKPDEPVAEQEDELGPEHEPEDEQEPEQKVVPGLAGPEAAPATATLAPAPEEDESFDLGWFDQYPTWHRSALYAPLLPPEEWERELQGEDALFAGLGELPECAVVFGRRRELSLAATAPCS

SEQ ID NO: 663 - protein, 297 aa, Zea mays
MSGGGGLGSGCSYQKFVHFALEQTRHRSTLVPHPSQEKFRFIKANEDNTVLNALSFSTSKIRLLRSLTIEQKNSVQVLDFAAFSRPEYDLPIFCANAFSSPARSIVVLDLNPLYDTTEHKDYREKYYRALMPLVHKYSELLPWGGKITSESLRFFSPIVIWTVFEPSEANHQALYSAFVDYYMVWLEFMDGAVRESSKEKIDRNREAQHKYLTWRAEKDPGYPLLKKLIGESGAKDLVREFLFEGVGSLGTKSFLEYFAEYAQEDGTVNKKRSMAGKSFGTRPWDAHGLFVGDAVDG

SEQ ID NO: 664 - protein, 241 aa, Zea mays
MDDDWELLLASPKAASAAEPYAGGGEDDAGAIKHDYFDLGSDAKYPRRASLSTGDEEEGAEEGLLRASDNASWVEPDPDDLLFPGRDRAALWSDSSSDGERPEVEATDPVGRAREEGGVMAAAADGVEGAVAKGGEHVRWWKLPLDALRVWAMRAARSAWSVPFAVALLGFAVLGRRLYRMRRQSKAAARVRLVFDEKKASQFKGQSSRLNESTTMMRRTPFIKPMLPANGVTPWPVLGHL

SEQ ID NO: 665 - protein, 345 aa, Zea mays
MDEASTSASGAATRRGFVPARSGVFYRFTQQNLPAWKPAMTPGCIIAMFLIIGIIFIPFGLLCLQTSNHIAEIIYRYDVDCVPDAYRGNRQAYIKDSSISKNCTLEAKVLEYMRAPIYVYYELENFYQNHRRYVKSRSDKQLRFGAKYTADSCSPVEWDNNGSPIVPCGLIAWSLFNDTYGFTRGSKEIKVNRKNISWKSDREHKFGKHVFPSNFQNGTLIGGGKLDPTVPLSEQEDLIVWMRTSALPKFRKLYGVIEDDLHADETIAIFVGNNYNTYTFGGKKSIVLSTASWLGGKNDFLGHAYIVTGSLSIIISILFALIHVKYPRPQGDPNCLSWNRKNSNS

SEQ ID NO: 666 - protein, 226 aa, Zea mays
MEVGRTPRRRASPAAAAAAAAAAVPSLLLFAVLFVGRAAAALGGPGPALYKHASFFDRDGDGVVSFAETYGAFRALGFGLGLSSASAAFINGALGSKCRPQNATSSKLDIYIEDIRRGKHGSDSGSYDAQGRFVPEKFEEIFARHARTVPDALTSDEIDQLLQANREPGDYSGWAGAEAEWKILYSLGKDGDGLLRKDVARSVYDGTLFHRLAPRWKSPDSDMERS

SEQ ID NO: 667 - protein, 96 aa, Zea mays
MAIRGVASTREEDMTLEEFKEWLKQFDADGDGRISRNELREALRRRGRGRGWFTAWRSDRALRHADKDSSGFLDDSEIENLVAFAQKDLGMKISTW

SEQ ID NO: 668 - protein, 714 aa, Zea mays
MGQDAGFKREDHSGLGSGPQTLKVSCCTSEENESRNRRYHQLKCSESNSRQLHLDYVPNFHCRSLPTRSRKTNAEQSTVGKRGSMYQSSSEISRIRKIQEGRRKIDSAFDGDAFLSFDIVDASSRPSTSGAYLHSHQNRRSGAKPSVDTAKRASKDFLDLQFREHPDENFKLDRPRLDSTLLKNDDGFLEISLEKEIAKGGPCRNAAPILLNTGSGKCTDLQKMNGCPSENNCGDKGRDSASSSKSTPVKVSSFDGSCQSDGAQHHITENNTKARSSPFKKMLDPIMKSKSPRSPSIMERGGSNSATGPGSRKNSVSRKSLLGDFSRSEQASNCQPNGQTQKRVNKSALSPAHLQAVLRLDSKNGVQVFEFCVDGPGESISARNWKNGDELSSIYTFHSGGKRSSAAGRISKDGGWDLPPIVGQVQVSSYLCSEVGKDGTVNNSVVTEFVSYDIGHARRIVEEKTGALQQPQRTSLTEENKTGRNNSDVSTSCPWSEEDLHPYLEIAATVIEVPFSRYKSEEVKNGSSPCTVKVVAPSGLHGSPSDDEAGGPSPLLDRWRYGGGCDCGGWDMACPIDVIGNTYDNSWAESIATNVKHPMELFVQGSKEELPVLSMKENGRGQFVVDFHGRLSALQAFSVCISLLHCSEASIAISLKKGKQKLYSSSLKLLLEEDVRHLIEAVTAEEKKKKKRSREKAPPPSVLLDPPFSPIGRV

SEQ ID NO: 669 - protein, 350 aa, Zea mays
MAMEDAASESSDWEVLSATSACGGGDDDEVLIVSGGGGDVVLDHFALTPDTAAAWPGDGEGSWSDDRGAWQGLELLDGFDPIPEASFNLAAGVWNQPLLISGVDDAREGARSATRSADGNQEEVVAAEIQQESNSVFSRGELRPVLQPAYHGVGETLDSDAATRTGASLQGEVSESSLVRLDGGIGTGVERSCLEDAVSSDEIHGEQEEQEQGSKVNAATGCDEPDGEVKDGALPLAHTAGTEEGEKQFVVWWKLPFKLLHYCAWKVKPVWSFSIAAALLGLVVLGRRMYRMKRKARGLPQIKIAFDDKRASQFADRAAYLKEAFLVARRVPMLRTSSGATLPWSMVQER

SEQ ID NO: 670 - protein, 183 aa, Zea mays
MKHLHLSSSLPLLLHRPSKPHLLHPSRRRASIRNAASGGGSGEPTPAAETASGTSPPAAAKPAGVKDRLKARNQARRVRLDSPPPEVVVVPKKKPAPAASSSPVPKKKVGRKGWEEMSLGEKAVDLYVGEKGLLFWLNKFAYASIFIMVGAWVLFRFVGPSLGLYQLDAPPLPPTAVFSGGSP

SEQ ID NO: 671 - protein, 86 aa, Zea mays
MEALQFLVLWLRMLLTLMYKHEQYNAFDVVMLLFYFHPSSDCWLMQIGWLLLFTKVLIMVVCLLSSFSSIYQSSNYGCVPSFNIFM

SEQ ID NO: 672 - protein, 823 aa, Zea mays
MDGSGSWDAIDWNQIEDPRPRRSGQAVKESMDDFLLEDEEVLAQGHGVVLLNNRDAGTLSVTNFRLLFVSQAKKCVIELGTIPLTTIEKLNDDVKLQPLPHLSDKNHPRELLQVIGKDMRIIVFAFIPRTQQKNEVFDALRRYTKPANLWDLYAFSCDPSTIKHDSEPKWRLLREYFRLFRRSLPLQGVEEVSLCNEWWRLTRVNSSYSLCSTYPSELIVPRSISDEDLFQASPFRSGKRLPVISWCDPGSGAVLARSSQPMVGLMMNFRNNADEKLVCALSSRTIDEKGSPRKLYIIDARPRANAIANGAKGGGSESSSNYHKSEVLFLGIQNIHTMRESLSRLRDYVDAHGSISSNGSPSAVSVVGDRRNRGSTWGGGNLNSMTSFSSTLGEWLNHIQNILVGASWIAAQISEEAASVLVHCSDGWDRTTQLVSLACLLLDPYYRTFSGFQALVEKDWLAFGHPFAERMGVPTVAENGGSQYELLRQPSLGNLSSSPSRNTLGPPGPSSNSPVQSQTSNNTSPILLQWLDCISQLLRLYPSAFQFSSKFLVDFMDCVLSCRFGNFLCNSEREREQSGVTISCRCMWSHLANLRASGGSFHEHYNPFYDPVNHNGALLPPAAALAPTLWPQFFLRWTCPIESQGGDLESQWHAMNKKYADTMKAKDIAEWRAKDIKLKLESMKQDLQREKRINSTALAAARSAQRENAAIKKAIESIGCTIKFSTSENEDRTEVLSCSLGRGTDGRAQQDENGDFSVAIEDSLVSDAPADHFCESLCPFRTREGCRWPDAPCAQLGSQFVGLKANFDAFDRLSIHDCYFGPE

SEQ ID NO: 673 - protein, 268 aa, Zea mays
MGQDVVAHVYDVATAGSDTTVLHINRFFKDAIGLGGIFHTAIQVYGDEEWSFGYCERGTGVFSCPPCKNPMYTYRESIVLGKTNCCILKVNQILRELSWEWPGHSYELLSRNCNHFCNTFCEKLEVSKLPGWVNRFANAGDAALEVAETTAGKLKQAKKEIVTACKAASTFLTGTSSSASSNAEDTGGSTSTGNSLFEGAWIRSIIGMTMKPSKSLVCVDSSDSDSSGSESESDGDRPNSDDNAERQAKGVKQERGTKKKNNGPHCHS

SEQ ID NO: 674 - protein, 711 aa, Zea mays
MGRKDTSSSSAAAGGGKKEKPMSVSAMLASMDAPAAKPKSSKSAAPSKAKAKPSKAPASSYMGDIDLPPSDDEDQEEAQLAAAKPKPARAAVDLSAGAAPSHKDAKKKDKREAVAAAAAEAARQEALRDDRDAFSVVIGARVPGSSAADGTVDDNVRDVVLENFSVSARGKELLKSASLRISHGRRYGLVGPNGMGKSTLLKLLAWRQVPVPRNIDVLLVEQEIIGDDRSALEAVVAADEELTALQAEQARLEASNDADDNERLVEVYEKLNLVGSDVARARASKILAGLGFDQAMQARSTKSFSGGWRMRISLARALFMQPTLLLLDEPTNHLDLRAVLWLEEYLCSQWKKTLIVVSHDRDFLNTVCNEIIHLHDKSLHVYRGNFNDFESGYEQKRKEMNRKFEVYEKQMKAARKSGSKAAQDKVKGQALSKAAKEAAKNKGKGKSAADDDDDQKQVAVPRKWRDYSVEFHFPEPTELTPPLLQLIEVGFSYPGRPDFKLSGVDVGIDMGTRVAIVGPNGAGKSTLLNLLAGDLIPTEGEARRSQKLRIGRYSQHFVDLLTMEENAVQYLLRLHPDQEGMSKAEAVRAKLGKFGLPGHNHLTPIVKLSGGQKARVVFTSISMSQPHILLLDEPTNHLDMQSIDALADALDEFTGGVVLVSHDSRLISRVCEDEQRSEIWVVEDGTVNRYDGTFEDYKDELMEEIKKEVEE

SEQ ID NO: 675 - protein, 184 aa, Zea mays
MGALCLLYPSTPPRCPCGARADATAAFAPSPFLSSCAATGAQTRLQLCGRSQRRGGVARVGGGGGGGKGESGKNGAAAFFDEDGVVDDMDGYLNYLSLEYDSVWDTKPAWCQPWTILLTGTGAVACSWVLIQSVVITAGVSFVISAWWYIFLYSYPKAYTEMIAERRRNVASGAEDTYGMEKIQ

SEQ ID NO: 676 - protein, 249 aa, Zea mays
MEVVGGVSLRPSPAPARIRTTLPPVDVGGRFLLRRVAGRQPARRALVVEARGGRGWSERQMQQQRRAPLLPKIEDDGNPRFVIFIRTANVYFWYPLNIITGGTTAKIMLAAKDNFLGKYIYKDTLARNLAAVIYKDEDVIIDTAKEQYRVLKTENQFRYGYKVVEKGNIRSALTTSNVIELPKKDELKTVVDKVKDFFGDVTAGAKESFAQITGSAVSKEEEEAESKEKFRSKRRKKQRKSKEGLKTEK

SEQ ID NO: 677 - protein, 359 aa, Zea mays
MSCSHLSTAWSSSALASSASTTRRRSPPRSGLLVRCSLRELRTRIDSVRNTQKITEAMKLVAAAKVRRAQEAVVSSRPFSEALVEVLYNMNQEIQTEDIDLPLTRTRPVKKVALVVLTGERGLCGSFNNNVLKKAETRIDELKQLGLQYTVVSVGKKGNAYFQRRPYIPLERDLEVSSVPTVKDSQAICDLVYSLFVSEEVDKVELLYSKFVSLVRSDPIIQTLLPMSPKGEICDVNGVCVDATEDELFRLTTKEGKLTVEREKVKIETQPFSPVVQFEQDPVQILDALLPLYLNSQILRALQESLASELAARMSAMSSATDNAIELRKNLSIAYNRQRQAKITGEILEIVAGADALAG

SEQ ID NO: 678 - protein, 80 aa, Unknown
  Sequence found in Organisms: Zea mays, Triticum aestivum
MSCSSGKCDCGSSCSCGSSCNCMSPNVETAAASSIKTTVLAAPTTKASAGGFEAATEGGGCDCNTCNCGTSCGCSCCSCN

SEQ ID NO: 679 - protein, 117 aa, Zea mays
MAEAVVLPRNCLATTLQPHLADSPSPVASVASARQVMSSALGWTPWSSGAKRGSPVGSIAAAQELREDTCHLKSKLVPEISSARQVVPLIHFWLPNNVLYNHLPCIGLILMGPDRSP

SEQ ID NO: 680 - protein, 114 aa, Zea mays
VRKLAHTTAWNCSRRPIEPSDERDWETMPSPRHHGFPPVWPTGHWRMALALHRSTGIMPRARGMMRVWLGEWSSAAGPHAAVTSHATAFPAARGLVSSEKQVGTWNLKCQEKNR

SEQ ID NO: 681 - protein, 248 aa, Oryza sativa
MAAAAVAAPPVRGYCPAAASTSSVARVRMPASFVSAPRRVSVRLRAAAVAEVPRGLQLRREEERGLGFFGGVFGGEEEEVVEKVGEERVEGWMRESIAEIVRHIGEAPFLVHLFNDDDGGSGRGGAGRVTVRRETASAESWPDVRRRWGPGGMRRPDGIILVEQIAAAVEEGGASAGAGAAEAARQVWGLVVQARGMECASCYVLDTCRVRSPAGLCTHFCLARAQCFGDPLELQLRNAWLNRLSGRR

SEQ ID NO: 682 - protein, 430 aa, Oryza sativa
MAAVFLRAAARATRSSALVRAILASRSPLSSSSCAASPTTAAPVPGTAPRAAAAGDGDEGCAAAAATPADVGGDEDDLRSRVFRLRLAKRSATAALERWAGEGRAASAAELRGIARDLSRAGRYKHALEVAEWMKTHHESDLSENDYGMRIDLITRVFGANAAEDFFEKLPACVQSLEAYTALLHSYARSKMTDKAERLFKRMKDANLSMNILVYNEMMTLYISVGELDKVPVIAEELKRQKFSPDLFTYNLRISASAASMDLEGFKGILDEMSKDPNSNEGWKLYQNLAVIYVDAGQLVGSGNSLVEAEAKISRREWITYDFLVILHTGLGNRDRIKDIWKSMLMTSQRMTSRNYICVLSSYLMCGQLKDAGEVIDQWQRSKAPEFDISACNRLFDAFLNAGFTDTANSFRELMLQKSCILTSRQERSS

SEQ ID NO: 683 - protein, 580 aa, Oryza sativa
MRGASGGGEGFVGASSVSNNISLPNEGTSPRGTDNAECSETSSDRSNSESIKPEECAMPSSIFDKKISIKKKLRLLSRMAILKDDGTVEVDIPTNAEAASLDLSSNDYCNEAFSGEPLASSDFQHRPPMQIVMLIVGTRGDVQPFIAIGKRLQIYGHRVRLATHANFKDFVVTAGLEFYPLGGDPKLLAGYMVKNKGFLPATPSEIPIQRKEIKEIIFSLLPACKDPDTDTGAPFNVNAIIANPAAYGHVHVAEALKVPIHIIFTMPWTPTCEFPHPFSRVKQPAGYRLSYQIVDSFVWLGIRDIINDLRKRKLKLRPVTYLSSAHAYSNDIPHAYIWSPYLVPKPKDWGPKIDVVGFCFLDLASNYKPPEPLLKWLESGEKPIYIGFGSLPIPEPDKLTRIIVEALEITGQRGIINKGWGGLGNLEEPKEFVYVIDNIPHDWLFLQCKAVVHHGGAGTTAASLKAACPTTIVPFFGDQFFWGNMVHARGLGAPPVPVEQLQLHLLVDAIKFMMDPKVKERAVELAKAIESEDGVDGAVKAFLKHLPQPRSLEKPQPAPPSSTFMQPFLLPVKRCFGIAT

SEQ ID NO: 684 - protein, 302 aa, Oryza sativa
MLRNRSRRSVGAKQGGVTAMAQPEPPPPSSQSSSSSSSSSPVFPSPRPFMALPHPPQAGFLDGAAEGPSSSMSPTSILETKQFCCSSAMPPFLSERSLRKAHVEMAAAPPEPAGVGLADVLREHHGGGKAGGGKVVFGSQLRIQVPTGRAVELVSSPIEFGVKNRDAHLAAMSPARRFLPEVVSSPSARVFAAAVVSPGEMAMSEDYTCVISRGPNPRTTHIFDDCIVESCGDVLVEKVAGGGGDGDGDAVRTNGFLNSCYACNKQLGHGNDIFIYRGDKAFCSSECRYQEMLFDEAVDNLR

SEQ ID NO: 685 - protein, 469 aa, Oryza sativa
MVLVAIGVVVAAAVVVSSLLLRWNEVRYSRKRGLPPGTMGWPLFGETTEFLKQGPSFMKARRLRYGSVFRTHILGCPTVVCMEAELNRRALASEGRGFVPGYPQSMLDILGRNNIAAVQGPLHRAMRGAMLSLVRPAMIRSSLLPKIDAFMRSHLAAWSSSSSSAVVDIQAKTKEMALLSALRQIAGVSAGPLSDALKAELYTLVLGTISLPINLPGTNYYQGFKARKKLVAMLEQMIAERRSSGQVHDDMLDALLTGVEGTREKLTDEQIIDLIITLIYSGYETMSTTSMMAVKYLSDHPKALEQLRKEHFDIRKGKAPEDAIDWNDFKSMTFTRAVIFETLRLATVVNGLLRKTTQDVEMNGYVIPKGWRIYVYTREINYDPFLYPDPMTFNPWRWLEKNMESHPHFMLFGGGSRMCPGKEVGTVEIATFLHYFVTQYRWEEEGNNTILKFPRVEAPNGLHIRVQDY

SEQ ID NO: 686 - protein, 254 aa, Oryza sativa
MAALSSASLLPPPSTFVPVLSPLRKPPPQHLAIRGSPHRRRGRRLSLAASSAASPDLEKEPSQSPSPSPQEKSPGDLSAVAESVKVLKEAAKTRKVPSPELLAALAKIKKAKLDTSTFFETLGGTQSPGRTWMLIFTAKGRLEKGQYFPVTAVQRFDAAGKRIENGVYLGPVGSLTFEGRLSWKKKILAFIFERVRIKVGPFGPLEISLGGGNDGREPSTKDPFFVWFYVDEEIAVAQGRGGGVAYWCRCKRVP

SEQ ID NO: 687 - protein, 192 aa, Oryza sativa
MVVRRLGGAGRALLSRQALSLPNLRRRASNSWAAVRDTFFSTKEVFESHRVVFTVGTSIASVLTAWAGYSLRHMQQSRIDKRLNSIEQSLKDTHKVEHEEIKKIVTSSNISTPACVATALTTSVVGYALGWRGGAWYARRGFRREQQKLMGQINSHHRWHWRPFSKLKNRLRRNRPAAKTVEAPRLTGESTI

SEQ ID NO: 688 - protein, 722 aa, Oryza sativa
MTSRVLVSSSSSSSSAAAAAFLPRIPNPCANPSHRGAPPCGAALWRHHSGRAVTTAAAAAATGDHWGAEYHGGGGGRGGKSAAGPGVQCDVDVVSWRERRVFASVAVAADVDTVWRVITDYERLAEFIPNLVHSGRIPCPHQGRVWLEQRGLQQALYWHIEARVVLDLKEVPDAVNGRELHFSMVDGDFKKFEGKWSIRSGPRSSSAILLYEVNVIPRFNFPAIFLERIIRSDLPVNLGALACRAENIYLGNQRHGTAKFSGAGSRFHNFRNATTENDAIAPSKFKETPPSGLGGVLASPPSELNSKWGVYGNVCRLDRPCVVDEIHLRRFDGLLEHEGAHRFVFASITVKAPVREVWNILTAYEKLPEFVPNLAISRIIRRDNNKVRILQEGCKGLLYMVLHARVVMDLREKLEREISFEQVEGDFYSFKGKWRLEQLGDQHTLLKYMVETKMHKDTFLSESILEEVIYEDLPSNLCAIRDYIEKAEAESGNSTSSSIVASNADTIAIDYAEGRQSEQASTSCSSSPVKQRPKVPGLQKDIEVLKSELEKFIAKYGQDGFMPKRKHLRLHGRVDIEKAITRMGGFRKIASIMNLSLSYKNRKPRGYWDNLENLQEEIRRFQKNWGMDPAYMPSRKSFERAGRYDIARALEKWGGVHEVSRLLSLELRRPRRRANSDDESKAGSSYAITNKHASKPNKPSVSPDKQKWLLKLKDLDANWIEY

SEQ ID NO: 689 - protein, 645 aa, Oryza sativa
MAQPAMEGTVQGGGGGGGGAQEPRGQYGGGGKNGGDASPRKHAAAAAAAALPRHRRSKSASSDRSLEPCKHAALHDQRCTQAAQATPSSHHQPDATTRKSHAAAAAAAEGSSIHHVLTRDRSRASASPNHRVSLENDIRQLQLNLHQERSIRIMLDRAIGRASSTLSPGHMHFPAQTKELIAEIELLEEEIANREQHVLTLYRSIFDQSASGASSGQSSGLSSPAHTKSISSRTRRHPSIISSAFCSSKKLPLQPFQIMTSVSESGRSKSMLKTKIKHESFSSETLDIHPATFPPDPRKLPYSGSSSLTRTLKDHLYQCPSKISEEMVRCMASIYCLLRTECPENPEKVRSPFLSRSSTNVILPRRGNGEDTNLSNTKCTVEVSSISADKNHMPDVSYAITHYRLLVEQLERVDLSMSETNIKLAFWINVYNSLVMHAYLAYGIPNSSLKRMALFHKAAYNIGGHAVTANSIEHALLCCRSPRIGRWFESILSTAMRKKCADEKQLVQLKFGLPDCQPLALFALCTGASSDPMLKVYTAKNISEELERAKREFLQASVVVRKSKKVFLPRLVERYAREAGLAGADELLAWARDNADARATQDAIQRLCVDAGGGRRKAAQAVEWLPYNARFRYAFPRTMVDKPLF

SEQ ID NO: 690 - protein, 301 aa, Oryza sativa
MSSGGVGGGSLGAGLLYHKFVSFALEETRLRTTLTPHPSQEKFKSIKPNDDNTVFNALSFSAPKIRLLRSLTIEKKNSYQVLDFAAFSEPEYDLPIFCANVFTTHAQSIVVLDLNPLYDTTVHKDYKDKYYRSIMPLVHKYNELLPWGGKITSESLKFFSPIVIWTIFESTEHNHHVLHSAFVDYYKVWLELMDQAIKENNKATIARNQEEQHKYLTWRAEKDPGYPLLKKLIGESRAEDLVMEFLFEGVNTLGTKSFLDYFPEYARDDGSVNKKRSMIGKSFETRPWDANGEFIGDAEAQ

SEQ ID NO: 691 - protein, 1089 aa, Oryza sativa
MPAKYLQMLGEERRPELHRQQAGCVTGILQAFDRRYPLAAHHSHNRLLPPAHALSSSPSVGEERTRYSSQIVLDKNMSKSWIDNQRAPLTVELSQGSYSSSSCSSSSSLDGNRSGQQDLSSTDRMLFPEKPFKSSPKLKSSSDSDCGVDYYLDDALAKLSAQPSYPTLGIRNLVKDSIYRDTRDFSIRTFTKEAEKDHLFNCGDPPRILNEPPNSAIQEKNKGTMDIDESLRVLAKLRNPSESVQQPRLSYDAPRFSCEGRESASKLREVPRLSLDIKESPLRNREIDVRPKPSMTDEDRRSSISKDYSPPLETQQEHNACKRLPSVVAKLMGLEDLPEHKDNTAISSQVSKSVTERSEEPTMLRPLSLSSQNEATPRQQRNLDATIKNVPNSKFPVETAPWKQQEKIVLPRKLPKGSKGAHGKEQHAASVYSEIEKRLKDLDFQQSNKDLRALKQILDSMQAKGLLQNKKREEPSMPKIYDGDHDNGDVTDVNLRLNSTSNTKQAPEGTPSFTTEEDSTTERSFKSPIVIMKPAKSADLLSDVTEDSAVGPLGGLSELPQLRTANSADKRKSSKKVTREAVEQHTKSSSRAPTPQHLASFDKRANGRNEEISRKQKSTSQLMTENSARRQQMQRENNGSLLKHKNSTSPRVQQKKPDSERRARPPIPSPDSSKNQRQSVERSHLDSVSPRSKFRRKPAQAQGEDFHQNGVSRRTRSLNQEGNDMSARSDGSISVASELDVEVTSTDRSAEVNILRSQHGTQTPSGRNPQKVKTSYDANKDLPSMDPAATITERPSPVSVLDSSFDQEEFFHTSKTTNSSNVDDEHHPSPSEESCKPSEKKSTELPTQPKNSKLANIASLLKKLQQLSVNKDEAPPVDHIAFLCETPSPDHRYVSEILLASGLLMKDLGSGLSQMQLHTSGYPINPDLFFVLEQRKSGWTSKPEGIHQSRSTTKPDDPKRAHRKLMFEAVNELLLDKFEKETTLITGVAARDPVMSSGQQLVKMICSGIECLKTERSRMCQEDSSVIPDAEILNRLEGWSPSFIRRELPGMVLEIERSIFKELVDEVVRGESADGQPAKAGRRRRRLFA

SEQ ID NO: 692 - protein, 540 aa, Oryza sativa
MGRRGAGAGAAVVVVAAFVAAAVASGDTLADLGGAAKGIDSVPEVNNLGPWAKGLLKGMPDSAAGPAEGPIAKYPLVLAEERTRRPDVLDHLRMYGGGWNITNKHYWASVSFTGIAGFVLAAGWFISFGIAVAASCFWKSRIDKENDFHADILRLVLLVVFIFTLTAGSVILFCGQSKFGQEATSTVDFVVNQSDFTIQTLRNVTDYLSLAKTISVAALYLPSDVQGQIDNLKVDLNKAADTISQKTSENYRRIRKVLHNLSVALICIAALMPVLAFLGYVLELYGQRSTVYVFVTLCWTVVATLFILLGIFLILNSAAKDTCEAMDEWAQHPQAETALSNILPCVDESTTNQTLYQSKHVVVILVGIVNRAISALSNRRPHHKHPGQFMPYLCSPYDANLTDRQCKSREVTFDNATTAWLNYTCTVPDSDLCSGPRTITPEIYSQLVLAANVSYALYHYAPLMLNLQDCKFVRNTFSSIASQYCPPIWRDLSLVSAGLALIASGLTLGLLLMLFADRPQREEVSELPSGSRITPVDCSP

SEQ ID NO: 693 - protein, 94 aa, Oryza sativa
MSSQRPGRHQRRASQSVFVLPDNFADLDDVPAGAGGAGEDGRKGAAATADAAGGQQQARPSPAARHRRAMSVAVASSRELEMIKEDMGSYKIGA

SEQ ID NO: 694 - protein, 249 aa, Oryza sativa
MGFRWAVKMQAHLNFRPITTLHCFPPPSIRPPTRRQLMLPVLSADLRRAPTPFSLLPLALAPPPPPPPTLLRRRPLLLPRAISSSTSPPPVQEMEAAYKFGPYKIDAREVFHSTPLSYAMVNLRPLLPGHVLVCPKREVKRFADLSSNEISDLWVTAKEVGIRLEQYHKASSLTFAIQDGPQAGQTVPHVHIHVIPRKKGDFEKNDEIYDAIDVKERELKEKLDLDIERKDRTMKEMAHEANEYRGLFS

SEQ ID NO: 695 - protein, 85 aa, Oryza sativa
MATAKAATAPPTHRASSPAAASPPYPSAARIADSDCFPQYTASLKCLEANQDKSKCQQQFDDYKECKKREREARLERNKGRSLFG

SEQ ID NO: 696 - protein, 166 aa, Oryza sativa
MSLVKLFDTLAFDAWNPFSIFGTTVAADAWLASDTSAFANTYIESRETAEAYVFRADLPAGVKKEEVRVEVDEGNVLVITGERSVRREEKGQRSHHIERSCATFFGRFHLPDDAVVDLVRASMDGGMLTVTVPKVVTDKQPAIAAAAPVPAVVAPAVEAKAIEASP

SEQ ID NO: 697 - protein, 205 aa, Oryza sativa
MELFVSTVASARATAPLCFASSFHHRRAAPPAVAAAATLRRSNRHLPTRGWRCASAAAPDPVPSEEPASASASTVVVTEDKPDPPPAEEKSEEVAAVSNGGSLETVAAAPVSSGAAEEDGGLDDILSKLDIQVTPTLVLYGSGALVVLWVLSSVVSAIDSIPLVPKVLELIGTGYSIWFTSRYLLFKESRDKLFAKFEDLKERII

SEQ ID NO: 698 - protein, 166 aa, Oryza sativa
MQQMRSAAAAPCSLAAMLLRRFAYTSYSSSCGPIRRHAAVALSSTTTTTTRFAAWSPPPPSGGARSRGFAAWASAPGPAGSTDSPAMQALETKIKEQLEADTVTVVDTSGDGRHVCIDVVSKVFEGKSAVNRQRMVYKAIWEELQSTVHAVDQMTTKTPSEAAANQ

SEQ ID NO: 699 - protein, 289 aa, Sorghum bicolor
MAAGSASATASLSVAAAAAAALRVRRPCARARAWAPSQRPQQGALLSLKPCASLAPHAPLWRAESDAAGGGAGAGDVMGLLLRERIVFLGNEIEDFLADAVVSQLLLLDAIDPDSDIRLFVNSPGGSLSATMAIYDVMQLVRADVSTIGMGIAGSTASIILGGGTKGKRFAMPNTRIMIHQPVGGASGQALDVEVQAKEILTNKRNVIRIVSGFTGRTLEQVEKDIDRDRYMGPLEAVDYGLIDGVIDGDSIIPLEPVPERVKPKYNYEELYKDPQKFLTPDVPDDEIY

SEQ ID NO: 700 - protein, 460 aa, Sorghum bicolor
MASATTSISSHPAALRDVVQAARIGALRQQVGVAPAAARGQRARAVRPLRAAEPARQPVAASAAAAAPAAPMADEAAAALAAVDYEALARELDGASPLEIMDRALAMFGSEIAIAFSGAEDVALIEYAKLTGRPFRVFSLDTGRLNPETYQFFDQVEKHYGIRIEYMFPDASEVQELVRTKGLFSFYDDGHQECCRVRKVRPLRRALKGLRAWITGQRKDQSPGTRASIPLVQVDPSFEGLDGGAGSLIKWNPVANVDGKDIWTFLRTMDVPVNTLHAQGYVSIGCEPCTRPVLPGQHEREGRWWWEDAKAKECGLHKGNIEKDGQAAAPRSANGNGSAGAPDIFESPAVVSLTRAGIENLLRLENRAEPWLVVLYAPWCPFCQAMEASYVELAEKLAGSGVKVAKFRADGEQKPFAQAELQLQSFPTVLLFPSRTPRPIKYPSEKRDVDSLLAFVNSLR

SEQ ID NO: 701 - protein, 202 aa, Sorghum bicolor
MESSSHKRAREVVDLTAAGPGEAAALPEADAKRLRPQDLLDMLDDDTDAAAAGDLASVMRSLEEEIASFDEAVGAAEAAPTQQQQQPELGFLLEASDDELGLPPAGASASSSEEAGGGGGGLAGAPPESAELDGGQIWGFEDEIDGGAGFGGYSPEAAAAAVAAAAAWDDDGFDAGLFAFGESDAYGPSDLAALRHETMPAV

SEQ ID NO: 702 - protein, 279 aa, Sorghum bicolor
MTMAGSCAAPPVAGLPSLRTPPPTHLRLGGFLPCSSAARSRGAAVLGCALGAKKQTPGVLNRLLCGYMRRDGHEGDVSSQGRDDTVMFGPDDDGVKIPTQVETLVKGTAMVAEPEYKAIPDLDYLQELLAIQQQGPRAIGFFGTRNMGFMHQQLIEILSYAMVITKNHIFTSGASGTNAAVIRGALRAEKPELLTVILPQSLKKQPPESQELLSKVQNLIEKPQYDHLPLIEASRLCNMDIISKVQQVICFAFHDSKLLMETCQEAKNLRKIVTLFYLD

SEQ ID NO: 703 - protein, 156 aa, Sorghum bicolor
MSSTAFSHLFPSAAVAAVSLLPRCVSFGASGGAAPGWRRRSRSMAAATAEAAAPAYTSDSLVLYFKAEGTMEERAIPKITESLQGMEGVKDLEVLIEEGIASVVLTKETTVQATGVASNLVEAIQGAGFKLQTLSLSFDDFDDITAGAGGNVQPSE

SEQ ID NO: 704 - protein, 412 aa, Sorghum bicolor
MEAFLAGLFRAPPRAVPGPRGTPLSGLPLFHGRRRRRPSSSVVCMAEPYLIAKLDSAEKAWKEMSVRLADPDIVSDPSEYQKLAQSVSELDQVVTTYRQFKDCERQLEETKALEKENEDDPDMSEMITSELEALSNQLAELEEKLKLLLLPSDPLDSRNILLEVRAGAGGDEAGIWAGDLVRMYQKYCERNNWKFKPVSCSEADMGGYKTYVMEVKGKQVYSKLKFESGVHRVQRVPLTETMGRVHTSTATVAIMPEADEVDVVIDPKDIELKTARSGGAGGQNVNKVETAVDLIHKPTGIRIFCTEERSQLQNKERAFQLLRAKLYEIKLREQQESIRNQRKMQVGTGARSEKIRTYNYKDNRVTDHRLKMNYELTGFLLGDIESAVQSCATLEQQELLEEMASSVGAVNV

SEQ ID NO: 705 - protein, 189 aa, Sorghum bicolor
MAGSARSSAAAKHAYRMFAPSRGGGAATRGPGAGAAEEFDESDVVWGSFGGGADSHSSPGAELQAAAGWARPIPASRAGAGRKKPAAVDGGGAAGSLPMNIPDWQKILGVEYRDHYRAGEWEPDADDDDHGRARGGGGAGAEMVPPHELAWRSRAASMSVHEGIGRTLKGRDLSRVRDAVWKKTGFEAD

SEQ ID NO: 706 - protein, 538 aa, Sorghum bicolor
MEAGAWAVVAAAVALYMAWFWRMSRGLSGPRVWPLAGSLPGLVQHAEDMHEWIAANLRRAGGTYQTCIFAVPGVARRGGLVTVTCDPRNLEHVLKARFDNYPKGPFWHGVFRDLLGDGIFNSDGETWVAQRKTAALEFTTRTLRTAMSRWVSRSIHARLLPILGDADADVVVVDLQDLLLRLTFDNICGLAFGKDPETLARGLPENAFASAFDRATEATLNRFIFPECVWRFKKWLGLGMETTLARSVQHVDRYLSAVIGARKLELTGGKQNDASATPHDDLLSRFMRKGTYSDESLQHVALNFILAGRDTSSVALSWFFWLVSTHPDVERKVVRELCAVLAASRGVEDPALWLAAPFDFDELDRLVYLKAALSETLRLYPSVPEDSKHVVADDVLPDGTFVPAGSSVTYSIYSAGRMKTVWGEDCLEFRPERWLSADGTRFEPHDSYRFVAFNAGPRICLGKDLAYLQMKNIAGSVLLRHRLAVAPGHRVEQKMSLTLFMKHGLRMEVRPRDLGAVIDELRGAGGYDAAARATAASA

SEQ ID NO: 707 - protein, 253 aa, Sorghum bicolor
MAAVTSTASLCPAAAGGLSASSSSPFTRKPSSSRRLQAASTACHCRPARVVEGLDRRDALLGIVLSAAVAPLLAPAGALADEPTTESQEGFTTYEDEANKFSIQVPQGWLVGAGEASGIKSVTAFYPEQAAADSNVSVAITGIGPDFTSLKSFGDVDSFAEGLVNGLDRSWQRPPGLAAKLIDSRAANGLYYLEYTLQNPGERRRHIVSAIGMAFNGWYNRLYTVTGQYIDDDDDSEKYRPQIEKAVRSFRLT

SEQ ID NO: 708 - protein, 125 aa, Sorghum bicolor
MARIHLVAVAMAMLLAVATAQAPGASPTPAPRAQPPATPPPGPAPAPGSPPPGSAPAPSPTQKPAPAPAPKATAPAPEIPASPPAPSSIGQTPTEAPTSPPPPSDASSVSPALFLAAGAAVAFFF

SEQ ID NO: 709 - protein, 266 aa, Sorghum bicolor
MALPLARLVLPGFPACQCQPRPPLRFPKHHVSFAAPASSRAAFAACAAASAPAAPAAQAPEAETVEQVGPRTRLVAQNIPWDSTADEMRALFQTHGSVVGVELSMYSASKNRGLAFVTMGSEEDALAALTHLNSTILNDRKIKVDFARPRKKQPKQPVVVSNPMEKYIVFVGNLTWRVRNRHLRELFASAPGVISAEVIFHTTTPRRSAGYAFVSFSSKETAEAAISAFNGKILMGRPINVMLKDENGKKNESSVPKEEAEVESSN

SEQ ID NO: 710 - protein, 753 aa, Sorghum bicolor
MHRVGSAGNTAGSTRPRKEKRFTYVLNDADDKKHCAGINCLAYLNGSTFSTSDYLFSGSRDGTLKRWELNNGDASFSATFESHVDWVNDAIIVGEKLVSCSSDTTIKVWNCFSDGACTRTLRQHSDYVICLAAAEKNSNIVASGGLGGEVFVWDLDAALAPVAKSVDAKEDEVPNGNSGPALSTMCSANSSSNIASSNGQSHGYNPIAAKGHKDSVYALAMNDTGTLLLSGGTEKVVRVWDPRTGSKNMKLRGHTDNIRALLVDSTGRYCLSGSSDSMIRLWDLGQQRCVHSYAVHTDSVWALASTPSFGHVYSGGRDQSVYLTDLSTRESVLLCTNEYPILQLSLQDDTIWVATTDSSVYGWPAEGRTPQKVFQKGGSFLAGNLSFSRARASLEGSAPVPVYKEPSFVIPGVPAIIQHEIMNNRRHVLTKDTTGSVKLWEITRGAVIEDFGKVSFEDKKKELFEMVSIPAWFTMDARLGCLSVHLDTPQCFSAEIYAVDLNVAGAQEDLKINLAQETLRGLLVHWSKRKQKSSSHSLPNGDSSIGKDVPSKDSPRSRSEVDDATENHATHVLPSFEFSTVSPPSIITEGSSGGPWRKRITDLDGTEGDLPWWCVDCVTHNRYPKENTKCGFYLHPAEGSPAPNITQGKLSAPRILRIHKVANYVVEKLVLDKPDGGSDSAFVMGLSSAQSQLSALDSSSRLGLKSWQKTKPCIEILCNNQVLSPEMSLATVRTYIWKKPEDLILHYRVVQSR

SEQ ID NO: 711 - protein, 562 aa, Sorghum bicolor
MPQQPVSKKPPPLAPIPIQILRHEPIEPNPISSPHAISHLSFISFFFTDNKDPIDRSPAAANSPAGLEMKVDREMEILLNEIPLLHHGGLLGGSGEAGADDDADLSFLIHELAAMGVVDGDDEPPAPGAANGFGFSSMMIYPKKGGENLVSLHPFSMAGHCAHMPSLFDPVTFAAADGWDIRCSPPPSVSVSPPPATPRARCKNVRRKNGGCGAVTATSPKKCGAAAAAAAAAANKSHGESLAGLRGVMSHIARDQHGCRLLQQRLDDGKREVDLIFAGVSRHAAQLMVDPFGNYLMQKLLAVCDAGQRMALVLTLTADAFVLVRISLNVHGTRAVQKLIESLRTREEISLVIDALRPGFLELIKDPNGNHVVQKCLQAFEADDNKAIFDAAALHCLDIGMQCHGCCVLQRCIARSRGEHRDKLVAAIAGNGFKLAQDAYGNYVVQYVIDLKIPNANSSLAQQFEGKYIHLSMQKFSSNVVEKCLKVFKEVDKAKIILEILATPHLEQLLQHPYANYVIYSALQNSKGSLHSALTNAIRPHVELLRTSPYCKRIYSRALLKK

SEQ ID NO: 712 - protein, 247 aa, Sorghum bicolor
MGFPDERVQVDALERHLLTGLSSNDYNGSFEDEVLYDASFAEMEDNFVKYQIAQWTLLSLLLIIAWGVGLLMLLYIPIRAYVCRSDFRSRKLYLTPHAVIYKVNKPFAFPCFGVFKKEKHCILPSISDVVVEQDKLQSVFGVYSIRIENIGVRKPRSYDVKITGVAHPHDFRKAVLVHLLNTRKLKFSQKASSHDQQSRSLSSTASSSEAPLGDLMLEKLDEVEISVKKMQALLQGAETSKIKTTSS

SEQ ID NO: 713 - protein, 478 aa, Sorghum bicolor
MKMAHLITNCSFSTSPAVQTFSSSPNYCRSVGQLQNSKSSNLSLKSCSRRQKKSYVSCASAAVQGQTQTPLTGSQQAYEHSSSKPKKVMVIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAIKEYSDECHLVKLGTMGEYGTPNIDIEEGFITITHNGRTDTLPYPKQASSFYHLSKVHDSHNIAFTCKAWGIRATDLNQGVVYGVRTDETALHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHTKLIELGLVPHLLSDSLLDSLLNFAIQYKDRVDTAQIMPSVSWKKMGAKPRTVSV

SEQ ID NO: 714 - protein, 303 aa, Sorghum bicolor
MASTARALGALLHRASFLSSSASALRGASLLRGDRPIGLFRRHAARRRISSFQPLCMGRRSCKIAGRKDAQNLKKMKRNSKIGKEIVAAIKKGGPNPSSNTTLAAILEKARELDVPNEILERNIKRASEKGQDTYTEKVYEVYGFGGVGMVVEVLTDKITRSVADIRNVVKDCGAKLADPGSVTFRFRQARVVNIKVTDADKDQLLTIALDAGADDVLEPNFDDDDSEEEAERFYKIVTTSENYPVVLSKLQEEGLKFETDNGYELLPLNPIEVDDEAMELNKELVSKLLELDDVDAVYADQK

SEQ ID NO: 715 - protein, 163 aa, Sorghum bicolor
MLPLRSAAAAPCLVAGLLLHRFSSCSSSSVYSVRHHASYAVSSQPSTCPTTTWFPFPHSSSPRIRGFAAWASAPGQAGSADSPATKALEAKIKEQLQADTVTVVDTSGDGRHVCIDVVSKVFEGKSAVNRQRMVYKAIWEELQSTVHAVDQMTTKTPDEAGAK

SEQ ID NO: 716 - protein, 326 aa, Sorghum bicolor
MGSDFKSIPLIDISPLVEKIDDPSMANDRDLLQVVRLLDDACKEAGFFYVKGHGIDESLMREVRNVTRKFFQLPYEEKLKIKMTPQSGYRGYQRLGENITKGKPDMHEAIDCYTPIRPGKYGDLAKPMEGSNLWPEYPSNFEVLLENYINLCRDISRKIMRGIALALGGAIDAFEGETAGDPFWVLRLIGYPVDIPKEQRTDTGCGAHTDYGLLTLVNQDDDICALEVQNRSGEWIYATPIPGTFVCNIGDMLKVWTNGIYQPTLHRVVNNSPRYRVSVAFFYESNFDAAIEPVEFCREKTGGAAKYEKVVYGEHLVQKVLTNFVM

SEQ ID NO: 717 - protein, 52 aa, Sorghum bicolor
MEYWYPCNGSSGCSKEKRPPLKRGQLKLQIARTLLGSLAAPVAKNRDRGFGS

SEQ ID NO: 718 - protein, 487 aa, Sorghum bicolor
MSTMGSSAQLRRLKPLYQLVVNNILAIVAVPLAASVLLKAASLGPEEILARALALRPAHMFLLAFLPAAATVLYLMLRPRAVYLVDYACFRTNPNCRVPFATFLEHSRVWPGFDERSVRFMTRLLERSGLGEETCLPYAQHYIPPSRDLESSRAEAELVIFSAIDDLLAKTGVSPQDIDILVVNCSLFAPTPSFTDMIMHRYELRKDVRNVHLSGMGCSAGLISVELARNLLQVAPRGARALVVSTETITPNYYMGRERAMLLPNCLFRMGGAAALLSTSGAGARFRLARVVRTLRGASDSAYRCVYQEEDDRGNVGINLSKDLMNIAGDALKANITAMGPLVLPASEQLLFALSFIARKVLNNRIKPYIPDFRTAFEHFCIHAGGRAVIDELQRSLTLSDEQVEASRMTLHRFGNTSSSSLWYELAYIEAKGRMRTGDRVWMIGFGSGFKCNSAAWECIRPAANADGPWANCIHRYPVHIPDVLKH

SEQ ID NO: 719 - protein, 410 aa, Sorghum bicolor
MWQMNLGETMAPMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRANEKECAYYLRTGQCKFGSTCKFHHPQPSTMMVAVRGSVYSPGQSATSPGQHAYQGAVTSWPLSRSASFIASPRWPGHSSYAQVIVPPGLVQVPGWSPYTAQIGSSSSDDQQRTPGAAQYYTGSRQSGTAGIGDQGMFSSYQAGSVPVGLYAVQRENVFPERPDQPECQFYMKTGDCKFGAVCKFHHPRERIIPTPNCALSPLGLPLRPGEPICSFYNRYGMCKFGPNCKFDHPMGSAMYGHASSPTSEAPTSLRMLAHVPSHPEVSPDSGSGRSRRIAHSDSQQIPSVERSTEREAS

SEQ ID NO: 720 - protein, 168 aa, Sorghum bicolor
CLLLMYYKNSRGRSYRRQGQMLTIVEYFLLLYRALLPTPVWYRFFLNKEYGSLFSSLTTGLYLTFKLTSVVEKVQSFLTALRALSHKDFHYGSYATSEQVVAAGDLCAICQEKMHVPILLRCKHIFCEDCVSEWFERERTCPLCRALVKPADLRSFGDGSTSLFFQLF

SEQ ID NO: 721 - protein, 182 aa, Sorghum bicolor
MCDLVARTGRHQQRYEDGRRLVAGCIPFRYRANNDETSGDKTKKLVEVLMINSQSGPGLLFPKGGWENDETVEEAAAREAIEEAGVRGDIVHFLGLYDFKSKTHQDACCPEGMCRAAVFALHVKEELASWPEQSTRQRTWLTVPEAASRCRYQWMQEALLTGFSDWHDKWSRGGGGTNCDPA

SEQ ID NO: 722 - protein, 179 aa, Sorghum bicolor
MAGGGASSAWGPSPALVTALVALLGLGLAAYIVGPQLYWHAAEALTAAAACPACDCNCDARPLLDLPEDCAKHFKGVKSRASGEETEKSFTELLVEELKQREEEATQAQQEADVKLLEAKKLASQYQKEADKCSSGMDTCEEAREKSAVALVQQKKLTSLWEQRARELGWKPENTKAHL

SEQ ID NO: 723 - protein, 447 aa, Sorghum bicolor
MDMRRRLSLARVPAVATMVVVMLLSLSSSLCVSAARAEQQRHPVVLIPGAGGNQLEARLTEDYKPSSLVCRVWPLVRGRGGWFRLWFDPSVLVAPLTRCFAERMTLSYDADADDYRNAPGVETRVSDFGSTSTLRYLDPNLKLLTGYMNTLASTLEEKAGYEEGRDLFGAPYDFRYGLAGPGHPSQVGSAYLQRLRLLVESACAANGGRAAILVAHSLGGLFALQLLARSPAPWRAAHVQRLVTLSTPWGGSVQEMLTFASGNTLGVPFVNPSLIRDEQRSAESNLWLLPTPKVFGNTTLVVSRSHNRSYSAKNMTQFLRDIGFEQGVEPYRARIRPLVEALPEPGVPLTCLVGTGVVTVESLVYGDGGFDEDPEEVVYGDGDGTVNLASLVGPIKAWSDSPTQVVEVVELPKVSHSGMLNDKSALEQIIRIVDSINFNTTSYHQSS

SEQ ID NO: 724 - protein, 579 aa, Sorghum bicolor
MRQRWGSCFSGGDVRVGGRVPEEPEPEVFSFAHPLPFWPPGGGFAQGRIRIGGGELELAAATAFQKICTLSSRRRGGGSATFYRPVGVPAGFSLLGYYCQPNCRPLHGHVLVARAGERPPGATPQPPPLAKPLDYALIWEFHAGGSRANAGHGYGRSDAYFWVPVPPEGYWAIGCLVTTERQSPPLEEVACVREDLTDECEPHGSLLRLQLPGPSSFFTVQGVRPVRRGMWRKGVCVGTFCCAADGLPPREHGMACLGNVELDLSAMPTLEQAHAVIRHYGPTLFFHPKEVYLPSSVSWFFKNGAALYKRGGDTAAGEEIDGEGSNLPGGGCNDGEYWIDVPSGERGRAVCRGNIDSAELYAHVKPAMGGTCTDVAMWVFCPFNGPARLKLGPISLPLGKTGRHVGDWEHSTFRVSNLTGELMGVYYSQHSGGHWVDASALEYIDGNRPVVYSSRNGHASYAYPGVYLQGSAALGIGIRNDAARSSLFVDSSARYRIVAAEYLGEGAVVEPQWLQFMREWGPTVVYKSRKRMEWMVGRLPPRLKCRAESMLNKMPNELSREEGPTGPKEKNNWEGDERW

SEQ ID NO: 725 - protein, 510 aa, Sorghum bicolor
MYRLLLRRFSTAAEGAAAASPSPSPSPSPSTSMSPTLRQPLPDNLYRRIMNVGRPSIPLSPVLKQWDQEGHTVKKFVIQAIVKKLVGLRRFAHALELSFWMTDRRHLHLTAGDVAYRLDLISKVHGLEKAVEYFGMVPKRLRMPQCYGSLLKCYVEAKAVDKAEEHFAKMQEMGMKSSYTYTSMMKLYLETGQLERVHAMFQDMEEKGVKPDTFSVESMLAAYIAAEDVEGVGKVLDKANPHEKLVKWHGQALAASLFMKSGMQVRAVMALLEAERRISPKSSRIAYAFLLKTYTDLGMYPEVGRIWSVYKSKVPPSNTMYLSRISALLKMNDIDGAEATLKEWETVSLRYHDFRLINLMVDAYCREGLVEKAVALVDDAIKKGRTPYANTWYKLAGGFFKTGEVSKAVDMTRKALESATPPWKPDLTNVLMSLEHFMNQKDVEAAEEIASMLQKLGPLTKEVYHCLLKTYVRAGKPVSDLLERMKKDGLEADEETERMRVDLHPLSITK

SEQ ID NO: 726 - protein, 442 aa, Sorghum bicolor
MGKSKRNKGGRSGGGADDQLDGGSDADSVTSMSTALSDLQLAQATEHVSSQEFVLDNYIDALYEKRGSTREKALGALIDAFESFVLLGLVENKYVTLLSQFTNSIKKGSTKEVCLACRCIGLLSITLGAGSSSHEIMDESHQQLLRVLQTWPDAPKMISALDCLAVVTFVGATDLSETQLSLKAIWDVIHPKSGSNVGIVRKPKPPLLAAAVSAWAFLLTTVGSSRRNTDSWKEPITFLCSLLEAEDRAVRIAAGEALALCFELKLLDVSSSYEADVDIDTRETSGSKHQLFLNMQALKAKISGLVYSLSMEAGGRGADKKNLNDQRDLFQRISDFIKSGECPEESLRISGKNGILRVTTWRESIQLNYMRRFLGRGFLKHSQDNDLLHEIFDIKIDRTENMSTTKKKMFRSEEEKGRALKLNKERRLAQERKQNILNEQYG

SEQ ID NO: 727 - protein, 591 aa, Sorghum bicolor
MLAATPSRSTDPMAATAALSFHPAAFSVSAHPREAAAATTKQPLRHCSPLRSVVPRRTCLLRARSSNGRPQISASFGNSNEVLDGMPTGDGPPAPGQGGSTVSITVVGASGDLAKKKIFPALFALFYEDCLPEHFTVFGYARSKMSDEELRNMISTTLTCRIDKRENCGDKMEQFLKRCFYQSGQYNSEEGFAELDRKLKEKEAGRLPNRLFYLSIPPNIFVDVVRSASRTASSSSGWTRFIVEKPFGRDSESSGELTRSLKKYLVEEQIFRIDHYLGKELVENLSVLRFSNLVFEPLWSRNYIRNVQFIFSEDFGTEGRGGYFDNYGIIRDIMQNHLVQILALFAMETPVSLDAEDIRNEKVKVLRSMRQLKLEDVVVGQYKGHSKGGRSYPGYADDPTVPKGSVTPTFAAAALFIDNARWDGVPFLMKAGKALHTRRAEIRVQFRRVPGNLYRRNIGTDLDKATNELVLRVQPDEAIYLKINNKVPGLGMRLDRSNLNLLYSERYRREIPDAYERLLLDAMEGERRLFIRSDELDAAWAIFTPVLRELEDRKVAPELYPYGSRGPVGAHYLAANYNVRWGDITSDDAAF

SEQ ID NO: 728 - protein, 93 aa, Unknown
  Sequence found in Organisms: Sorghum bicolor, Triticum aestivum
MDKSMLGDLDGLPEEDKMRMAGMIDQLQIRDSLRMYNSLVERCFTDCVDTFRRKTLDKQEESCVRRCAEKFLKHSMRVGMRFAELNQGVATPD

SEQ ID NO: 729 - protein, 404 aa, Sorghum bicolor
MERPKKTAVAGLPDDLLVEILSCLPINEIHRCKCVSKGWRDLIADPLHHKKLPQTLHGFFPSYVGELGSFINLSGGSASTFDPSFAFLKKLPGIHNIWLRASCNGLLLFRHSTRLRELGYIVFNPATEQWAAVPSEHTLADRPIRFSHTCFVFNPAVSPYFHLVIISARGVSLATVQFYSSETGVWRHTQIDWAEEVELRRQWNKRDPQIRGCTPCAAIFNSMLYLILTDNQIFEVDVEGNTKRIIRAPSSVGGRVHGCVPLFIGQSQGRLYCINEEHWADGIPSELSSRVFRRDSDDNSNLLSIWVLEDYDTQKWALKHSVSCSRLFGRTGFLGYNVVAIHPDNNNFMFIVYRKHQLISYGLNSKEVRTVGTFQESLQLPPYVPCFSDFLSVARHEEILGVGV

SEQ ID NO: 730 - protein, 251 aa, Sorghum bicolor
MPCCPPSLLGVGPRLRSFLRDYDALQSLALALIYLQIVCALIGSLGALFNGVLVINLVIGLFAVVAIESSSQRLGRTYAVLLFFAVVIDVAWFILFSHAIWTITPDEKYGRLFVFSLRLALWMQIIGFSVRFLSSFLWIQMYRLGASSSTPTYFETNHEARNSFLSPRSDSVRRSSMADDILGGSIYDPSYYSSLFEDVRNNSCNHQGDKQSGSNDSGSTSAGQSPRLKSFACRSLLANDVESGLRRPLNS

SEQ ID NO: 731 - protein, 337 aa, Sorghum bicolor
MAGTWVKMEQKGGGPGARSSHSITLVGHTAYSFGGEFTPRVPVDNTMYAFDLGTQTWSALDDATGDVPPPRVGVTMAAVGGTVYTFGGRDLEHKELNELYAFDTATRAWTLLSSSGGGPPHRSYHSMVADAEGGRVYVFGGCGDAGRLNDLWAYDVASGRWEELPSPGEACRPRGGPGLAVAGGKVWVVYGFSGEEMDDVHCYDPATRAWAVVETTGDRPSPRSVFCGAGIGRHVVVFGGEVDPSDLGHLGAGKFSAEAFALDTETRAWTRLVDDDDKAEAEAEQQQHPGPRGWCAFAAGEKDGRQGLLVYGGNSPTNDRLDDIYFFAPVLEAAAAS

SEQ ID NO: 732 - protein, 248 aa, Sorghum bicolor
MSLSVAGARTSTSPLPSSFAASSSRPRLLALPLHRRSHGSLASPPAAGRRRLRRLLRVRMARTESTGVGIGFRAPEFELPEPLTGKLWTLDDFEGNSALLVMFICNHCPFVKHLKKDIAKLTSFYVEKGLGAVAISSNSVRTHPQDGPEHMAEEAKLFKYPFPYLYDESQEVAKAFGAVCTPEFYLFKKDGRRPFELFYHGQFDDSRPSNNVPVTGRDLSRAIDCALSGQELPFVQKPSVGCNIKWHP

SEQ ID NO: 733 - protein, 170 aa, Sorghum bicolor
MSGNGVVKKVSDAATKAGKAIDWDGLAKMLVSDEARKEFANLRRTFEDVNHQLQTKFSQEPQPIDWEYYKKGIGSKVVDMYKEAYESIEIPKYVDTVTPQYKPKLHALLVEMKEAEKASLKESEKIEKEIAEMKEMKKKISTMTADEYFAKHPELKQKFDDEIRNDYWGY

SEQ ID NO: 734 - protein, 346 aa, Sorghum bicolor
MFPMASSSLSPPPLSLILLRPLPCRPVLLSRQRKPFPTVRVEARPEQRLQRRPVTGRWRRGGGFACFSYNANNKTPPPSDKSSDKWAILRRWDVPWEWQTVVLSMVGCGVSFVLTGLVEQSALQYLGFKAVEATIDEKAEILFFGQLSVTVVVLGVIFSITNTFRPFPDDMFRYDIKEPFKLQNGWLLWAGVGLFGAIISIALAGAAMTYLNGETPERETDSLVLLLPLIGSSTTSTAFLVGITGVLAPLLEETLFRGFLMVSLTKWFPTPFCVLVSAAVFALAHLTPGQFPQLFILGVALGFSYAQTRNLLTPITIHAFWNSGVILLLTFLQLQGYDLKELLGAS

SEQ ID NO: 735 - protein, 138 aa, Sorghum bicolor
MVVRIRLARFGCRNRPFYRVMAADSRSPRDGKHLEVLGYYNPLPGKDGGKRMGLKFDRVKYWLSVGAQPSDPVQSILFRAGLLPPPPMLAMARKGGPRDRRPIHPMTGRPLDLEGVTIVDDSNAPEGDAEEPTDEVAS

SEQ ID NO: 736 - protein, 836 aa, Sorghum bicolor
MFFSRLDDSPMFRKQMQSLEEGADLLRERCLKFHKGCRKYTEGLGEAYDGDIAFASSLETFGGGHNDPISVAFGGPVMTKFTIALREIGTYKEVLRSQVEHMLNDKLLQFVEIDLHEMKDARKRFDKATLLYDQAREKYLSLKKGTRTDVAAAVEDELHSARSSFEQARFNLVTALSNIEAKKRFEFLEAVSGTMDAHLRYFKQGYELLHQMEPYINQVLAFAQQSRERSNYEQAALLERMQDFKRQIDRESRWSPNGMNDSPNGDGIQTIGRSSHKMIEEAMQSASKGKVQTIRQGYLSKRSSNLRGDWKRRFFVLDSRGMLYYYRKQNSRPSSGYNQRTSIPSEHGSGLLSRWFSSHYHGGVHDEKSVARHTVNLLTSTIKVDADQSDLRFCFRIISPTKNYTLQAESAMDQMDWIEKITGVIASLLSSQSPERRLLLSPKGSSHHRTASSSSSFSSSTELEHSINEDCMLEKNSGSGYFEHSARVAQHHRTSMMKPDKPIDLLRKVAGNNSCADCGASEPDWASLNLGVLLCIECSGVHRNMGVHISKVRSLTLDVRVWEPSVINLFQSIGNTFANTVWEEMLPSSTCVDHGDISRPDGLENMSHRFAPSKPKQSDSIAVKEKFIHAKYAEKDFVRKHNVDEIQLAEQMWDNVSSNNKKGVYSLIVGSNADVNFSYGHTSFNSALTLGKALLLQEQSTSPSNGSSRCFDLNPLEKGSTGDSVSPASTSARIDGLDDYVEGLSLLHLACRVADLGMVELLLQYGANVNSTDSRGRTPLHHSIMKGRHVYAKLLLSRGADSQAVDRDGRTALKYAIDSGTIEDEEILVLLEDPSR

SEQ ID NO: 737 - protein, 857 aa, Sorghum bicolor
MASPAGGGSPAKPVLLHGDLDLWILEARLLPNMDMFSEHVRRCLAACRPPSSCGTKHPTAAARGPGGGRGGRHHHRKIITSDPYVTLSVSGAVVARTAVIPNSQDPVWEERFAVPLAHRAAELEFQVKDNDTFGAQAIGTVTVPAERVVSGDEVEDWFPVIGTNGKPYKPDTALRLRFKFQPIANNPAYRHGIAGDPDHRGIEDSYFPLRHGGQVTLYQDAHVREGDLPEIELDDGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQARGNKRKITAFIGGLDLCDGRYDTPEHRLFKDLDTVFQNDYHNPTFSAGAKGPRQPWHDLHCRIDGPAAYDVLLNFEQRWRKATKWRDRFRRVSHWKDDALIKLERISWILSPSPNVPNDHPSLWVSKEEDHEKWHVQVFRSIDSGSLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQTMEMMYKIIADELKAMDIKDMQLEDYLNFFCLGNREEPPSNGSPESEKSTDKSAAGLATKYRRFMIYVHAKGMIVDDEYVILGSANINQRSLAGSRDTEIAMGAYQPHYAWSTKNGHPHGQVYGYRTSLWAEHLGTVDDRFKDPSSLECVRRVNQIAVENWQRFTAEEMSTLQGHLLKYPVKVEADGKISSLPDQECFPDVGGKILGASTSLPDSLTM

SEQ ID NO: 738 - protein, 670 aa, Sorghum bicolor
MLAGSCVFVALALLLPSVPPAAATQEFYCDDSTYADNSTFQANLNLLGAALPANASASPAGYATGAVGAAPDQVNGMVLCRGDTNASSCSSCVAAAFRDAQQRCPLTKGATVYKDDCTLRFAGIRFLDFLREDQWLVSELVPSIDPGPGSVNAADAWFDAAVTGIFTALVDRAAAASNATRKYFATGEMDFDPKLYGLAQCAPDLTLAQCQSCLGDLESRVTTQFLSGRPLGNNAFHVWCSLRYSVSPFYAGRAMLQLPAPPAPPPTATPTPHSSGRKMNAAGISAGITCVVVLMLILSVFFFIRFRLRIKVKKNDHSLKKIGRAQCTIFDLLTLEEATEHFSEKNKLGEGGFGIVYKGILSDGQEIAVKKLLGRAGSGLDQLQNEVQLLAELQHKNLVGLQGFCSHHNDTLLVYEYIKNGSLDSILFDDSKGNALDWEQQYNIIFGIAKGILYLHEDSTMRIIHRDLKANNILLDDNMEPKIADFGLARLIGEGHTHTQTARVVGTFGYMAPEYVLHGRVSPKIDIFSFGVLVLEIVTRRSNCNSDDHSTVNLLSDVWDHWKKGTMSQMLHGSLNEFARSQALRCIHIGLLCVQPEPDDRPDISAVVFMLTRDSIELKPPAQPAFFFGSESPSASRSDGQSSYVYARSGFMLEQGVSVNGITLSELYPR

SEQ ID NO: 739 - protein, 218 aa, Sorghum bicolor
MAQAMASMTGLSQGVLPSRRAANRARAAAVVVRASAEGEAAAAQPGRRAVLGLVATGVVGGALSQAVHAATVNSIKIGAPPPPSGGLPGTENSDQARDFGLPLKDRFYLQPLPPAEAAARVKTSAQDIINLKPLIDKKAWPYVQNDLRLRASYLRYDLKTVIASKPKEEKKSLKELTGKLFSTIDDLDHAAKIKSTPEAEKYFAATKDVLGDVLAKIG

SEQ ID NO: 740 - protein, 336 aa, Sorghum bicolor
MSAASALRPTELFPLPSGLSLSPRLKLLLTFFRADLTVRPLDEWQLKSALLAFLRDPPLSLPLLPDSDLSVSRLPDLQKRRREEPVASGVLHVRDLTFLRPRKGDGEAEEMTREQEEEKYFEWRNTLVQKLEGIELNLEGVKFRMTVEIPSSDDFRTMKKSWEDFYSSELLNSRNPVRKIAKRPDTIIVRGVPSRWFAETRVSSKPSTLVTHTIFSALGKIGNLKIANDDEIEAKGDGASKELISGLNCKVWVQFENYDDFHDAMKALCGRSLEKEGSRLKVDYDVTWDREGFFRIAQYEPAGNNSGERDSSASVHGRRKHHTSRIESDYRKRFRD

SEQ ID NO: 741 - protein, 163 aa, Sorghum bicolor
MGGGTAAEPPAWMAAAARRWLENAGATVEDAPGRAFNALPLSGVRVSLAERGRALCSLRVPPQLTDAEGNWHTGAIAAAADDVCAAAIMSVEGIIKVSVHYDISYFTPAKLHEEVEMDGRVVEQKGRMTAVTVEIRKKESGELVAIGRQWMTASRPKGSQSKI

SEQ ID NO: 742 - protein, 444 aa, Sorghum bicolor
MAAAKSIDRLPARLVVPAEPTPAGPLHLSWLDRYPTQMALIESLHVFKAAPATATGGIDGGAAASPARTIERALARALVHYYPLAGRLVLSESGAQQAVDCSNAGVWFTEAEAACTLEDVDYLEAPLMIPKDDLLPPTPAAGDEEDERALVLLVQVTSFACGGFVVGFRFSHAVADGPGAAQFMNAVGELARGAENALSVVPQWGRDAIPDPAAALVGRLPTPDADSKRLEYLAIDISADYINHFKAQYSAAHAGAAWCSAFEVLIAKAWQSRTRAAGFDPDSPVHLCFAMNARPMLHASLPRGGAGFYGNCYYIMRVSAPAGKVAGSSVTEVVKIIKDGKRRMPAEFARWAAGEVGAAGVDPYQITSDYRTLLVSDWTRLGFAEVDYGWGPPAHVVPLTNLDYIATCILVKPWAHKPGARLITQCVTPDRVAAFHEGMLDTSC

SEQ ID NO: 743 - protein, 503 aa, Sorghum bicolor
MWKQFIGKLSWKAMKSSSGGGGTGSPPAKLPPHLPSPRENGASPRENGATPKPNVSPPSPAAGAGAGAGAEVRSREDAFVQKVNICCAVYDFSDRGKDSPEKERKRQMLMSLVDCIGAAEEPLTETMIAACVRMFAANLFRVFPPKVRSGTSTSETEEDEPFFDPSWYHLQVVYEFLLRFVTSPLVDAKVARKYVDSPFVSKLLDLFDSDDPRERDCLKTILHRIYGKFMGNRPFIRKAVSNIFYRFVFETDHHNGIAELLEVFGSVISGFAKPLKEEHKLFLWKALIPLHKPKSVGVYLPQLTYCITQFIEKEPKLAGTVIRGLLKYWPVTNSQKEIMFLGELEEVLELTDMAEFQKCMTPLFRKIASCLNSSHFQVAERALFLWNNEHLFDMISQNRQVILPIIYPALERNTRWHWNQSVLNVTMNVRKMFREMDERLLLACQNNFQEEEEKRAATEERRRLMWEQLERSAARGHHQPVIAADASFPAPPSSARLVAPTVT

SEQ ID NO: 744 - protein, 430 aa, Sorghum bicolor
MAAAAAEAPSASASSAENRLLQSLADRGWRFHDPTDEAIQALLLASPTPSSEAVESELVDMDLRLFGVKYLPDRATAAATSKRLSYLHGPVVLQVVSVRDIYRSIIDASFKNPQQRRLLRFGLTDGICEAVAIEFSPIPFITEEIAPGAKIRLENKIPINNGILCLSAKNVSVIGGTVQSLYEEWQMNQKYSGLSRPSLRLSQSDDGVGPPPFEKLDIEARPCRATKVQAYPARKLADTHDHAPVNSGGKPMNEDSNDVNKDTIESKAESKEITQDSRQKEVSEAVPVQNQAAAQKLLQKMSQAMPEDRRGRGHRFKGKGKEEDAQVFTLDEWEKRKAIGLKPAAESYVHDTSRDEELARQLQEQLDLEDMHGGADVFSGGAESSDAERLRMSMFSFSGPDEAGGGRRDFRGRGRGRGRGRGRGRGRGRF

SEQ ID NO: 745 - protein, 454 aa, Sorghum bicolor
MAKALLSSSLLPALPRAAGGSASRPLLLPPLRLRRGGRRAASACAVRAGLHGLDSVGGPHLQATLERAEAALYTLADAAVAAADAGGDAGEAAAAAVQKNGGWFGFISEALEVVLKVLKDGLSAVHVPYAYGFAIILLTIIVKAVTLPLTKQQVESTLAMQNLQPQLKAIQQRYAGNQERIQLETARLYKQAGVNPLAGCFPTLATIPVWIGLYQALSNVANEGLFTEGFFWIPSLGGPTTIAARQSGSGISWLFPFVDGHPPLGWHDTICYLVLPVLLVASQYVSMEIMKPPQSDDPSQKNTLLILKFLPFMIGWFSLSVPSGLSIYWLTNNVLSTAQQVWLRKMGGAKPVVSKGGSGIITAGRAKRSNAEPAGERFRQLKEEENRRKLSKALAAGDSDASSSTYDMEDEELDDETTEEGGPVEEASSTGSDKKLPSYSGKKGKRSKRKRMVQ

SEQ ID NO: 746 - protein, 497 aa, Sorghum bicolor
MRLTRRQGRAGAAMEKEEPAAAELEIPGECQYAGDPVVVRPSQPTPRHTLHLSNLDDQRFLRFSIKYLYVFASHAAVSADALRAALGRVLVDYYPLAGRLRPSDEEEGKLVVDCNAEGALFAEGRLPGLTAADFLRGRGGATPHKSWRKLHYRVEAQSFVAVPPLVVQVTWLGCGGMVLCTAINHCLCDGIGTAQFLHAWARAVRGGQDAPGAGADDDDDVALPFHDRRALRPRCPPRVAFTHPEYSSSRGISGAVVGNGNGNGNANEAAPSLLARLLGQPLAPVSLTFTAAHLLRLKRQCAPSLKCTSFEALAAHVWRAWVRALDPPGALRVKLLFSVNVRRRLKPELPRGYYGNGFVLGCAESTAAQLVTAAPSSAAAARYGVRLVQDAKECVDDDYVRSMVDLLEERRGARPDLAASLVISAWTRLGLEDLDFGAGKAAHMGPLTSEIYCVFLPVMGDPQGVTVLLSVPQAAADKFQHCCLEFLKDTDVDAKLS

SEQ ID NO: 747 - protein, 447 aa, Sorghum bicolor
MAAAAPPLLLAGLALAVVAAAVWPSLAAAPAALQDPAELLRRAKEPAFADWMVGVRRRIHENPELGYEEFQTSELVRRELDALGIPYRHPFAVTGVVATVGTGGPPFVALRADMDALPLQESVEWEHKSKVPGKMHGCGHDAHVAMLLGSAKILQEHRDELKGTVVLVFQPAEEGGGGAQKMIEAGALENIDAIFGLHIADSVPIGVLASRPGPIMAGSGFFEAVISGKGGHAALPHHTIDPILAASNVIVSLQQLVSREADPLDSQVVTVGKFQGGGAFNVIPDSVTIGGTFRAFLKESFNQLKQRIEEVIVSQASVQRCSASVDFLTKDRPFFPPTINSPELHDFFVNVASEMVGSRNVRDRQPLMGAEDFSFYAEAIPSTYYYFVGMYNETRGPQAPHHSPYFTINEDALPYGAAAQAALAARYLLEHQQPAATTDKAKPHDEL

SEQ ID NO: 748 - protein, 649 aa, Sorghum bicolor
MDTTTGDLEFSGDINFLKPYCSWSTTQDTTVHKDSTPEAYSSLFISNPEASKGKQGAMSRAKGTGNPLLTLGLGRSPSSSDNSKLSSGTACITSSSLLKEIDEESSVDLGLNLGFHIGNDIAHCRQKSHASFENMLSTNSPKLDLQLSLSIGSPESVVIDANMMSPDGMVMPTTNLPPATVEEGSVPPSWGFEHSIVSSSYASEATYAPVPSPVMSSTMFTSVKSPVASTFETTNSQLRNNNTKSCQFPGCMKGARGASGRCIAHGGGKRCHKSGCQKGAEGRTIYCKAHGGGRRCQFLGCTKSAEGRTDHCIAHGGGRRCSHEGCPRAARGKSGSCIKHGGGKRCQKENCTKSAEGHSGLCIAHGGGRRCQFPDCTKGAQGSTKFCKAHGGGKRCTFFGCTRGAEGSTSFCKGHGGGKRCAFQGGGVCPKSVHGGTQFCVAHGGGKRCASHGCTKSARGRTEYCVRHGGGKRCKFEGCTKSAQGSTDFCKAHGGGKRCSWGQADTSFGAGAQQCDRFVRSKTDLCSAHSALVQDHCVHGGGTLGSAIYQFAVDVKPTEMKVALVKGDPREKINGDKILLDPGSSVPNSGVHHPVLVQSMVDPLPEGRVHGGGLLALLSRAGSRTSNGGSELYSGQGGVDVRLSGSPRN

SEQ ID NO: 749 - protein, 338 aa, Sorghum bicolor
MRICELGDGDGGLVLQQEQQEEAVQASGGGELVRLKAKRALVGAGARVLFYPTLLYNVLRNRYEADFRWWDRVDQFILLGAVPFPSDVPRLKQLGVQGVVTLNEPYETLVPTSLYQANEIEHLVIPTRDYLFAPSLEDISQAIDFIHRNALQGGTTYVHCKAGRGRSTTIVLCYLIKYRNMTPEAALDHVRSIRPRVLLAPSQWHAVRSFGSLTTGQLPVRSTNLGCFLEAIEARCMNTENDDYHVMEFDCEDSGLPLSQIMLSKPASPTGCTDAVLITEADLEGYDTYIGTRKDAVSLVVATRRPIMRRLSCLFGSLKLNSSSCEPASSRFTEVRAC

SEQ ID NO: 750 - protein, 524 aa, Sorghum bicolor
MTGGSGQAGRVNARHNGGSGISRLALCLEADTWGPQHSHSGRKKPQAPNRTKTLSFSSGAATARMAATAAALRCCFPGSSGVGSGFVKAKSSRRGWCAAAVAAPSREAEPVSSLGHRTRVDFPILHQEFDGAKLVYFDNGATSQKPYSVMRTLDEYYRSYNSNVHRGIHALSAKATQAYEDARRKVANFVNAADSREIIFTRNATEAINLVAYSWGLSNLKEGDEIVLTVAEHHSAIVPWQFVSQKTGATLKYVGLTKENAPDIEQLKRLLSNKTKIVVVHHVANVLGSMLPIEEIVTWSNRVGAKVLVDACQSVPHMPVDVQKLGADFLVASSHKMCGPTGVGFLHGKFEILSSMEPFLGGGEMIADVFQDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHGVAIRSGHHCAQILHRTLGITASARASLHFYNTKDEVDTFIDALKATIDFLTSKY

SEQ ID NO: 751 - protein, 262 aa, Sorghum bicolor
MAAASLARLSRRATASASAAAPSLRRLLSATSTAPAAASAPPPPPSAAAAAAVGADRVRWDYRGQRQLVPLGQWMPKVAVDAYVAPEAVLAGQVTVHDGASVWSGAVLRGDLNKITLGFCANVQERCVLHAAWAAPTGLPAETLVDRYVTVGAYCLLRSCTIEPECIIGQHSILMEGSLVETNSILEAGSVLPPGRRIPTGELWAGSPARFVRKLTNEEIMEIPKLATAINDLMQSHFSEFLPYSNAYLEVEKLKKSFSIPL

SEQ ID NO: 752 - protein, 282 aa, Sorghum bicolor
MAGGGQAAVSFLTRMAAAAAGLGLAASAASTSFYTVDGGERAVIFDRVRGVLPQTTSEGTHFLVPILQKPFIFDIRTRPHSFSSTSGTKDLQMVNLTLRVLSRPDVEHLPDIFNSLGLEYDEKVLPSIGNEVLKAVVAQFNADQLLTERPHVSALVRESLTQRAREFNIVLDDVAITHLAYGPEFSQAVEKKQVAQQEAERSRFLVARAEQERRAAIVRAEGESEAARLISEATTTAGNGLIELRRIEAAKEIAGVLARTPNVSYIPAGNNGQMLLGLNAAR

SEQ ID NO: 753 - protein, 252 aa, Sorghum bicolor
MEVVGGVSLRPSPAPARIRRTTLSCVDVGRRLVLRPAGAPLGQLPARRALVVEARGRSWSERQMQQQRRMPQLPKIEDDGNPRFVIFIRTANVYFWYPLNIITGGTTAKIMLAAKDNFLGKYIYKDTLARNLAAVIYKDEDEIIDTAKEQYRVLKTENEFRYGYKVVEKGNIRSALTTSNVIELPKKDELKTVVDKVKDFFGDVTAGAKESFAQITGSAVSKEEEEAENKEKFRSKRRKKQRKSKEGLKTEK

SEQ ID NO: 754 - protein, 322 aa, Sorghum bicolor
MGECEDGKEYRCWEELLPDALGLIFRNLPLQEMLTVVPRVCKSWGRVVAGPYCWQEIDIEEWSQQQSKPDQIGRMVELLIGRSGGSCRRISVSGLPCDPLFSFIGDNARALRTLEIPRSEISDSIVETVAPRLSNVTFLDISSCTKIGARALEAFGKHCKSLVGLRRVMHPIDLVDKVCQHDEAHAIACSMPKLRHLEMGYMLIATEAVLEILGQCRDLKFLDLRGCWTVDDKFLRERHPGLRVLGPRVDDCYENSYWEECSDYSDDSSIYSWEFMDDDYYAVGSDDEAIWDDGQGLENLEVRFYGGGFSESFAGFDWPPSP

SEQ ID NO: 755 - protein, 287 aa, Sorghum bicolor
MGEGGEEKSFNFLQVLLEGSIAGGTAGVVVETALYPIDTIKTRLQAARGGSRIEWKGLYSGLAGNLAGVLPASAIFVGVYEPTKRKLLETLPENLSAVAHFTAGAIGGIAASLVRVPTEVVKQRMQTGQFKSAPDAVRLIVAKEGFKGLYAGYGSFLLRDLPFDAIQFCIYEQIRIGYKAVARRELNDPENALIGAFAGAITGAITTPLDVMKTRLMVQGQGNQYTGIVNCAQTILREEGPKAFLKGIEPRVLWIGIGGSIFFGVLEKTKSMLAERRNRELRAVKDE

SEQ ID NO: 756 - protein, 235 aa, Sorghum bicolor
MAAPTAGVDTTAPPPPPSAEPAAAPAPDQKVSPPPHAPQPDAPAPAAAPAPAPVPAPAPRKRKLEEAGFHTSEYYKIRAVVADLRVRFVQVYQATDFRNTDAAREILKEINVVMDLSKKMRLKLGATSEPVKPLEKPSAGFVKDELVKPSEKLSAGPVTEEPVKPTEKPSAGPVKDEPVKPSEKPSADPVKKEPTEPVPAGENNQAPGVSQTTIPPNDAGVGAPVVKHDNSEAQK

SEQ ID NO: 757 - protein, 828 aa, Sorghum bicolor
MVDKNDGSEGLKFNTSNLIQTTEEVARAFIAAASAATAQSARPSVVYSSKDESGSPMQKLQQQFSKIMKGFTSSPDLSGTYNPEVLTTQKRQWSRYQLKSLGDRCIREPSHLFESIVIVGLPPNADIQELENIALGRNDEDGKRSRNLFSNSHHQVHAISNLEPQVLFAYPPEKPLPLKYKDTLSFCLPGGVQVHAVERTPSFSELNEILLGQEQLKESNQSFVFRLQVADNSALYGCCVLVEEIVQRPSKLVSMLMNDKPIFPRRSRYVVTTPRCYCILSRLPFFELHFGVLQSILMEERLEWLTDGVSMLTSLSLEESCENDICEGTEVTAQKQYLDSNTIDVDKSSESSMGVSSKELSDTDSSFGCRENQLDFVSKEQQQNSSCDKEQSDRKREIITCDASEVSDHFVPEDTSSDQSGAKHHELDSASGIQDESGAKNCDDSPKGNVDDEELDLFITDTILPLMRSRLCEDCESSPSSQGSPSRNFDTQESDSEEPSSIGDGDLVRHNNILQWAKAKKYGSLQVVCQYYQLQCPARGSSLTFHPLEHLHPLSFHRPGETVLHIAGSTIELRSRDTSLEVAEMRNSLFAEEESTALSTWAVASICGCLRLEHVMTLFAAALLEKQIVIVCSNLGMLSASVLSILPLIRPYRWHSLLTTVLPNDMMDFLDAPVPYIVGVQNKTSDVLNRLPNAVVIDANRNQIKSSSVPQLPQHRELLSALRPYHSILVGESYLARKRPVYECTDAQVEAAKGFLAVLRDYLDTLCSNLRSHTITNVQSNNDKVSLLLKESFIGSFPIRDRPFMKLFVDTQLFSVQTDLVLSFYQKD

SEQ ID NO: 758 - protein, 330 aa, Sorghum bicolor
MAAALAASSAEAALLLLVLLVRLAAVALRCGEGLSLALYDESCPEAEAAVTAAVRQAMANDRTVAAGLLRMHFHDCFVRGCDGSVLLDSTGTVTAEKDGPPNVSLHAFYVIDNAKRAVEAQCPGVVSCADILALAARDAVALSGGPSWVVALGRRDGRVSRANETTTLPGPTASFEQLKQAFHGRGLSTKDLVVLSGAHTLGFAHCSSFQNRIRLQDQGTDADDPSLSPSFAAALRRACPANNTVRAAGSGLDATSAAFDNTYYRMLQAGQGLLSSDEALLTHPKTRAFVALYAASQEAFFRAFAKSMLRMAALNGGDEVRANCRRVNSS

SEQ ID NO: 759 - protein, 262 aa, Sorghum bicolor
MRRYSPPYRSPPRRAYGGRGRSPPPPRRGYGGRNKEGSGSLLVRNIPLSVRAEELRVPFERFGPVRDVYIPKDYYSGEPRGFAFVEFVDPYDASEAQYHMNRQVFFGREIAVVLAAESRKRPEEMRSRARVRGYSGHEGRRSSYYGRSRSRSRSPRYRGRPRSRSYSPAPRRRDDYSASPRRQEAHRTSSPRRPTKEHDEDKKRRSYSPASRDDADNGYEKRSPPADSNGSPPHRRSPKEEYSGSPPGSRSRSADESPVRSD

SEQ ID NO: 760 - protein, 201 aa, Sorghum bicolor
MKKYQIDIPTEAVDEDFLTRAGTLQRIDELILYRCTEMREVCSKLVPGISGMIKDNFRYVEVMAKILTPWLVGEEWDSSKWSTAGEPWFTPDEMQKIVAKDAAADDAREKVKGDHKVAAMIEANLDDYRCLTKSHGIVLQKVRSCYEAKVKRGQKRSHTEMAEEEVVEAVAECRKGQDGADSTEEKWSPSNGSSKTEISHF

SEQ ID NO: 761 - protein, 391 aa, Sorghum bicolor
MLRACTRVGGAGAGGRRERLMASLIRFLSSSPSYSTTHLPRQHQPQPPPAAAAAARPSRFRLLFARAAARRDPEPTPVPAVEERRSLAVRTGELFLGLAALLLRGAGAGAGAAVEEVEARDGVVWEQRPEDVDAERARRELTSPGFSFSAAGLLFPYHLGAAQCLMDRGYITEKTPLAGSSAGAIICAVIASGNTMQDALQVTKVLADNCRSKGTAFRLGAVLKDVLDEFLPDDLHIRCNGRIRVAITRLSWRPRGLLVDQFDSKEDVINAVITSSFIPGYLAPRPATFFRNRLCIDGGLTLFMPPTSAAETVRICAFPASRLGLQDIGISPDCNPENRASPRQLFNWALEPAEDETLDKLYELGYLDAAVWAEQNSAELITKNGQSLVAD

SEQ ID NO: 762 - protein, 425 aa, Sorghum bicolor
MSALLDLLMGILRQQTIGGAALELAAIAAPLWLAALVGLLIGWAWRPRWAGVVVGVGGGGGDNNAQHQAAAHLLPTPPPPPPARATATAVVSRNEAPAVVPRTVVAPAAAAPEDEQLAVNTGDLMHLWRLVEEKDGGPSWIHMMDRTLPTMRYQAWRRDPPNGPPQYRSSTIFEDASPEVVRDFFWDDEFRIKNSWDDMLLQHETLEECTRTGTLVVRWVRKFPFFCSDREYIIGRRIWASGKTFYCVTKGVPRPSVPRHNKPRRVDLYYSSWCIRPVESRKGDGSMTACEVLLFHHEDMGIPWEIAKLGVRQGMWGCVKRIEPGLRAYQVARTAGEPISKCAAMAHVTTRFNADELITEENTEGSSSNNTEVEKPKHWTNNIPKVLMIGGAVALACTFDGGLLTKAVIFGTARRFAGPGGPGRR

SEQ ID NO: 763 - protein, 196 aa, Sorghum bicolor
MDLSAVQAALSDKSYSALAPLCDELLLQVAAKGAITDEWPYSVHLLAHLYINDLNSARFFWKSLPQEVKDTRPELAAVWRIGQCLWNRDYAGVNTAAQGFEWGPDLADFITAFLESYRQRIFKLLTSAYSTISVADVAHFMGMSEEDVTNYAVQNSWSLDAATGMLTVKKPKAQTNQKLDSSKLQRLTECVFHLEH

SEQ ID NO: 764 - protein, 216 aa, Sorghum bicolor
MATAARALVAARPARPLLPSRRLPSSSSIRPPRQRGGGVGSVRCMARRPDSSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 765 - protein, 214 aa, Sorghum bicolor
MVVRRLGGAGRALLTLPNIRRRASNSWAAVCDTFFSTKQVFENHRIVFTVGTSIASVLTAWAGYSLRQVHQSRIERRLESIESSLKGNHKVEHEEIKKIVTSSNISAPACVATAMTTMVVGYTLGWRGGAWYARRAFRREQQKLMMGHMKSHNRWHWRPFNRLRNRLRNSRLASKNKSTNAHPSVGQSSEAPSTSSSGASADVSSAAQSAVGSA

SEQ ID NO: 766 - protein, 313 aa, Sorghum bicolor
MGGGVMRTAAKVGIAGGAAAAAKSGRFRHAAPAFATAAAAAGSEAAPLVSASGGEAVPPATAQWAASWELDDWEFADWRDDSAAAAVVVAEREATAAAAKPRLVFAPPSREEAEEATSELRDAIERAYFNETPVEVVKEQDKEFNKQATDAIIPSMPGHVVQAFTLLKSSPEAQSVVASLASDRNVWEAVLKNEKVMEFYKNHQTTLVETFPEEAATVESPGNFEDATSENASNTELPTGSPFSDFVDNAKKRVMDVIYNITDFFKDLFDSAGAQDGAGPSAEKGPSAAEMALGGSFMALAIGVILVVLLKRA

SEQ ID NO: 767 - protein, 1008 aa, Sorghum bicolor
MWAPSRGSSSGSGRRTWRRRIADYLADDQTDVSDNESFITAHSDEYVAASTSMSAAGGGGMLPAFLADQSDLVEVMLELDEESMVVRSVTPTTAALYGTPTASSLPGPGAAGPQAHTPDGPRSLSRCSSTSSRIRRKFAWLRSPSPSPSLRRPPPAAGAAAATAALSDQQVVREAALAARERRRVQARLLNRSRSGARRALKGLRFISRTTTDADGGAALWRAVEERFNALATDGLLARDDFGDCIGMVDSKEFAVGIFDALARRRRQNLERISKDELYEFWLQISDQSFDARLQIFFDMVDTNVDGRITREEVQELIVLSASANKLSKLKEQAEEYASLIMEELDPENLGYIELWQLEALLLQRDAYMTYSRPMSSGSAAQWSQGLSAGAGAGAGGQQQQQQQAQPQPSRWQLQRRRWSPRRAAARARVAAAERWRRAWVVALWCAAMASLFAWRFVQYRRSAAFRVMGYCLPTAKGAAETLKLNMALVLLPVCRNTLTWLRSTWARFFVPFDDSIAFHKMIALAIAVGICLHAGNHLACDFPRLIASGPDEYRLVARFFGRDKPSYRGLLAGAEGVTGIVMVTLMAVSFTLATRPFRKREAEVKPARSARRWCWPLAHLAGGFNAFWYSHHLLIVVYLLLLVHGWFVFLVDKWYQRTTWMYISVPLVLYVGERTLRAFRSKAYAVKILKVCLLPGNVLTITMSKPYGFRYRSGQYIFLQCPTISPFEWHPFSITSAPGDDYISVHIQTRGDWTQELKRIFVENYFTPCVPRRAAFGELGAVEHKSPPRLLVDGPYGAPAQDFRNYDVLLLVGLGIGATPFISILRDLLNNIKLADELMDLAMETSRSEDSANSLSASTASSSNKRRAYRTSCAHFYWVTREPGSFEWFKGVMNEVAEMDKKGVIELHNYLTSVYEERDARTTLLSMVQALNHAKHGVDIVSGTRVRTHFARPNWKEVFTRIASKHPNSTVGVFYCGRPTLAKELKKLSLDMSHKTGTRFDFHKEYF

SEQ ID NO: 768 - protein, 329 aa, Sorghum bicolor
MGVKGFVEGGIASIVAGCSTHPLDLIKVRMQLQGEAAAAPQPALRPALAFHAGGHAVTLPHHDIPVPPPRKPGPLTVGAQILRSEGARGLFSGVSATMLRQTLYSTTRMGLYDILKTKWTPPPDNNGNGGVLPLHRKIAAGLVAGGVGAAVGNPADVAMVRMQADGRLPLAERRNYAGVGDAIARMTRDEGVRSLWRGSSLTVNRAMIVTASQLATYDQAKEAILARRGPGADGLATHVAASFTAGIVAAAASNPVDVVKTRMMNMKVAPGAPPPYAGAVDCALKTVRSEGPMALYKGFIPTVMRQGPFTVVLFVTLEQVRKVFKGVDF

SEQ ID NO: 769 - protein, 1710 aa, Sorghum bicolor
MAAANAPIAMREALTLTSLGIAPQFVTFTHVTMESEKYICVRETSPQNSVVIIDMAMPMQPLRRPITADSALMNPNTRILALKAQIPGTTQDHLQIFNIEAKTKIKSHQMPEQVVFWKWITPKLLGLVTQTSVYHWSIEGDSEPTKMFDRTANLANNQIINYRCDPAEKWLVLIGIAPGAPERPQLVKGNMQLFSVDQQRSQALEAHAASFATFKVVGNENPSTLICFASKTTNAGQITSKLHVIELGAQPGKPGFSKKQADLFFPPDFQDDFPVAMQVSQKYGLIYVITKLGLLFVYDLETAAAVYRNRISPDPIFLTAESSSTGGFYAINRRGQVLHATVNDATVVPFVSGQLNNLELAVNLAKRANLPGAENLVVQRFQELFAQTKYKEAAELAAESPQGLLRTPETVAKFQSVPVQAGQTPPLLQYFGTLLTRGKLNAFESLELSRLVVNQNKKNLLENWLAEDKLECSEELGDLVKTVDNDLALKIYIKARATPKVVAAFAERREFDKILIYSKQVGYTPDYLFLLQTILRTDPQGAVNFALMMSQMEGGCPVDYNTITDLFLQRNMIREATAFLLDVLKPNLPEHAFLQTKVLEINLVTYPNVADAILANGMFSHYDRPRIAQLCEKAGLYLRALQHYSELPDIKRVIVNTHAIEPQALVEFFGTLSREWALECMKDLLLVNLRGNLQIVVQAAKEYSEQLGVDACIKLFEQFKSYEGLYFFLGSYLSSSEDPDIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSVRSLLPVEPLVDECEKRNRLRLLTQFLEHLVSEGSQDVHVHNALGKIIIDSNNNPEHFLTTNPFYDSRVVGKYCEKRDPTLAVVAYRRGQCDDELINVTNKNSLFKLQARYVVERMDGDLWDKVLQPENEYRRQLIDQVVSTALPESKSPEQVSAAVKAFMTADLPHELIELLEKIVLQNSAFSGNFNLQNLLILTAIKADPSRVMDYINRLDNFDGPAVGEVAVEAQLYEEAFAIFKKFNLNVQAVNVLLDNIRSIERAEEFAFRVEEDAVWSQVAKAQLREGLVSEAIESFIRADDAAHFLDVICAAEEANVYDDLVKYLLMVRQKAREPKVDGELIFAYAKIDRLSEIEEFILMPNVANLQNVGDRLYDEELYEAAKIIYAFISNWAKLAVTLVKLKQFQGAVDAARKANSAKTWKEVCFACVDAEEFRLAQICGLNIIVQVDDLEEVSEYYQNRGCFNELIALMESGLGLERAHMGIFTELGVLYARYRPEKLMEHIKLFSTRLNIPKLIRACDEQQHWKELTYLYIQYDEFDNAATTIMNHSPDAWDHMQFKDVCVKVANVELYYKAVHFYLQEHPDLINDMLNVLALRLDHTRVVDIMRKAGQLHLVKPYMVAVQSNNVSAVNEALNELYVEEEDYERLRESVDMHDNFDQIGLAQKLEKHELLEMRRIAAYIYKKAGRWKQSIALSKKDNMYKDCMETCSQSGDRELSEDLLVYFIEQGKKECFASCLFICYDLIRPDVALELAWMNNMLDFAFPYLLQFIREYTSKVDDLVKDKIESQKEERAKEKEEKDLVAQQNMYAQLLPLALPAPPMPGMGGPPPPMGGMGMPPMGGMGMPPMGPGPMPAFGMPPMGSY

SEQ ID NO: 770 - protein, 384 aa, Sorghum bicolor
MPTPVKSVLPVVLLGCGGVGRYLLRHIVSCRPLHANQGVAIRVVGVADSSSLLVAEDVHSNGLDDALLTQLCAAKSAGSPLSSLLAQGHCQLFKNPEARGKVIDAATTLGRTTGLVLVDCSATYDTVSLLNDAVGHGCCIVLANKKPLTGAYEDFQKLVSNFRRIRFESTVGAGLPVIASVTRIIASGDPVSRIVGSLSGTLGYVMSELEDGKKFSEVVKNAKSLGYTEPDPRDDLGGMDVARKALILARLLGQQISMENINVESLYPSELGPDAVSTKDFLESGLVQLDKSMEERVKAAASRGNVLRYVAEIESTGCQVGLKELPKDSALGRLRGSDNVVEIYSRCYQSSPLVIQGAGAGNDTTAAGVLADIIDLQDLFQTTA

SEQ ID NO: 771 - protein, 494 aa, Sorghum bicolor
MQAAAGSVSWVTAQPSVLGRCGGAPSASLKGSACGVGGGGCRIRGRDVAVPRCCARAQEKRPPRVRKSKEERREMVESFINGYRLSNEGKFPSVNLTHKEVGGSYYIVREIVRDIIQENRVLGPGGLDAMALSFEDRDDSSESSMKHELGQDNIEILDTSGSEVSKGYVPEISSTDESIPLQDNAISTQTLLGSSNILEAGVLNSVVQNGSAADAILMETNLEKQDEVPSGGSIEFDLNSSEEQARLFAQVSDSDEDIVLNSQADAQDGTASSATDGVILPLESSAVYESNAALLRDHETLPNDNHDGSTDGAVDDANLLAAINGVQAKQASLHEHDASTGSVSIDNAQSFDSQYSTTVSTDPINGSKSEAEVATKTVEASKVHRLQDEFEQPLVDASCDGQENSDSPVSHPALDTKGLLHTEDQHSVVQIDESEFKISTPGITKEEVQAADFRHEQGINTRTAISRHALCLLTLRCMLTVYNFLHTSQKAAVY

SEQ ID NO: 772 - protein, 299 aa, Sorghum bicolor
MAPPPATVAAVRHHSPHLLLRRGGGGLLPPPPAPATLPFATRGVASAPARLRLPPPWFSLSPVPKSLSASSSSHVPVRSLFTGIVEEVGRVRRLGPPLAPSSGGGGGEAPGLDLEVETRDLLTGTQLGDSVAVDGTCLTVAAIDPAASTLTFGVAPETLRRTSLGGRAPGDGVNLERALTPSSRMGGHFVQGHVDGTGEIAAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKVGS

SEQ ID NO: 773 - protein, 331 aa, Sorghum bicolor
MPLHCSLPATCSALCLRAAARPDPRCPSSHARLVGLALSRPRHQRLVHTGCARAGTSDSKAVQLVLGGRARSDDDDTDSESSDGEDSQDRMTDEERKTLRRKIREMMDRVPETAGLTDPEERRAKMRELLTKYELVVEEEDPDWPEDAEDGMGFSLGQFFDKITIKAEKKDDAEEDDDSGYQSDKEIVWEDDNYIKPVRDVRTQDWDASVFTDFGPMIVLVHNRYKRPRENEMARAELTKAIEMFWEHNLPSPRCVAVDACAEPDLVDALKVSGFPEILFTNAGRIIHREKVVRSAEAWSRMMAFFYYKAARPPFLCEADGKGQEKVPLMS

SEQ ID NO: 774 - protein, 88 aa, Sorghum bicolor
MSSQRPGRHQRRASQSVFVLPENLASLDVDAAGEVGANSKAGGPDGAGAEQQARPPAGRHRRAMSVAVASTRDLELIKEDLGSYKLGA

SEQ ID NO: 775 - protein, 483 aa, Sorghum bicolor
MASAAAAPTSLSLAARAATRAATAAAAAAAPLRRGGLAAACQPARSLAFAAGDARLAVHVASRCRQASSARGTRAMATMAKKSVGDLTEADLEGKRVFVRADLNVPLDENQNITDDTRIRAAVPTIQYLISKGAKVILSSHLGRPKGFTPKFSLGPIVGRLSELLGIQVQKAEDVIGPEVEKLVDALPIGGVLLLENVRFYKEEEKNDPEFAQKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGASLVEEDKLDLATSLLAKAKEKGVSLLLPTDVVIADKFAPDANSQIVPASAIPDGWMGLDIGPDAVTSFNAALDTCQTVIWNGPMGVFEFDKFAVGTEAVAKKLAELSAKGVTTIIGGGDSVAAVEKVGVADVMSHISTGGGASLELLEGKELPGVVALDEAIPVAV

SEQ ID NO: 776 - protein, 379 aa, Sorghum bicolor
MKEGGGGGGDGGFVRADQIDLKSLDEQLERHLSRAWTMEKRKEEASGGADQRGAGARPHSRRPRREDWEIDPAKLVVKGVIARGTFGTVHRGIYDAHDVAVKLLDWGEDGHRSEQDIQALRAAFSQEVSVWHKLDHPNVTKFIGAIMGARDLNIQTENGHIGMPTNICCVVVEYLPGGALKSFLIKNRRRKLAFKVVVQIALDLARGLSYLHSKKIVHRDVKTENMLLDKTRTVKIADFGVARLEASNPSDMTGETGTLGYMAPEVLNGNPYNRKCDVYSFGICLWEIYCCDMPYPDLSFSEVTSAVVRQNLRPEIPRCCPSSLANVMKRCWDANPDKRPEMAEVVSMLEAIDTSKGGGMIPVDQRPGCLACFRQYRGP

SEQ ID NO: 777 - protein, 333 aa, Sorghum bicolor
MAADPDTEVQAEFPPLVRQYKSGRVERFFNPSPLPAGTDPATGVVSKDVVVDPATGLWARLFLPPSSSHGKKQQLPIVVYYHGGAYVIGSAADPWTHTYLNGLVAKAGVLAVALEYRLAPEHPLPAAYEDSWEGLKWVATHAAATAAAGGGPEPWLTEHGDFSRVFLAGASAGGTIAHYVAVRAGEQQGQGQGDLLGVRVRGLLIVHPYFSGAADIGDEGTTGKQRKAQADAFWRFLYPGSPGLDDPLSNPFSEAAGGSAARVAAERVLVCVAEKDDLRDRGVWYYESLKAGGYPGEVELLESKGEGHVFYCMNPSCDRAREMEERVLSFLRK

SEQ ID NO: 778 - protein, 67 aa, Unknown
  Sequence found in Organisms: Sorghum bicolor, Triticum aestivum
MAPRVVASALLFAMAAVLVASASAQEFTAPASAPAPGPVAGAASAPASAVAVVSSALLSLLVATLMQ

SEQ ID NO: 779 - protein, 139 aa, Sorghum bicolor
MTVEKVDAALADFDAHFDRLFASPDAASDGKVKLLLFLADREPDSSLTWCPDCNVAEPVIYERLEAALQGKDAVLLRAYVGDKPTWRDPAHPWRVDPRFGLKGVPTLIRWEDGAAAARLGDDEAHLKDKVDALLSVPSI

SEQ ID NO: 780 - protein, 267 aa, Sorghum bicolor
MAQPFSPHTPSSSWVTRRPPTSTSSPSASTTRTSASPIPGCRPRRRAVAPAASLHLGPGEIAEVSRNKVLIAATVASAIGQLSKPFTSGKNGGAGAGLDLRTIFRSGGMPSTHSASVVAVATSLGLERGFADSVFGMSVVFAAIVMYDAQGVRREVGNHARVLNKFWILKEKAPLEYSEVDMASEFVSVTEEVISNASPSKHGSSTESPRVKGLHSSEPEVTEVTELKQAYIEEDYRLSESVGHTELQVTVGALLGFAVSLAVYATL

SEQ ID NO: 781 - protein, 350 aa, Sorghum bicolor
MASSSSPAPTLAGEALRQKRILSSKLYLEVPSSKAPVVYSPAYDISFLGLEKLHPFDSAKWGRICRYLTREGYLDKKRMVDPLEACKEDLLVVHTEAYLNSLKSSFRVSNIVEVPPVSLVPNWIVHKKLLYPFRKQVGGSILSAKLALERGWAINVGGGFHHCSADEGGGFCAYADISLCIQFAFARLNISSVLIIDLDAHQGNGHEKDFANDGRVYIFDMYNAGIYPFDFTAKQYIDQKVELASGTETDEYLEQLDKALEVCNSRFQPQLIVYNAGTDILDGDPLGRLKVSPEGVVTRDEKVFTFAKDQNIPLLMLTSGGYMKSSARVIADSIINLSNKNLIGLGSELG

SEQ ID NO: 782 - protein, 362 aa, Sorghum bicolor
MAVVRLRGNGANGVVRPRPRDRGARGGGGSMAGRVAVLAFCVAGIWSAYIYQGVLQETLSTKRFGPEGRRFEHLAFLNFAQNVLCFVWSFIMIKLWSGGSSSNGRAPLWKYWGVSVTNTIGPTMGIEALKYISYPAQVLAKSSKMIPVMLMGTLLYGVKYTLPEYFCTFLVAGGVSSFALLKTSSKTIKKLANPNAPLGYTLCFLNLAFDGYTNSTQDLIKSRYPKTNPWDIMLGMNLWGTIYNAVIMFAAPLLFSNWPYANGFEALRFCQENPEVAWDIFLFCLCGAVGQNFIFLTISRFGSLTNTTITTTRKFMSIVVSSVISGNPLSLKQWGSVVMVFLGLSIQIYLKWKKKKGRDHKE

SEQ ID NO: 783 - protein, 397 aa, Sorghum bicolor
MATSSTATASLHLLLPASRRRRHFVPRAAHSESTPPGAASVDRRRFIAHTAAAAAVSPLVLPRWTPAARADGAPALSEWERVFLPIDPGVVLLDIAFVPDDPSHGFLLGTRQTILETKDGGNTWFPRSIPSAEDEDFNYRFNSVSFKGKEGWIIGKPAILLHTSDAGESWERIPLSAQLPGNMVYIKATGEQSAEMVTDEGAIYVTSNRGYNWKAAVQETVSATLNRTVSSGISGASYYTGTFNTVNRSPDGRYVAVSSRGNFYLTWEPGQPFWQPHNRAVARRIQNMGWRADGGLWLLVRGGGLFLSKGTGISEDFEEVQVQSRGFGILDVGYRSQEEAWAAGGSGVLLKTTNGGKNWVRDKAADNIAANLYSVKFLDDSKGFVLGNDGVLLRYLG

SEQ ID NO: 784 - protein, 242 aa, Sorghum bicolor
MATAISSLVTPPALHRRCLSPASVSVSAPIRISFRAAAASQAWRRGLALRVSASSAVLEAPEVVAARKLYVGNVPRTVTNDELRDMFAAHGTVERAEVMYDKYTNRSRRFGFVTMSTVEEANAAVEALNGTEVGGRKIKVNVTESFLPNIDRSAPESEPVFVDSQYKVYVGNLAKNVTTEVLKNFFSEKGKILSATVSHIPGTSKSKGYGFVTFSSEEEVEAAVATFNNAELEGQPIRVNRA

SEQ ID NO: 785 - protein, 418 aa, Sorghum bicolor
MELEAAPRQQQQLEEEEEEVVGCTCGGGAEAADQFERLHDAVLLDVLNRIGDVKALGRCALVSRRFHALVPLVDSVFVRVDCVIPDDPTPSAAAAAPGSAPHQAPATAARGRGGALAHMARVLLGGIARPIHALGQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAALDTSRETEEPGSLPDSLYTNGGLKLRVVWTISSLIAASARHYLLHPIICNHETLESLDLTDADGQGVLTMDKRQLQELRVRPVSPSGSSHRTLMPALSMRLHYAPLIELPGGTLLKGATLVAIRPSEDALREGQGAGAAGPVGTCWISEAFEEPYRTAAKVLLKRRAYCLEMNSF

SEQ ID NO: 786 - protein, 284 aa, Sorghum bicolor
MDADGSSKRSRPVRRAVKKLKFKPKVPPQKPKKLSAQKPQQEDPKPIDQDLMKILRTHQVAAKSSLNKEDERPMQNTPSTPPSADVVNMSPTQFGLQKQNQLPLQIPRSFPVPVHSGMFYKEDSDDDDNDDGSDNVELHETQPNSIECEALTRPAEELDLLQQQGSKERMFLFQLPKSLPLPKRTSSTSIVERQGKPTGKEVKEGCNLQQLPQGYLGKMLVYKSGKIKMKLGDVMFDVSPGAETRMAQHVVAQNTRDKHCCLLGEIENRHVIVTPDMDSLLNDK

SEQ ID NO: 787 - protein, 288 aa, Sorghum bicolor
MATAATASATAATRFTLLAGAGLRSRISRRPTAVRFQRQRGLTTTALLKTADLLPKAQGQPETLDYRVFLVDGGGRKVSPWHDVPLRAGDGVFHFVVEIPKESSAKMEVATDEAFTPIKQDTKKGNLRYYPYNINWNYGLLPQTWEDPTSANSDVEGAFGDNDPVDVVEIGERRANIGDVLKVKPLAALAMIDEGELDWKIVAISLDDPKASLVNDVDDVEKHFPGTLTAIRDWFRDYKIPDGKPANRFGLGNKPASKEYALKVIEETNESWEKLVKRNIPAGELSLA

SEQ ID NO: 788 - protein, 146 aa, Sorghum bicolor
MHSQLVCGGCKRLLQYRRGATGVCCPTCNTFTAANPSGPEMSELVCGGCFTMLVHSRSATNIRCPHCSRLNSTRSGNQMGHLSCGQCRTTLAYPPGATTVGCPTCRNINPVRDARPQTVLVENPKTLDEKGKLVSNVAVGVTSWKR

SEQ ID NO: 789 - protein, 129 aa, Sorghum bicolor
MSATAKCLEATAGPPAGSGSSRCLLFPGKEHRTSVTAAEFKKWLKQFDADGDGRISRRELREAIRRRGAWFASVKAWCAVRRADRDRNGFVDDCEMESLVEFAENELGFLISKEPTSTPNRRAQPPLRW

SEQ ID NO: 790 - protein, 211 aa, Glycine max
MLVKSLSLHSHAFSSCSFSASEIGTNPSWVPLKSLNSLCCSSKPRNLCRFLCLSTQNGGFRENSGEVGLGDAVIIVDHGSRRKESNLMLNEFVEMFKHKTGYEIVEPAHMELAEPSIRDAFQSCVEQGAHRIIVSPFFLSPGRHWTQDIPSLSAEAAKEHPDVSYIVTAPLGLHELLVDVVNDRIKHCLKHVAGDADECSVCSGTGKCRLY

SEQ ID NO: 791 - protein, 498 aa, Glycine max
MEGDLQRSLSLRLNRRGDRSNQNPAKDFEVGFFSSGRVPQDYPMKIVWKKGFVRLVLVAGILWMLLILLALLFHIWSCQTSVSFLSAMCNKDSKVYNMLGNMGLVSKPHRCPIPLSNDPDKIVIPTRRTPNEILKNLSYVMEDEVPHSEAQSSPLFGGHPSWKQREESFKLKSNMKVHCGFIQGGGAEMNRVDIKYVKKCKFVVASGIFDGYDLPHQPSNISLRSKELFCFLMVVDEVSLKFMRENGTVKEDGAGGKWVGIWRLVLLKHPPYDEPRRNGKVPKILTHRLFPQAQYSIWIDGKMELIVDPLLILERYLWRGRHTFAIAQHKHHRSIYEEADSNKRRKRYARPLIDLHIKIYYYEGMKPWSSNKKTNSDVPEGAIIIREHTAINNLFSCLWFNEVHLFTPRDQLSFGYVAYRLGDAFKFFMFPNCEYNSLFVLHPHTREHSSPIEWVKQLDELKKGNLRESRGGLGLFTPYPGDLDSVVLPNVTRTSKAG

SEQ ID NO: 792 - protein, 256 aa, Glycine max
MAMSSIHTLYAFSFRLCFPNSSPQFKPLNAIPLRRTKHYNNNNNNVKFPRERTRTRATLDDVETDQLSSIPLVENEKAKKDVEESVKVLKDAAKTRKVAAEEILSALSIIEKAKVDPSAFFETLGGKESPGRTWMLIFTAEKQLKGGRYFPLTAVQRFDAAAKRIENGIYLGPIGQLTFEGRLSWKKRILAFVFENIRIKVGPLQPLEISLGKKEDKEPSTKDPFFIWFYVDEEIAVARGRSGGTAFWCRCRRANN

SEQ ID NO: 793 - protein, 641 aa, Glycine max
MALQMTWQPSLLSQKRKTGTGPPLGLRNLGNSCYLNSVLQCLTYTPPLANFCLRLQHSSLCDSSGSSCPFCILEKQIARSLRLDLTHDAPSKIQSCIRIFAENFRCGRQEDAHEFLRYVIDACHNTCLRLKKLRRKGAEANGGGDEAGGSTVVKEIFGGALQSQVKCLCCGYESNKVDEIMDISLDVFHSNSLKDSMQKFFQPEVLDGNNKYKCDSCKKLVAAKKQMSILQAPNILVIQLKRFEGILGGKIDKAVAFEEVLVLSSFMCKASQDPQPEYKLFGTIVHSGYSPESGHYYAYIKDAMGRWYCCDDSCVAVATLQEVLSEKVYILFFSRTNQRPVSSSNSLASNGVKPHSNGSQTSECPKVGVPPKAVHAKSNSELSSWKDIPRVSKTAKAPSSSRVKFDINGSSSSKRNSAPVSVNGKVDVCRNQPSAVNGHVKDSASLENGKEDSSLPTRNGIDENKVSVDKLKRKESTVSNGHTGNQTVDIHSVKSDLKEDTDRSRIIAGRVPDNFKQESNGLNNKPTILGNKRKLQGDPCILLAHDGQSQARVQELKDILGKEAKSVLRSIGWTDKVYEFMRSKKLRAQEAGNLTNGDEIRKLLIGDAQGAFISKIPESLKQDMIQRLQSFSQEKIQFSGP

SEQ ID NO: 794 - protein, 184 aa, Glycine max
MIRNAAIKEFLKKKYLNSRAAIEDTYFSTKDTFERHRVVFTVGTSIASVATAWFGYSLRHLHDIKVDQRLQSIENSMKNNSNLQHSQIKDIVAGSASGAFSIPACVATAGTSLIIGYALGWRGGIWYATKKFRKEQMKMLGQITPKRWQLLGKIKPRGFQFQFLRRKLTRFKVSDTATKNLKRV

SEQ ID NO: 795 - protein, 291 aa, Glycine max
MASVASSSSFSTRLLLHSHTPLVCRRRCRPNFLRMVTRSCLDDSSALLRAAQHTVDTYVKSGMVVGLGSGHASGMAIQHLGSQLRTGNLKDIVGIPMSVSSASEAAKAGIPLDTYQGSSQIDFAFDDADVIEEGTLVAIIGRRKLQGGESIIQEKSIINSANKCVFIIEENQYKGGLEGSIPVLIQSLNWMTIAEEIDDMFLGDAEVWRRPSIGQAGPLGGDFPVVTKEGHNILDVIFTSPIENLAEVAKSLDKVDGVVDHGVVSKIPCTVVIASQTGLNILDKLTADIVG

SEQ ID NO: 796 - protein, 270 aa, Glycine max
MASSCASSAIAAVAISTPSSQKNGSLLGSTKASFLSGRKLKVNNFTAPVGARSSTTVCAVAEPDRPLWFPGSTPPPWLDGSLPGDFGFDPLGLASDPESLRWNVQAELVHCRWAMLGAAGIFIPEFLTKIGILNTPSWYTAGELEYFTDTTTLFIVELFFIGWAEGRRWADIIKPGCVNTDPIFPNNKLTGTDVGYPGGLWFDPLGWGSGSPEKIKELRTKEIKNGRLAMLAVMGAWFQHIYTGTGPIDNLFAHLADPGHATIFAAFTPK

SEQ ID NO: 797 - protein, 253 aa, Glycine max
MASLQHPTASLQSKHILIPRNTLSQKPILNLSLHGTTFTPLKLKFGVTTTTTAAAATRRSTGATGARMSATAASSYAAALADVAAANNTLDATTADIEKIDEIFSDPQVSDYFADPTLAVEKKRQLIDEIAESSEFQPHTRNFLYILVDAQRIDLINEIAKEFELVYNSLTETELAVVTSVVKLESQHLAQIAKQVQKLTGTKNVRIKTLLDPSLVAGFTVRYSGSKLIDMSVRKQLEDIAAQLELGDISLAV

SEQ ID NO: 798 - protein, 658 aa, Glycine max
METNNACTMHSHCIEMSMEVHQVVPPPHKSTLQKLKGRLKETFFPDDPLRQFKGQPLKRKLILGAQYVFPILQWGPKYNLKLFKSDLVSGLTIASLAIPQGISYAKLASLPPIVGLYSSFVPPLVYAVLGSSKDLAVGPVSIASLVMGSMLHQEVSPTTDPILFLQLAFTSTLFAGLFQALLGILRLGFIIDFLSKAILIGFMAGAAIIVSLQQLKSLLGITHFTNQMGLIPVMTSVFHNIHEWSWQTILMGICFLVLLLLARHVSIRKPKLFWVSAGAPLMCVIISTLLVFAIKAQNHGISVIGKLQEGINPPSWNMLLFHGSHLDLVMKTGLITGILSLTEGIAVGRTFAALKNYKVDGNKEMMAIGFMNVVGSFTSCYVTTGAFSRSAVNNNAGAKTAVSNVVMSVTVMVTLLFLMPLFQYTPNVVLGAIIVTAVIGLIDLPAACNIWKIDKFDFVVMMTAFLGVLFISVQGGLALAVGLSTLKILLQITRPKTVMLGKIPGTDIYRNLDQYKEAVRIPGFLILSIEAPINFANITYLNERTLRWIEEEEDNIKEQLSLRFLVLEMSAVSAVDTSGISLFKELKATLEKKGVELVLVNPLAEVIEKLKKADEANDFIRADNLFLTVGEAVASLSSAMKGQSSTITEGAHTIVSHN

SEQ ID NO: 799 - protein, 194 aa, Solanum lycopersicum
MAAKLPLPSCPTIFKHLSVDHTRSRFNGAVCLWGTAHSLGRIMHFGLSFTNIVQPYSFRIFKRRAWSIRSAADGSGLDSSPTTSGSSGTRLIRAIEALLVKLDARIKVLRKNLPMKLLFFLVGFYCATAFATVIGQTGDWDIISSGLAVAVVEGIGALMYRSIPLIDGVRSIITMFNYWKTGLTLGLFLDSFKY

SEQ ID NO: 800 - protein, 570 aa, Solanum lycopersicum
MVSVATVDAQKAEVLSSVISTNQNQSSEELHVFRSKLPDISISNNIPLHVYLFERLSEFEERTCIIAGSSGETFTFGETYLICQKIAAGLTMVGIEKGDVIMTFLQNCSEFVFTILASSMIGAVITTANPFYTKSEAFKQLKASNAKLIVTQSQYVDKFRDPAENDPKIGEDFSVVTIDDPPENCLHFSVLSEAKAEDMPKGVVIHPDDPVALPFSSGTTGLPKGVILTHKSLITGVAQLVDGDNPNFYLKHDDVVLCVLPLFHIFALNSVLLVSLRAGASVLLMQKFEISALLELIQKHRVSVAAVVPPLVLALAKNPMVDSFDLSSIRLVLSGAAPLGKELEEALHRRVPQAIFGQGYGMTEAGPVVTMCPAFAKQPFSTKSGSCGSVVRNADLKVVDPETGGSLHRNQPGEICIRGSQIMKGYLNDDEATARTIDVDGWLHTGDIGYVDDDDEIYIVDRVKELIKFKGFQVPPAELESLLISHPDIADAAVVPQKDDAAGEVPVAFVVRSAQGFDLTEEAIKEFIAKQVVFYKKLHKVYFIHAIPKSPSGKILRKDLRAKLIATPQL

SEQ ID NO: 801 - protein, 234 aa, Triticum aestivum
MGLGVRAAPFTYVAHALAVVAAAMVLYWCIHFRGGLAFEAANKNLIFNVHPVLMLIGFIILGSEAIMVYKVLPTVNHDTTKLIHLILHAIALVLGAVGIYCAFKNHNETGIANLYSLHSWLGIGTISLYGIQWIFGFLAFFFPKAAPNVRKSALPWHALLGIFVYILALATAELGFLEKLTFLQSSGIDKYGPESFLVNFTALVVVLFGASVVVAAVAPARLEEPQGYAPIPEN

SEQ ID NO: 802 - protein, 303 aa, Triticum aestivum
MGGGVMRTAAKVGLAGGAAAAAGRFRNVAPSFATAPAAEAAAAAPLLSAAGEIPPVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSSDSVESPEKFEEASPEYALPTASPLSDFVDNAKKTMMEMVDNITNFFQDLFHNPAEAEAGPGSSSKKPSFAEMAAGGSFVALAMAVILVVLFKRA

SEQ ID NO: 803 - protein, 235 aa, Triticum aestivum
MDGRDATADLQEWELLLASPTAAAAPGPYAAGGEAVVEDDAAGAIKYDYFDLGSDAKYARRASLSAGAEEEAGEASWVEPHPGALAFPARDRAALWSDSSSDGERREDAEATEPLVETPREAAGVDEGAVAEGGPAAAAARWWRLPVEVLRLWAARAARSAWSVPVAVALLGIAVLGRRLYRMRRQSKAVARVRLVLDDKKASQFKAQPMLRRAPMIKPMLPGNGVTPWPVLGHL

SEQ ID NO: 804 - protein, 990 aa, Triticum aestivum
MATQSAVRLIGGAGAGGWTKDFGAFDSPLGNLPGEGLGFVENGSGIYGGWGESVPNRSGSAPPSMEGSLAALGNLIGQRSGNFDTSLGNLDNVTGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVQESFQQNPDSLYDNSSHLSSSSIGDGVAVHSNIDSSMNLPHDVVKPSGLNSWTPVPLASVLRSTLSNNLSSTSVPSSSCSDNNPSVQISEGQQEKQSIDMKPGNDVPVSGAVVTELDVVDSSMKNLKLSLDSQTTSQVKQQWQGNFLQQYGFSPLVQGDHMAMTPHGAHLPHVPFVDNMSHTQLKLPTGDMQQLLPQLGMPTPFYTPNSFGSPYYQNLHPASVLANPYVTSGYALGGSSFPPVMTSYSPQSSAATPLDSPMTPSFSGRPSGFPSAGNLTVGTEFVQPYKMYGQLGVPMQPPIPDPNFFQFFQHPSFPQYASGNQYNTLAPRGSVFGNVADNFDPRKLFPQAQYPSDQRLQLPKTGIFSSPTTLRGGTVPNYHGIPPYVGAPLTYPTSPVFQGQPFSGISPFGRNDSARFQSASRSMTAVSGFQGQREREKFDNPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 805 - protein, 190 aa, Triticum aestivum
MEAAAATGLRPFAAPLGAATRAGAGAGWRCAPGQRRLGRGARVAARLDGGVGKGVPTTNYVVPLDKATGMTRPLVEILRDLNKRVPDKIIDPDTNTVPWYHANRMLSFYAPGWCGEVRDVIYSNSGTVTVVYRVILKGTDGEAFRDATGTAKVHEGRNDDAVAAAEEAAFSKACARFGFGLYLYHQDEIL

SEQ ID NO: 806 - protein, 145 aa, Triticum aestivum
MAFMRTSSNASSGMGVAPDIRETFLELQMKKAFRYVIFKIEEKQKQVVVEKTGATTESYDDFLACLPEKDCRYALYDFDFVTGENVQKSKIFFIAWSPDTSRIRAKMLYSTSKDRIKQELDGFHYEIQATDPTEVELGVLRDRAH

SEQ ID NO: 807 - protein, 111 aa, Triticum aestivum
MKEATASGGGATATANDPRQPATARPYAPPKLSSQDLPVDYAGFLAVVFGVVGVMLHYKVCSWIAIIFCAQSLANMKNFENDLKQLSMAFMFAVMGLVTNYFGPRPGGTKR

SEQ ID NO: 808 - protein, 278 aa, Triticum aestivum
MALPLVRLLLPSLHACQPPLRHPEYSAPPRHSHVSFAVPAAARSSGNRLAFAVCAASASVAPAPAETQADAEDEQPVGPKTRLIAMNIPWDFTPDDIRVLFEKQGTVVDVELSMHSSKKNRGLAFVTMGSEDEALSALKNLNLSTLNDRTIKVDFAKPKKKQPAVPSAPVEKNVVFVGNLTWRVRSRHLRELFASTPGVQSVEVIFHTTTPRRSAGYAFVSFSSKEEAEAAISTFNGKELMGRSINVMFKEDTVKKNKSSDSEEEKLEEAESSEESDS

SEQ ID NO: 809 - protein, 484 aa, Triticum aestivum
MSCFSCFGPALEAEGRKPVPDAKDPRTKDGAVSDRAGSDKLRLQGGSDPKNNHLTIPRDGSSQNIAAQIFTFRELAAATKNFRQDCMLGEGGFGRVYKGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNVGGRNSEQRNGRSPNHHSPRTSKHGGEVSRTSSTGGDSGRRSGLDEMDMAGSQAGSPAQTGRKRETPRTADRQRAIADAKMWGENSRERKRPNGSFDSTNE

SEQ ID NO: 810 - protein, 344 aa, Triticum aestivum
MDEAGTSSSAGSAPRGGRPARSGVFYKFSQQDLPAWKPAMTPGYVIAIFLIIGIIFVPLGLICLQASNRVAEIVHRYDIDCVPNAYRSNKQAYIKDSSISKECIQKVKVQYHMKAPIYVYYELDNFYQNHRRYIKSRSDKQLRYGLKYTDSSCSPIEKSDGLPIVPCGLIAWSLFNDTYDFTRGSMGIVVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYAYLITGSSSIFLSILFALIHVKIPRPHGDAAYLSWSRKNGNN

SEQ ID NO: 811 - protein, 486 aa, Triticum aestivum
MALALSTLPFAPSTPAPASFRPRGAHFAPSPAGRSVGVGLPLACAAPRKNRGRRRRGGGLVVFAAADYYATLGVQRSATIKDIKAAYRKLARQYHPDVNKEPGATDKFKEISSAYEVLSDDKKRALYDQYGEAGVKSAVGGNAGAYTSNPFDLFETFFGASMGGGGGFSGMDQSAFRTRRRSTAAQGEDIRYDVILGFSEAIFGTEKDIILSHLETCDACSGSGSKVGSKAKICSTCGGRGQVMRTEQTPFGLFSQVSICPTCVGEGEVISEYCRKCSGEGRVRVRKEIKVKIPPGVSKGSTLRVRGEGDAGPKGGPPGDLFVCLDVEEPSDIKRDGINLYSTVSISYIEAILGTVQKVRTVEGSSELRIPPGTQPGDVLVLAKQGVPSLNRPSIRGDHLFTVKVSIPKRISGREKELLEELASLKNGGFARAPVKPKPVHKENGSRAAPEVSDQPDDGEGDWLKKLSDFAGSIVNGASKWLKDNL

SEQ ID NO: 812 - protein, 597 aa, Triticum aestivum
MSQPAAAAVAAQPQGQAAAGRQGGGLGQSLAGIVRMAVFWYFASKFFGPKRAPTEPGLLMSNLFQKGEPMDMWMYLSENDKFSDFGNEDALIWHETNIPYAVWTPTSTRTHTLTYYPTEALKHNGSLYAHVYFSRSGYPVDPTDPEYEQKSAFGRTHPIVAYLRKSKAGHKKSLLGDSDESEEKLPPKENKESEDKEEGPVEYISYWKPNVTINLVDDFTRYPQNNIPPNVAPYLNVDPTTNSYYPTVFFNEFWLLRDKLTALNETVKELTLNLEVSPISMTKWQLFLQIEQSFQVHRSYGSMLEGEADELKRVFLEGNPYLLGLTMIVSLFHSLFDFLAFKNDIQFWNKNKSMEGLSAKSVVLNFICQLIIFLYLLDNDTSWMILASSGVGVCIEFWKIGKAMHVEIDRSGKIPMLRFRDRESYAQNKTKEYDALAMKYLTYVLLVLMAGFAIYSLKYDKHKSWYSWILSSLTSCVYMFGFIMMCPQLFINYKLKSVAHMPWRQMTYKFLNTIIDDLFAFVIKMPWLHRLSVFRDDVIFLIYLYQRWVYPVDKKRVNEFGFGGEDEPAAPQTLEGAAAAQQIEAKAETSTEDKKTK

SEQ ID NO: 813 - protein, 457 aa, Triticum aestivum
MASSCIPTGIRLPDLDMVKAAAVGASSAPGAGAAPLRPAHSSASSALSDASNSSSASSLSLKRARTPRKRPNQTYNEAAALLASMYPSVFPAGDRAPPSPRLLGLASALADDPSRADLLPPFPVLGNAACLLRDAAAPPTTPRSPVLARACPSPAAVSSAFTEFRDSAPSPGTPDGAAGADGPGELDYEDDDDSFDADSFLLGGLDEGAAAEGIDGIMGKLSMESGSDASSINRVLSSSGIDPYIRNLMVLGLGFRRSRSNIKQALKRHDDDSEWWMCPAIPLKDIMPAPPPSMEPPPPVEKKKKKTKKKALKDIAAGPCITCVKEEIPDPAYGDDGIFGPKAPKTGLGLSLNTEEVLKAWYDRGSVFADGNIPDASSTDGLAKLSDIELFLENGAAGAIREGSIQKLKHKQKQCTPLLSNKTRYQARKVHAESRPRVKGRFVSQAALLQKAAEKET

SEQ ID NO: 814 - protein, 192 aa, Triticum aestivum
MKHLLLPSPLPLLLHGPASKPLLLHVRQRHRHALSAAPDGNSGDTSTAASEPPPTNTQPSPPPSAPPSTNSGTTSVKTRLRSRNQARRVQEPYLPPVEVKMMRGKGKANASAAPRREKEKRKKTWDEMSLGEKAYELYVGEKGALFWLNKFAYASIFIIAGAWILFRFVGPATGLYQLDAPPLAPTDVLRGS

SEQ ID NO: 815 - protein, 570 aa, Triticum aestivum
MRSLLGEERSFIIESDDDDEEDPAHRGDGVGHGDDGSSSDSSSCATPRGGGGGGGDSQPNSYTNQWPQSYRQSIDILSNVQSPSLGFLGTPTLSRLSNSFLNSSFLNNSFRGKTPEIVSNLVKPLIRPTTSDEQQQQQQQHEDIRKSSQYLLPSRKPSLQQIPEDQKPLVVGHEVSPYQQCSYTQGAMNGINVLCGVGILSTPYAIKQGGWLGLVILDVFALLAWYTGVLLRRCLDSKEGLQTYPDIGHAAFGTTGRIAISIILYVELYACCIEYLILESDNLSKLFPNVHLSIGGLTINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGEATESQFTLNLPENLVVSKIAVWATVANPITKYALTITPLAMSLEELLPRSQQKYSNIILLRSALVVSTLIIALSVPFFALVMALIGSLFAMLVTYILPCACFLAILKAKATWYQTATCSFIIAVGVTCACVGTYSSLSGIVQNYAT

SEQ ID NO: 816 - protein, 126 aa, Unknown
  Sequence found in Organisms: Hordeum vulgare, Secale cereale, Triticum aestivum
MAMTVEVLAGLACMFSTSVLLQILACALYNNWWPMLAALMYIIVPMPCLFFGDGSTRFLSSGEGGAWMKAAKFLTGMSAMGSLAIPAILRHAGLIETGAMFIEFTSFFILVCTVLCFHRATLDEEW

SEQ ID NO: 817 - protein, 794 aa, Triticum aestivum
MGPGAPSPEDAAGGGPEAWYGSIQYLVNISAVGAASCVLLFLLVKLRFDHRRIPGPSALAAKLLAVYHATAPQIALHCGADAAQFLLFERASFLVLAAVSAAAFAAALPLNLLAGDAAIADQFAATTISHIPRAPPLLWLHLLLTAAVVAIAHLGISRMEDALRITRFRDGNGNPSDPNSSSVTVFTIMIQGIPRALAADRAPLKEYFEHKYPGKVYRVIVPFDLCTLEYLADEWGKVRNKISWLEAKMDARSLFDEFVQDESGQLEAHWLVRRCKELWAMAAQRFGFTDDERLRKLQTRKLVIGSRLSDYKEGRAPGAGIAFIVFKDVYTANKAVRDFRMERKKTPIGRFFPVMELQLERSRWRVERAPPASDIYWNHLGMNKTSLALRRIAVNTCLIVMLLFFSSPLSILSGMQNAARIINVEAMDNAKSWIVWLQGSSWFWTIIFQFLPNVLIFVSMYIIIPSVLSYFSKFEFHLTVSGEQRAALLKMVCFFLVNLILLRALVESSLESWILSMGRCYLDSADCKQIEHYLSPSFLSRSSLSSLAFLITCTFLGISFDLLAPIPWIKHILKKFRKNDMVQLVPEENEEYRSMNNDEETNGLVSPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDLDWNLYQS

SEQ ID NO: 818 - protein, 144 aa, Oryza sativa
MDQKPKDDFDFLEPSVLLDETHYQTGFKNGYSEGLVSGKEEGRQVGLKNGFQVGEELGFYQGCLDVWTSLVSIDQDAFSARVRKNIEQLAALLRSYPLSNPEDEQVQDIMEKIRLKFRVITASLGTKLEYQGRPTSSKQDVEDL

SEQ ID NO: 819 - protein, 144 aa, Sorghum bicolor
MDQQPKIEVDFLDPTLLLDETHYQEGYKNGYNDGLASGKEEGRQVGLKMGFQVGEELGFFQGCLDVWTSAILIDQNAFSARLRKNIEQLAALVSSYPLSDPENEQIQDVMEKIRLKFRAITASLGVKLEYEGHPTSSKQDVEDL

SEQ ID NO: 820 - protein, 796 aa, Zea mays
MGPAAQPPDAGGGGDPEAWYGSIQYLINISAVGAASCVLLFLLVKLRFDHRRIPGPSALAAKLLAVYHATAAQIALHCGADAAQFLLFERASFLILAAVAAAAVAAALPLNLLAGDAAVVDQFASTTISHIPKSSPLLWLHLLLTAAVVAIAHLGISRMEDALRITRFRDGNGNPSDPNSSSVAVFTIMIQGIPKTLAADKTPLKDYFDHKYPGKVYRVIVPFDLCTLEHLVEQLGKVRNKISWLEARLGARDLFDDIVHDNDDTVQSEEHWFVRRCRGLWAMAGERLGFTDEERLRKLQTKKLVLASRLSDYKEGCAPGAGVAFVVFKDVYTANKAVKDFKMERKKTPIGRFFPVMELQLERSRWKVERAPPASDIYWNHLGLSKISSRLRRIAVNTCLILMLLFFSSPLAIISGMQNAARIINVEAMDHAKSWLAWLEGSSWFWTIIFQFLPNVLIFVSMYIIIPSVLSYFSKFECHLTVSGEQRAALLKMVCFFLVNLILLRALVESSLESWILSMGRCYLDGPDCKQIERYLSPSFLSRSSLSSLAFLITCTFLGISFDLLAPIPWIKHIMKKFRKNDMVQLVPEENEDYLPMQNGEETNNLTAPLMPEREDGGLLDNIEGHDLSLYPLNRSFHMPKQKFDFAQYYAFDITIFALTLIYSLFAPLVVPVGATYFGYRYLVDKYNFLFVYRVRGFPAGNDGKLMDRVLCIMQFCVIFFLAAMLLFFAVQGDSMKLQAICTLGMLVFYKLLPSRSDRFQPSLLEGMQTVNSFVDGPTDYEVFSQPDLDWSLYQS

SEQ ID NO: 821 - protein, 527 aa, Zea mays
MAMATTEATTLTALLKEAAAAFPTRRAVAVPGRLELTHAALDALVDAAAARLAADAGVLPGHVVALSFPNTVELVIMFLAVIRARGVAAPLNPAYTQEEFEFYLSDSEARLLVTNAEGNAAAQAAAAKLGLAHAAASLHDAAGPVHLAGLPAHAPENGSHGGGAAGSLSPNDPSDVALFLHTSGTTSRPKGVPLKQRNLAASVRNIRSVYRLAETDATVVVLPLFHVHGLLCALLSSLASGASVALPAAGRFSASTFWADMRASGATWYTAVPTIHQIILDRHASRPEAYPALRFIRSCSASLAPAILERLEAAFSAPVLEAYAMTEASHLMTSNPLPEDGPRKPGSVGRAVGQELAVLDEEGRLVAAGSPGEVCVRGDNVTAGYKGNPEANEAAFRFGWFHTGDIGVVDDQGYVRLVGRIKELINRGGEKISPIEVDAVLLGLPGVAQAVSFGVPDDKYGEEINCAVIPRDGSALREEEVLAHCRRNLASFKVPKKVFITDDLPKTATGKIQRRIVAQHFVQPTSA

SEQ ID NO: 822 - protein, 823 aa, Zea mays
MYFAKLDDSPMFRTQIQSLEESAELLRERCLKFHKGCRKYTEGLGEAYDGDIAFASSLETFGGGHNDPMSVAFGGPVMTKFTIALREIGTYKEVLRSQVEHMLNDRLLNFVDIDLHDVKDAHKRFDKASLSYDQIREKYLSLKKGTRPDITTAIEDELHSARSSFEQARFNLVTSLSHVEAKKRFEFLEAVSATMDSHLRYFKQGYELLHQMEPYINQILAYAQQSRERANKEQASLVERMHEYKRQIDRESRSSINGLNDSYNGDRMQTIGRSSHKQIEAVMQSTSKGKVETIRQGYLSKRSSNLRADWKRRFFVLDSRGMLYYYRKQITRPPAGCSMQRNVNPPEHGSGLLSRLFSSHYHIHDEKSVARHTVNLLTSTIKVDAEQSDLRFCFRIISPTKIYTLQAESAVDQMDWIEKITGVIASLLSSQSPEQCFMSSPKGSGHDRSTSDGSSFTSSVEFEPSVIDDLVLEKYSGNGQHDVIRGTHHHRTSMKPEKPIDLLRKVDGNNMCADCGALEPDWASLNLGALLCIECSGVHRNLGVHISKVRSLTLDVRVWEPSVINLFQSLGNMFVNNIWEDMLPDDNSSADGSDTSQYLSVSKPKHKDVFSAKEKFIHAKYVDKEFIRKRSMDENQLAEQMWNSVAANDKKTAYSLIVRSRANVNLVYGEMPSSPFLTLGKALQQEQPVSPPDGSPKFFDCNSHDKISPREPLSPASTSSRTDDMEDGCEGLSLLHLACRVADVGMVELLLQYGASVNMNDSRGRTPLHHCILKGRHRHAKLLLSRGADSQAMDRDGRTALQYAIDGGTSDEDILALLEDHSR

SEQ ID NO: 823 - protein, 542 aa, Setaria italica
MEAGAWAVVAAAVAVYLAWFWRMSRGLSGPRVWPLVGSLPGLVRHAEDMHEWIAANLRRAGGTYQTCIFAVPGVARRGGLVTVTCDPRNLEHVLKARFDNYPKGPFWHGVFRDLLGDGIFNSDGETWVAQRKTAALEFTTRTLRTAMSRWVSRSIHGRLLPILGDATADGRSVDLQDLLLRLTFDNICGLAFGKDPETLARGLPENDFASAFDRATEATLNRFIFPECVWRCKKWLGLGMETTLARSVHHVDRYLSAVIKARKLELTGGKKGGDAPAPAATPHDDLLSRFMRKGTYSDESLQHVALNFILAGRDTSSVALSWFFWLVSTHPAVERKIVRELCAVLAASRGADDPALWLAAPFDFEELDRLVYLKAALSETLRLYPSVPEDSKHVVADDVLPDGTFVPAGSSITYSIYSAGRMKTVWGEDCLEFRPERWLSADGARFEPHDSYRFVAFNAGPRICLGKDLAYLQMKNIAGSVLLRHRLAVAPGHRVEQKMSLTLFMKHGLRMEVRPRDLGPVVDELRAAGEYDAAARATAACA

SEQ ID NO: 824 - protein, 443 aa, Zea mays
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 825 - protein, 265 aa, Zea mays
MARPFSSPHIPSSSWVTRRPPPWTSSPSVSTTRTSASSITACRPRRRAVAPAASLHLGPGEIAELARNKVLIAATVASAIGQLSKPFTSVKNGGVGAGLDLRTVFRSGGMPSTHSASVVAVATSLGLERGFADSIFGMSVVFAAIVMYDAQGVRREVGNHAKVLNRFWILKEKAPLEYSEVDMAAPEFVSVSEEASSNASPSLKRGCSTESPRVNGLRGSELTELKQAYVEEDYRLSESVGHTELQVTVGALLGFAVSLAVYATL

SEQ ID NO: 826 - protein, 394 aa, Hordeum vulgare
GSGDDTPVEQPKKLYISPPNAKRFQLPDGRHLAYEEKGISAGRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMVNPYDSKMTKDEKRKIWDRWSTKRKLMHILARRFPSLLRLFYHRSFLSGKQGQPESWLSLSTGKRDKTLLEAPMFSAFWEKDVAESVRQGDAQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPVPEPSEVAREPTEETSPAYEEEEEEVAEQEQETSGLA

SEQ ID NO: 827 - protein, 1042 aa, Brachypodium distachyon
MEASASSTPQALTLLTSSPRFLSLHPSARQRGRGSGGGLLLRPPPHRRLELGYRANRPLGCSVSGSTDVSVDVLGGPVAAAAALLAALQLLWLRWRGARDGESPEVLCTQDKSIVNKELRTTTRSVYDSNYAPCATHENGFSELSVSGGMTPEVECQAEKTSSTENIMNVLAMPHSLSQGQHTKYISNRMGWQGGLSRHFLSLSEQKEHAQIDKGPSDSKTDSENAHLLQCQQSDQEENLDLTSLSSFKRTVECPLNFVPQARTGNLFKSRKAIEFTDPYEGGSYLTPGKLVPVACLREGPASKQKKAVKDHDAAKTIGWTISEILSKENLENFIPAKTLGLNGTVDTSDYIRRYNSSLMDGRLKDCVDLLENMEQKGLLDMKKIHHASFLIACKKQRAVMEAVRFCRLIANPKMSTFNMLLSVCAHSQDFDGALQVMMLLKEAGLKPDCKLYTTLISTCAKCGKVDAMFEVFHEMVSAGIEPNVNTYGALIDGCAKAGQVAKAFGAYGIMSSKKVKPDRVVFNALISACGESGAVARAFDVLSEMTAEPSESKGWKPILPDHVTVGALMKTCIQAGQADRAREVYKMLQEYNIKGTPEVYTIALRSCSLTGDLGFALKIYEDMNKIGVIPDEMFLSALVDVAGHARRADAAFEIIKDVRAKGFHVGIMAYSSFMGACCNAKDWKKALQLFEEIKISRLTPTVPMMNALITSLCDGDQVQKSIEVLNELKEFGVRPNEITYSVLCVACERNGEAELGIDLFEQLKVDGIGLNPTIVGCVTGLCLQKFSNDLSLGNIIVRFNLGKPQIDNKWTTSAIMVFRQAITAGLLPSSDVLSQVLGCLRFPHDSSLKSTFIDNMGISCDMPHHPNTYSLLEGFGEYDVRAFSILEEAALLGAVASASTKHSQIVIDARKSKMYTAEVSLLMTFKSLKHRLAAGARLPNVTILLPTEKKQVDLDEREKTLKLAGRVGQAVGSLLRRLGIKYQGEESHGRMRINGLTLRRWFNPKFTSTPSTGTPAELLPLPSRLAKGIADQQRDIRSLSL

SEQ ID NO: 828 - protein, 612 aa, Setaria italica
MGFEGLVVVSDPYLQRRFTQADLRALQAKLRALLRVYAEMQLRLKAAGASAGGKKAGGGIARSSSSSAVAFLTAATTTLLHTISESEKASYVGHINAYLAEDPFLKSALPIDPATDHIFHITKDGVLLCKLINLAVPGTIDERAINTKRVLNLWEKNENHTLCLNSAKAIGCTVVNIGTQDLAEGRIQLLADVNLKSTPQLVELVEDSKEMEELMSLSPEKILLRWMNFQLKKGGFQRTVTNFSSDIKDSEAYACLLNVLAPECSAKPSAMSVKDLLHRARLVLEHADRMGCKRYLTPKDIVDGLPNLNLAFVAHIFQKRNGLSKQMKQVSFVDGLSDDAQVSREERSFRLWINSLGISTYINNVFEDLRNGWVLLEVLDKVAPGSVNWKMANRPPIKLPFKKVENCNQVLKIGKELKFSLVNIAGNDIVQGNKKLILAFLWQLMRYNILQLLKNLRFHSNGKEITDNDILAWANKKVKDSGKHHSRMESFKDRSLSSGTFFLDLLSAVEPRVVNWSLVTKGEKDEEKQMNASYIISVARKLGCSIFLLPEDILEVNQKMMLTLTASIMYWYLKRPTSHSLDSENGSSCETSSTTTSDDSASESSFDDNAAR

SEQ ID NO: 829 - protein, 452 aa, Setaria italica
MQAAAGSVSWVAAQPSVLGRCGGGGGAQSASVKGRAGGGGGGGGGGASVRGVGVVRCSTRAQEKRPPRVRKSKEERREMVESFINSYRVANDGKFPSVNLTHKEVGGSYYIVREIVRDVIQENRVLGPGGLDSMALSFEDCPDSSEVSMKHELGQDNIESLAMSDDGQAGQGSVSESSSSEESFSLQNNSINTDILLGSSNILEAGVLKSIVQNGTASGTAFLETNLEKQDEVPSGGSIEVGLNSSEELNSQEDAHEGMGSVATDILPSEATDVYETNGALLREHEMLPNDSHGGSNDSVVDDGNLLAAANGALQEKQASFQEHDPSNESVQGDVQSLDCQISTTLSANPINGFDSEAEVTTKTIEASDTKGLLHTEDQHSVVQVDGSEFKKSTSGFTKEVVEATDARHEQGMSTTTVISRRTSKAQQKKDDNLFWLVLRAFVVAISKIWAK

SEQ ID NO: 830 - protein, 131 aa, Setaria italica
MDAKNVGNEQEAQQKLDAVTGSVPRPNQETLKQFADSDAGNISPANGQEADVNMEAAISTEDVMRAGGFGAKDDIGSLLPTAIDSTDFEASLRDARDFEGEKEAPSHPGLGWKGEKADDGSKPSDVPQQLP

SEQ ID NO: 831 - protein, 773 aa, Setaria italica
FLLPRQWLLLLAAVLATAAAVARGQAPLASRADLGGLYSLRASLGLRARDWPLKSDPCAAWSGVACRAGRVVNVTVAGLRRTRLAALAPRLALDGLRNLTALERFNASGFPLPGEIPDWFGSSLPPSLAVLDLSSAAVNGTLPANLGASGNLTIVLLSGNGLSGAVPAPLLSDRGPRVLDLSRNNFTGGLPNVSAVAGGASMFNISGNSLYGVAGYAIAALRRRFQVVDVSSNYLDGALNGSDGVVITTTNCFHGVPGQRSRVDCEEFYRKQGVNLVDAPAPSPLPSASPLPQPSPEVKRKKQGISKNVLIGVLVAAGALMVLFLAVLLFCLVKMSSRGRSRGRGVEINEEGTGTRSARRRDSSVNPVASSPSAVSPRANGGPKKDVSAIAGDFSYEELVDATGGFGDDKLIKHGHSGDIYHGVLENGSHVIVKKVGSKGINKHASELDFYSRYSHDRIVPLLGYLSKDDEEFLAYKYMPKGDLTDALHKKPVDTADGLPSLDWITRLKIATGVAEAMCFLHDECSPPLVHRDIQASSVLLDDKYEVRLGSMSDICAQQSGGSQNVFSRILRSSKSLDKHTSGPPATCSYDVLCFGKVLLELVTGNFGISGSNDAASEEWLANTLNQINGGDKASVTSIIDPLLLVDEDHQEEVWAAAIIAKACLSAKPSRRPSARHVLRALESPLRVVRQSSSSRSDSARLRSSSSRSSWQSVFLQGNNHRVQSLDRRHSVRSHGSGGEASFSFSFKRAVAAAPEVAPEPVAAALDEEAVVV

SEQ ID NO: 832 - protein, 280 aa, Zea mays
HCSLKPADDERQTLGEPWKPSVTKATEVGMQSKNNKLANVVSLLQKLQQLSVSKDEDAPPVDHMAFLCETESPDHRYVSEILLASGLLMKELGSGQAGLQLQLHSSGYPINPDLFHVLEQRKAGWASIPDGIHQSRSGAKSDPKRAHRKLVFDTANELLLQKFEKETTVYAVSSSTGAKDHPPAKALSGQQLLKFVSSEIEGMGTERSSTCQMEGGVIPDAEILQRLQGWTSFSRELPGMVLEIERSVFKELVDEVVHGESADGPEMKAAGRRRRRRLFA

SEQ ID NO: 833 - protein, 244 aa, Zea mays
NGVYLFQVRLYDTALQRRPAISVEFKESPIKAVAADPNGHDVYIGTGTGDLASFDMRTGKLLGCYFGKCSGSIRSIVRHPDLPLIASCGLDSYLRIWDTNTRQLLSAVFLKQHLTTVVLDSHFSVEEPGEMKSKQLESSVETETEVRKEKKKKSKAITEDETEAQIRKEKKSRTIEEEEQAGLVDHSDINDEVYARKEKKKKKSRGIEGGKERDSDGEICSPKRRKSGERSKCLKKRSKKQLVA

SEQ ID NO: 834 - protein, 668 aa, Zea mays
QVFSWEPIRCHDTVDVGWSRLADLNVHEGKLLGCSFNQSCVGIWVVDLTRLEPYTMGTSTKVNGHSELKTVSSGTLPLQNDSGSRANIGRSSVLQNTENNLKTTSGRLSASQNSDSAPKETNSAPSSGLIPSTPHRAGVGSHNRSVGNSAFQSGGTTLKRSSLRNNSASNVHNFSKADVVPVIVPRTSSGGELATDSRSDAADVAPVLPKVTRRVEPATDSRKESNDVELVVPRASSRMEIADLAPISSSKSGRRLESAPDSKEESADTAPVVVSNPRANVRMEIVSDSAPALSKSNRKLDSGTNSKKESADAVIVPRTNSRMEMISDSRREPSAGRISPFRIQSRYAEPRKLAHARTDSNKVDSRSKITETEDFNCQIFLPRRNSVFQTISSEEPREDVKCGPVDRVGFSNSSEPNASVRNENYVPRMRKPGDNCYIEVSRAGRARSSVSNWEGRDQPPSHEEPTTSSSTLAPTGHPYSSRGSNQASEAPIIASDEDVLSLIMERHDLFLSSTKSRLMKLQIIHQMWERNDIRGVLSAMDRMGDHAVCADMASVLMEKSETITLDLCTSILPVVTDLLESKIDRHLVVALELLVKLVRTFGPMIHSTVSSGPCVGVDLEAEQRRERCNLCFIELEKAKNKLPSLTRRKGAVANAAQELALVFQEIMS

SEQ ID NO: 835 - protein, 74 aa, Zea mays
MCARPATSEMCLHHSTPCDAGGACCSASHPPTSSKMQSCCPKLLGPSAAMIASPPLKSRLHLLPRGRGRRSYSP

SEQ ID NO: 836 - protein, 537 aa, Zea mays
VTSRRVKDKWSIRSAPRSSSAVLLYEVNVIPRFNFPAIFLERIIRSDLPVNLRALACRAEKIYLENQGCGSRKFFVEDLKPSYTSQLNNFHSTTVETSKFKQAPPRSGVSSVLPSPSSELISKWGVYGNICRIDKPCVVDEIHLRRFDGMLEHEGAHRCVFASITVKAPVREVWNVLTAYENLPEFVPNLAISRIVLRDNNKVRIMQEGCKGLLYMVLHARVVMDLREKHEQEISFEQVEGDFYTFKGKWRLEQLGDQHTLLKYMVETKMHRDTFLSESILEEVIYEDLPSNLCAIRDYIEKAGAKSSNSTGHSNVPTDPDPDVDHDESRQSEQTCVSCSSSTMKQRPKVPGLQKDIEVLKSELDNFIAEYGQYGFMPKRKHLRSHGRVDIEKAITRMGGFRKIASIMNLSLSYKNRKPRGYWDNLENLQEEISRFQKIWGLDPSYMPSRKSFERAGRYDIARALEKWGGVQEVSRLLSLELRYPRRQADPDDERQSESPSGMMKKHGVKPDEGNVSPNAQKWLLKLKDLDVNWVEY

SEQ ID NO: 837 - protein, 72 aa, Zea mays
VRSPGPLWSAYDRRMAPNLRWGHRGNPESLDMAKSAAPVHFQTWLDTFNVFTIARGHVSSEKQVGTWNLKCQ

SEQ ID NO: 838 - protein, 631 aa, Oryza sativa
PRQAFRLSPASSPLPFPHRGLLLLLLSTRIRGSGCAAREGGRVTRRLLERPMRGASGGGEGFVGASSVSNNISLPNEGTSPRGTDNAECSETSSDRSNSESIKPEECAMPSSIFDKKISIKKKLRLLSRMAILKDDGTVEVDIPTNAEAASLDLSSNDYCNEAFSGEPLASSDFQHRPPMQIVMLIVGTRGDVQPFIAIGKRLQIYGHRVRLATHANFKDFVVTAGLEFYPLGGDPKLLAGYMVKNKGFLPATPSEIPIQRKEIKEIIFSLLPACKDPDTDTGAPFNVNAIIANPAAYGHVHVAEALKVPIHIIFTMPWTPTCEFPHPFSRVKQPAGYRLSYQIVDSFVWLGIRDIINDLRKRKLKLRPVTYLSSAHAYSNDIPHAYIWSPYLVPKPKDWGPKIDVVGFCFLDLASNYKPPEPLLKWLESGEKPIYIGFGSLPIPEPDKLTRIIVEALEITGQRGIINKGWGGLGNLEEPKEFVYVIDNIPHDWLFLQCKAVVHHGGAGTTAASLKAACPTTIVPFFGDQFFWGNMVHARGLGAPPVPVEQLQLHLLVDAIKFMMDPKVKERAVELAKAIESEDGVDGAVKAFLKHLPQPRSLEKPQPAPPSSTFMQPFLLPVKRCFGIAT

SEQ ID NO: 839 - protein, 286 aa, Oryza sativa
LYHKFVSFALEETRLRTTLTPHPSQEKFKSIKPNDDNTVFNALSFSAPKIRLLRSLTIEKKNSYQVLDFAAFSEPEYDLPIFCANVFTTHAQSIVVLDLNPLYDTTVHKDYKDKYYRSIMPLVHKYNELLPWGGKITSESLKFFSPIVIWTIFESTEHNHHVLHSAFVDYYKVWLELMDQAIKENNKATIARNQEEQHKYLTWRAEKDPGYPLLKKLIGESRAEDLVMEFLFEGVNTLGTKSFLDYFPEYARDDGSVNKKRSMIGKSFETRPWDANGEFIGDAEAQ

SEQ ID NO: 840 - protein, 205 aa, Oryza sativa
MLPVLSADLRRAPTPFSLLPLALAPPPPPPPTLLRRRPLLLPRAISSSTSPPPVQEMEAAYKFGPYKIDAREVFHSTPLSYAMVNLRPLLPGHVLVCPKREVKRFADLSSNEISDLWVTAKEVGIRLEQYHKASSLTFAIQDGPQAGQTVPHVHIHVIPRRKGDFEKNDEIYDAVCGIFLNRPPFIQYLNPIFTTKFLLSCFLID

SEQ ID NO: 841 - protein, 108 aa, Sorghum bicolor
MARIHLVAVAMAMLLAVATAQAPGASPTPAPRAQPPATPPPGPAPAPAPAPAPKATAPAPEIPASPPAPSSIGQTPTEAPTSPPPPSDASSVSPALFLAAGAAVAFFF

SEQ ID NO: 842 - protein, 562 aa, Sorghum bicolor
MPQQPVSKKPPPLAPIPIQILRHEPIEPNPISSPHAISHLSFISFFFTDNKDPIDRSPAAANSPAGLEMKVDREMEILLNEIPLLHHGGLLGGSGEAGADDDADLSFLIHELAAMGVVDGDDEPPAPGAANGFGFSSMMIYPKKGGENLVSLHPFSMAGHCAHMPSLFDPVTFAAADGWDIRCSPPPSVSVSPPPATPRARCKNVRRKNGGCGAVTATSPKKCGAAAAAAAAAANKSHGESLAGLRGVMSHIARDQHGCRLLQQRLDDGKREVDHIFAGVSRHAAQLMVDPFGNYLMQKLLAVCDAGQRMALVLTLTADAFVLVRISLNVHGTRAVQKLIESLRTREEISLVIDALRPGFLELIKDPNGNHVVQKCLQAFEADDNKAIFDAAALHCLDIGMQCHGCCVLQRCIARSRGEHRDKLVAAIAGNGFKLAQDAYGNYVVQYVIDLKIPNANSSLAQQFEGKYIHLSMQKFSSNVVEKCLKVFKEVDKAKIILEILATPHLEQLLQHPYANYVIYSALQNSKGSLHSALTNAIRPHVELLRTSPYCKRIYSRALLKK

SEQ ID NO: 843 - protein, 75 aa, Sorghum bicolor
ASSRTQHSSRPATEQARKQASGAMEYWYPCNGSSGCSKEKRPPLKRGQLKLQIARTLLGSLAAPVAKNRDRGFGS

SEQ ID NO: 844 - protein, 51 aa, Sorghum bicolor
MKIESGVELWKNPLKKKNLKRGENMDLTRVLSVEGMARLVSFCYFLTVRRQ

SEQ ID NO: 845 - protein, 582 aa, Sorghum bicolor
MLAATPSRSTDPMAATAALSFHPAAFSVSAHPREAAAATTKQPLRHCSPLRSVVPRRTCLLRARSSNGRPQISASFGNSNEVLDGMPTGDGPPAPGQGGSTVSITVVGASGDLAKKKIFPALFALFYEDCLPEHFTVFGYARSKMSDEELRNMISTTLTCRIDKRENCGDKMEQFLKRCFYQSGQYNSEEGFAELDRKLKEKEAGRLPNRLFYLSIPPNIFVDVVRSASRTASSSSGWTRFIVEKPFGRDSESSGELTRSLKKIDHYLGKELVENLSVLRFSNLVFEPLWSRNYIRNVQFIFSEDFGTEGRGGYFDNYGIIRDIMQNHLVQILALFAMETPVSLDAEDIRNEKVKVLRSMRQLKLEDVVVGQYKGHSKGGRSYPGYADDPTVPKGSVTPTFAAAALFIDNARWDGVPFLMKAGKALHTRRAEIRVQFRRVPGNLYRRNIGTDLDKATNELVLRVQPDEAIYLKINNKVPGLGMRLDRSNLNLLYSERYRREIPDAYERLLLDAMEGERRLFIRSDELDAAWAIFTPVLRELEDRKVAPELYPYGSRGPVGAHYLAANYNVRWGDITSDDAAF

SEQ ID NO: 846 - protein, 351 aa, Sorghum bicolor
MDVLTYLCLQLRFAMLVKPTQMEQKGGGPGARSSHSITLVGHTAYSFGGEFTPRVPVDNTMYAFDLGTQTWSALDDATGDVPPPRVGVTMAAVGGTVYTFGGRDLEHKELNELYAFDTATRAWTLLSSSGGGPPHRSYHSMVADAEGGRVYVFGGCGDAGRLNDLWAYDVASGRWEELPSPGEACRPRGGPGLAVAGGKVWVVYGFSGEEMDDVHCYDPATRAWAVVETTGDRPSPRSVFCGAGIGRHVVVFGGEVDPSDLGHLGAGKFSAEAFALDTETRAWTRLVDDDDKAEAEAEQQQHPGPRGWCAFAAGEKDGRQGLLVYGGNSPTNDRLDDIYFFAPVLEAAAAS

SEQ ID NO: 847 - protein, 306 aa, Sorghum bicolor
MFPMASSSLSPPPLSLILLRPLPCRPVLLSRQRKPFPTVRVEARPEQRLQRRPVTGRWRRGGGFACFSYNANNKTPPPSDKSSDKWAILRRWDVPWEWQTVVLSMVGCGVSFVLTGLVEQSALQYLGFKAVEATIDEKAEILFFGQLSVTVVVLGVIFSITNTFRPFPDDMFRYDIKEPFKLQNGWLLWAGVGLFGAIISIALAGAAMTYLNGETPERETDSLVLLLPLIGSSTTSTAFLVGITGVLAPLLEETLFRGFLMVSLTKWFPTPFCVLVSAAVFALAHLTPGQFPQLFILGNSLQSIQI

SEQ ID NO: 848 - protein, 460 aa, Sorghum bicolor
MAATAAALRCCFPGSSGVGSGFVKAKSSRRGWCAAAVAAPSREAEPVSSLGHRTRVDFPILHQEFDGAKLVYFDNGATSQKPYSVMRTLDEYYRSYNSNVHRGIHALSAKATQAYEDARRKVANFVNAADSREIIFTRNATEAINLVAYSWGLSNLKEGDEIVLTVAEHHSAIVPWQFVSQKTGATLKYVGLTKENAPDIEQLKRLLSNKTKIVVVHHVANVLGSMLPIEEIVTWSNRVGAKVLVDACQSVPHMPVDVQKLGADFLVASSHKMCGPTGVGFLHGKFEILSSMEPFLGGGEMIADVFQDKSTYAEPPSRFEAGTPAIGEAIGLGAAIDYLSCIGMEQIHEYEKELGTYLYESLLSVPNVQIYGPAPSQTVHRAPLCSFNIENVHPTDIAEILDLQHGVAIRSGHHCAQILHRTLGITASARASLHFYNTKDEVDTFIDALKATIDFLTSKY

SEQ ID NO: 849 - protein, 299 aa, Sorghum bicolor
MEVVGGVSLRPSPAPARIRRTTLSCVDVGRRLVLRPAGAPLGQLPARRALVVEARGRSWSERQMQQQRRMPQLPKIEDDGNPRFVIFIRTANVYFWYPLNIITGGTTAKIMLAAKDNFLGKYIYKDTLARNLAAVIYKDEDEIIDTAKEQYRVLKTENEFRYGYKVVEKGNIRSALTTSNVIELPKKDELKTVVDKVKDFFGDVTAGAKESFAQITGSAVSKEEEEAENKEKFRSKRRKKQRKSKEGLSKYAETNAVSLASLNPIFTLPVASLITSHNLPFTSFRDGEMIQSLSTLSDK

SEQ ID NO: 850 - protein, 201 aa, Sorghum bicolor
MRRYSPPYRSPPRRAYGGRGRSPPPPRRGYGGRNKEGSGSLLVRNIPLSVRAEELRVPFERFGPVRDVYIPKDYYSGEPRGFAFVEFVDPYDASEAQYHMNRQVFFGREIAVVLAAESRKRPEEMRSRARVRGYSGHEGRRSSYYGRSRSRSRSPRYRGRPRSRSYSPAPRRRDDYSASPRRQEAHRTSSPRRPTKEHDED

SEQ ID NO: 851 - protein, 1011 aa, Sorghum bicolor
MWAPSRGSSSGSGRRTWRRRIADYLADDQTDVSDNESFITAHSDEYVAASTSMSAAGGGGMLPAFLADQSDLVEVMLELDEESMVVRSVTPTTAALYGTPTASSLPGPGAAGPQAHTPDGPRSLSRCSSTSSRIRRKFAWLRSPSPSPSLRRPPPAAGAAAATAALSDQQVVREAALAARERRRVQARLLNRSRSGARRALKGLRFISRTTTDADGGAALWRAVEERFNALATDGLLARDDFGDCIGTWRSFVRSSMNEAARSLARPQPRRRADGIGVAGMVDSKEFAVGIFDALARRRRQNLERISKDELYEFWLQISDQSFDARLQIFFDMVDTNVDGRITREEVQELIVLSASANKLSKLKEQAEEYASLIMEELDPENLGYIELWQLEALLLQRDAYMTYSRPMSSGSAAQWSQGLSAGAGAGAGGQQQQQQQAQPQPSRWQLQRRRWSPRRAAARARVAAAERWRRAWVVALWCAAMASLFAWRFVQYRRSAAFRVMGYCLPTAKGAAETLKLNMALVLLPVCRNTLTWLRSTWARFFVPFDDSIAFHKMIALAIAVGICLHAGNHLACDFPRLIASGPDEYRLVARFFGRDKPSYRGLLAGAEGVTGIVMVTLMAVSFTLATRPFRKREAEVKPARSARRWCWPLAHLAGGFNAFWYSHHLLIVVYLLLLVHGWFVFLVDKWYQRTTWMYISVPLVLYVGERTLRAFRSKAYAVKILKCPTISPFEWHPFSITSAPGDDYISVHIQTRGDWTQELKRIFVENYFTPCVPRRAAFGELGAVEHKSPPRLLVDGPYGAPAQDFRNYDVLLLVGLGIGATPFISILRDLLNNIKLADELMDLAMETSRSEDSANSLSASTASSSNKRRAYRTSCAHFYWVTREPGSFEWFKGVMNEVAEMDKKGVIELHNYLTSVYEERDARTTLLSMVQALNHAKHGVDIVSGTRVRTHFARPNWKEVFTRIASKHPNSTVGVFYCGRPTLAKELKKLSLDMSHKTGTRFDFHKEYF

SEQ ID NO: 852 - protein, 292 aa, Sorghum bicolor
MDADGSSKRSRPVRRAVKKLKFKPKVPPQKPKKLSAQKPQQEDPKPIDQDLMKILRVGNWLSNCVVNIKIIGLNILFVDERPMQNTPSTPPSADVVNMSPTQFGLQKQNQLPLQIPRSFPVPVHSGMFYKEDSDDDDNDDGSDNVELHETQPNSIECEALTRPAEELDLLQQGSKERMFLFQLPKSLPLPKRTSSTSIVERQGKPTGKEVKEGCNLQQLPQGYLGKMLVYKSGKIKMKLGDVMFDVSPGAETRMAQHVVAQNTRDKHCCLLGEIENRHVIVTPDMDSLLNDK

SEQ ID NO: 853 - protein, 93 aa, Sorghum bicolor
AAEFKKWLKQFDADGDGRISRRELREAIRRRGAWFASVKAWCAVRRADRDRNGFVDDCEMESLVEFAENELGFLISKEPTSTPNRRAQPPLRW

SEQ ID NO: 854 - protein, 641 aa, Glycine max
MALQMTWQPSLLSQKRKTGTGPPLGLRNLGNSCYLNSVLQCLTYTPPLANFCLRLQHSSLCDSSGSSCPFCILEKQIARSLRLDLTHDAPSKIQSCIRIFAENFRCGRQEDAHEFLRYVIDACHNTCLRLKKLRRKGAEANGGGDEAGGSTVVKEIFGGALQSQVKCLCCGYESNKVDEIMDISLDVFHSNSLKDSMQKFFQPEVLDGNNKYKCDSCKKLVAAKKQMSILQAPNILVIQLKRFEGILGGKIDKAVAFEEVLVLSSFMCKASQDPQPEYKLFGTIVHSGYSPESGHYYAYIKDAMGRWYCCDDSCVTVATLQEVLSEKVYILFFSRTNQRPVSSSNSLASNGVKPHSNGSQTSECPKVGVPPKAVHAKSNSELSSWKDIPRVSKTAKAPSSSRVKFDINGSSSSKRNSAPVSVNGKVDVCRNQPSAVNGHVKDSASLENGKEDSSLPTRNGIDENKVSVDKLKRKESTVSNGHTGNQTVDIHSVKSDLKEDTDRSRIIAGRVPDNFKQESNGLNNKPTILGNKRKLQGDPCILLAHDGQSQARVQELKDILGKEAKSVLRSIGWTDKVYEFMRSKKLRAQEAGNLTNGDEIRKLLIGDAQGAFISKIPESLKQDMIQRLQSFSQEKIQFSGP

SEQ ID NO: 855 - protein, 187 aa, Glycine max
PGNMIRNAAIKEFLKKKYLNSRAAIEDTYFSTKDTFERHRVVFTVGTSIASVATAWFGYSLRHLHDIKVDQRLQSIENSMKNNSNLQHSQIKDIVAGSASGAFSIPACVATAGTSLIIGYALGWRGGIWYATKKFRKEQMKMLGQITPKRWQLLGKIKPRGFQFQFLRRKLTRFKVSDTATKNLKRV

SEQ ID NO: 856 - protein, 361 aa, Triticum aestivum
GQREREKFDNPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 857 - protein, 451 aa, Triticum aestivum
DRAGSDKLRLQGGSDPKNNHLTIPRDGSSQNIAAQIFTFRELAAATKNFRQDCMLGEGGFGRVYKGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNVGGRNSEQRNGRSPNHHSPRTSKHGGEVSRTSSTGGDSGRRSGLDEMDMAGSQAGSPAQTGRKRETPRTADRQRAIADAKMWGENSRERKRPNGSFDSTNE

SEQ ID NO: 858 - protein, 253 aa, Triticum aestivum
AYITDSSISKECLQKVKVQYHMKAPIYVYYELDNFYQNHRRYIKSRSDKQLRYGLKYTDSSCSPIEKSDGLPIVPCGLIAWSLFNDTYDFTRGSMGIVVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYAYLITGSSSIFLSILFALIHVKIPRPHGDAAYLSWSRKNGNN

SEQ ID NO: 859 - protein, 462 aa, Triticum aestivum
MALALSTLPFAPSTPAPASRGSAAFRPRGAHFAPSPAGRSGGLGVGLPLACAAPRKNRGRRRRGGGLVVFAAADYYATLGVQRSATIKDIKAAYRKLARQYHPDVNKEPGATDKFKEISSAYEVLSDDKKRALYDQYGEAGVKSAVGGNAGAYTSNPFDLFETFFGASMGGGGGFSGMDQSAFRTRRRSTAAQGEDIRYDVILGFSEAIFGTEKDIILSHLETCDACSGSGSKVGSKAKICSTCGGRGQVMRTEQTPFGLFSQVSSCPTCVGEGEVISEYCRKCSGEGRVRVRKEIFFVCLDVEEPSDIKRDGINLYSTVSISYIEAILGTVEKVRTVEGSSELRIPPGTQPGDVLVLAKQGVPSLNRPSIRGDHLFTVKVSIPKRISGREKELLEELASLKNGGFARAPVKPKPVHKENGSRAAPEVSDQPDDGEGDWLKKLSDFAGSIVNGASKWLKDNL

SEQ ID NO: 860 - protein, 458 aa, Triticum aestivum
MACIPTGIRLPDLDMVKAAAAAAGAGVGPPGAGPPGAGPLRPAHSSASSALSDASNSSSASSLSLKRARTPRKRPNQTYNEAAALLASMYPSVFPAAPPSPRLLGLASALADDPSRADLLPPFPVLGNAACLLRDAAAPPPMTPRSPVLARACPSPAAVSSAFTELRDSAPSPGTPDGAGADGPGELDFEDDDDSFDADSFLLGGVDEGAAAQGIDGIMGKLSMESGSDASSINRVLSSSGIDPYIRNLMVLGLGFRRSRSNIKQALKRHDDDSEWWMCPAIPLKDIMPAPPPSMEPPPPVEKKKKKTKKKALKDIAAGPCITCVKEEIPDPAYGDDGIFGPKAPKTGLGLSLNTEEVLKAWYDRGSVFADGNIPDASSTDGLAKLSDIELFLENGAAGAIREGSIQKLKHKQKQCTPLLSNKTRYQARKVHAESRPRVKGRFVSQAALLQKAAEKET

SEQ ID NO: 861 - protein, 192 aa, Triticum aestivum
MKHLLLPSPLPLLLHGRASKPLLLHVRQRHRHALSAAPDGNSGDTSTAASEPPPTNTQPSPPPSAPPSTNSGTTSVKTRLRSRNQARRVQEPYLPPVEVKMMRGKGKANASAAPRREKEKRKKTWDEMSLGEKAYELYVGEKGALFWLNKFAYASIFIIAGAWILFRFVGPATGLYQLDAPPLAPTDVLRGS

SEQ ID NO: 862 - protein, 245 aa, Triticum aestivum
LITCTFLGISFDLLAPIPWIKHILKKFRKNDMVQLVPEENEEYRSMNNDEETNGLVSPLMSEREDSDILNGFEGHDLSMYPINRSFHMPKQKFDFAQYYAFDITIFALTMIYSLFAPLVVPVGAVYFGYRYLVDKYNFLFVYRVRGFPAGNDGKLMDRVLCIMQFCVIFFLAAMLLFFAVQGDSMKLQAICTLGLLVFYKLLPSGSDRFQPSLLEGMQTVNSFVDGPTDYEVFSQPDLDWNLYQS

SEQ ID NO: 863 - protein, 410 aa, Zea mays
MAMATTEATTLTALLKEAAAAFPTRRAVAVPGRLELTHAALDALVDAAAARLAADAGVLPGHVVALSFPNTVELVIMFLAVIRARGVAAPLNPAYTQEEFEFYLSDSEARLLVTNAEGNAAAQAAAAKLGLAHAAASLHDAAGPVHLAGLPAHAPENGSHGGGAAGSLSPNDPSDVALFLHTSGTTSRPKGVPLKQRNLAASVRNIRSVYRLAETDATVVVLPLFHVHGLLCALLSSLASGASVALPAAGRFSASTFWADMRASGATWYTAVPTIHQIILDRHASRPEGVPGAPIHPQLQRVAGAGDPGAAGGGVQRAGAGGVRDDGGVAPDDVKPAAGGRATEARVSGARGGAGAGGAGRGGAARGGGEPRGGVRPRGQRDGGLQGEPRGERGGVPVRVVPHGGHRRGG

SEQ ID NO: 864 - protein, 536 aa, Hordeum vulgare
MAAATTMTWHEELATLVGDTGVRLPAAAAPAPNSGAAAVGGGWYGEEEEGKVEEGWAQQARGFAESTAEMLRELGLGVWDVAAQSLAGAEDSELARRLRRPAAAAGKRLSFMNEYLPEDRDPVRCWAVVAAVAFVALLVLGVGSGDDTPVEQPKKLYISPPNAKRFQLPDGRHLAYEEKGISAGRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMVNPYDSKMTKDEKRKIWDRWSTKRKLMHILARRFPSLLRLFYHRSFLSGKQGQPESWLSLSTGKRDKTLLEAPMFNAFWEKDVAESVRQGDAQPFVEEAVLQVSDWGFSLSDIQMQKKEDQGVFEFIKSLFSQAEREWVGFLGPIHIWQGMDDRVVPPSATEFARRMVPGATVHKLLDEGHFSYFCFCDECHRQIFSTLFGTPQGPLNPVPEPSEVAREPTEETSPAYEEEEEEVAEQEQETSGLA

SEQ ID NO: 865 - protein, 645 aa, Brachypodium distachyon
MAMASTSSCSSRPPLLHPASRTPNPSRLPPLVSRASSSPRPLLLSFAPPARGRFRAAAVQQSDFEDGEEEWDGEVEEDYYSEEEEEEEGEEMDVEAMEEEARAAAADLAARLDRELRVDGDVREKRRTMRDKTSTSKHIPDNNLPKVAVIGRPNVGKSALFNRLVGSNRAIVVDEPGVTRDRLYGRSYWGDQEFMVIDTGGVITLSKSQAGVMEELAITTTVGMDGIPLASREAAIARMPSMIEKQAVAAVEEAAVLLFLVDGQAGLVAADIEIADWLRRNFSHKCIILAVNKCESPKKGQMQALEFWSLGFTPVPISAITGTGTGELLDMVCSELKNFEGLEGLDDVEEDENRVPAISIVGRPNVGKSSILNALVGEDRTIVSPVSGTTRDAIDTEFTTEDGQKFKLIDTAGIRRRAAVASAGSTTETLSVKRAFSAIRRSDVVALVVEAMACVTEQDYKIAERIEKEGKACVIVVNKWDTIPNKNNESTTHYELDVREKLRVLDWAPIVYCSAINGNSVEKIISAASLVEKERSRRLGTSILNQVVREAVAFKAPPRTRGGKRGRVYYTTQAAVRPPTFVLFVNDAKLFPEPYRRYMHKQLRSDAGFPGTPIRLLWRSRKRADKQRRKSNNTEARGSLVGASS

SEQ ID NO: 866 - protein, 1084 aa, Brachypodium distachyon
MEASASSTPQALTLLTSSPRFLSLHPSARRRGRGSGGGLLLRPPPHRRLELGYRANRPLGCSVSGSTDVSVDVLGGSVAAAAALLAALQLLWLRWRGARDGESPEVLCTQDKSIVNKELRTTTRSVYDSNYAPCATHENGFSEPSVSGGMTPEVECQAGIPCVDTVNTTTRAVSAITRGTSLQTLFDVSGKEEASCSTSAEKTSSTENIMNVLAMPHSLSQGQHTKYISNRMGWQGGLSRHFLSLSEQKEHAQIDKGPSDSKTDSENAHLLQCQQSDQEENLDLTSLSSFKRTVECPLNFVPQARTGNLFKSRKAIEFTDPYEGGSYLTPGKLVPVACLREGPASKQKKAVKDHDAAKTIGWTISDILSKENLENFIPAKTLGLNGTVDTSDYIRRYNSSLMDGRLKDCVDLLENMEQKGLLDMKKIHHASFLIACKKQRAVMEAVRFCRLIANPKMSTFNMLLSVCAHSQDFDGALQVMMLLKEAGLKPDCKLYTTLISTCAKCGKVDAMFEVFHEMVSAGIEPNVNTYGALIDGCAKAGQVAKAFGAYGIMSSKKVKPDRVVFNALISACGESGAVARAFDVLSEMTAEPSESKGWKPILPDHVTVGALMKTCIQAGQADRAREVYKMLQEYNIKGSPEVYTIALRSCSLTGDLGFALKIYEDMNKIGVIPDEMFLSALVDVAGHARRADAAFEIIKDVRAKGFHVGIMAYSSFMGACCNAKDWKKALQLFEEIKISRLTPTVPMMNALITSLCDGDQVQKSIEVLNELKEFGVRPNEITYSVLCVACERNGEAELGIDLFEQLKVDGIGLNPTIVGCVTGLCLQKFSNDLSLGNIIVRFNLGKPQIDNKWTTSAIMVFRQAITAGLLPSSDVLSQVLGCLRFPHDSSLKSTFIDNMGISCDMPHHPNTYSLLEGFGEYDVRAFSILEEAALLGAVASASTKHSQIVIDARKSKMYTAEVSLLMTFKSLKHRLAAGARLPNVTILLPTEKKQVDLDEREKTLKLAGRVGQAVGSLLRRLGIKYQGEESHGRMRINGLTLRRWFNPKFTSTPSTGTPAELLPLPSRLAKGIADQQRDIRSLSL

SEQ ID NO: 867 - protein, 405 aa, Brachypodium distachyon
MASSYNYPTTTSPATTINPSFPAPSAPPLYPTLTMADLAPVEIPTTPDGAPPPSEDVLLRLPGAQLHLIDRRRSHPLAAGDLSLRRIRAGDASLAATALLGPIQWPLARDVAAVKLDPRHYSFSLAVPASHDDPSPDPLHYGLTLSAPDPRLDAVLGAYTSFSVHSVAGSEALAGGARGEVEAAAYWTAVAPNVEEYGGAVAKAIARGAENVAKGIIWCGVMTVDRLRWGNEVLRKRIQPGDTDAEVSPEMLRRIQRVKKVTKMSEKVASGILSGVVKVTGYLTSSLANSKAGKKFFSMLPGEILLASLDGFGKISDAVEVAGKDVLSTSSTVTTGLVSHKYGEKAAAATNEGMDAAGHAIGTAWAVFKIRQALNPKSALKPTSLAKSTIKAGAADLRAKSSKSK

SEQ ID NO: 868 - protein, 470 aa, Brachypodium distachyon
MQTPTMSTSMAARATSAAANLPAPPPRQCYYHLLPPAGRRSVWALSASPKKKNPWLDPFDDGPDEDFDYTGVYSGGKQDEDPRPPEDPSNPYGFLRFPMGYNPELDSLASKVRGDVRRACCVVSGGVYENVLFFPVVQLLKDRYPGVLVDVVASARGKQVYEMCKNVRYANVYDPDDDWPEPAEYTHQLGVLKNRYYDMILSTKLAGTGHALFLFMSSAREKVGYVYPNVNGAGAGLFLTEMFKPPTTNLSDGGYNMYQEMLEWLGRPGKGVPQQPIPPLRVSISKKLRGIVEDKYSRAGVEKGKFVVVHGIASDSVANMTSRGDDDCLLPLEQWAEIAKAISSQGNGLRPLFVMPHQKHREEIEDIVGRETSYLFITTPGQLTCLINDSAGVVATNTAAVQLANARDRPCVALFSSKEKAKLFLPYAEDKKSCTVVASATGKLADIDIEAVKNAVKEFEPAPSFALAQK

SEQ ID NO: 869 - protein, 503 aa, Setaria italica
MAQLPSGSVVSGEAELVPTLSSLEPVYGEGSQLDEARLRFARLGDRFQAVYGARPALFARSPGRVNLIGEHIDYEGYSVLPMAIRQDMIVAIRKSDSSQVRVSNVDDKYPVCVYPADPDKEIDIKNHKWGHYFMCGYKGVYEYCRSKGIDLGKPVALDVVVDGTVPQGSGLSSSAAFVCSATIAIMGVLEKNFPKKEVAQFTCLSERHIGTQSGGMDQAISIMAKPGFAELIDFNPIHATDVQLPRGGTFVIAHCLAESKKAETAATNYNNRVVECRLAAIVLAIKLGMDTKKAVSSVTTLSDVEGLCVSFAGKEGSSDPGVAVKKLLHEEPYTAEEIEKITGESLTSVFKSSQTSLDVIKAAKHYKLFQRASHVYSEAWRVYAFRDTVSSKLSDEDKLKKLGDLMNESHYSCSVLYECSCPELEELVKVCRDHGALGARLTGAGWGGCAVALVKEPIVPQFILNLKEKYYKSRIDRGVIQQSDLGLYVFASKPSSGAAILKL

SEQ ID NO: 870 - protein, 700 aa, Setaria italica
MGFEGLVVVSDPYLQRRFTQADLRALQAKYAALRDASPSGRLRIRDLPAAISSLRGATVAAKGDAEKENSAPEAGPGPGLTDEEWASVLKAVARADERPQQDASFELFLRVYAEMQLRLKAAGASAGGKKAGGGIARSSSSSAVAFLTAATTTLLHTISESEKASYVGHINAYLAEDPFLKSALPIDPATDHIFHITKDGVLLCKLINLAVPGTIDERAINTKRVLNLWEKNENHTLCLNSAKAIGCTVVNIGTQDLAEGRPHLVLGLISQIIKIQLLADVNLKSTPQLVELVEDSKEMEELMSLSPEKILLRWMNFQLKKGGFQRTVTNFSSDIKDSEAYACLLNVLAPECSAKPSAMSVKDLLHRARLVLEHADRMGCKRYLTPKDIVDGLPNLNLAFVAHIFQKRNGLSKQMKQVSFVDGLSDDAQVSREERSFRLWINSLGISTYINNVFEDLRNGWVLLEVLDKVAPGSVNWKMANRPPIKLPFKKVENCNQVLKIGKELKFSLVNIAGNDIVQGNKKLILAFLWQLMRYNILQLLKNLRFHSNGKEITDNDILAWANKKVKDSGKHHSRMESFKDRSLSSGTFFLDLLSAVEPRVVNWSLVTKGEKDEEKQMNASYIISVARKLGCSIFLLPEDILEVNQKMMLTLTASIMYWYLKRPTSHSLDSENGSSCETSSTTTSDDSASESSFDDNAAR

SEQ ID NO: 871 - protein, 209 aa, Setaria italica
MSGLALCEVAAKSPCWSECSGSRLLAASRVRRGAVSCRWEKPGTFSLLWASPSYRRNSRQMQWAIRTMSDDSSGQPGNSTRLFSAIQSFWNKFSAKLKKARKGLATKIMFFLIGFYCATAFATVIGQTGDWDILSAGLAVAIVEGIGALMYSASFGFLGRIRNMVTMFNYWKAGLTLGLFLDSFKYEVDGLLDSCNPFNFEINIFTGLW

SEQ ID NO: 872 - protein, 126 aa, Zea mays
MAISVTAVAALSAFSAQRSLPQPYRQRVVTFIVVRPVRAHRRFVGVAASSPPTPPDLAKKVSESIKQAQETCADDPVSGECVAAWDEVEELSAAASHLRDRQKGADPLEEYCKDNPETDECRTYED

SEQ ID NO: 873 - protein, 553 aa, Zea mays
MAKKKEKAVNVSGKPRHSNDVNRPNDKKGAGGGAGGGSRSAATVRRLKMYKTRPKRDRSGKVLRNDFQSKELPNTRIEPDRRWFGNTRVVGQPQLEMFREELQSRLSDNFSVILKERKLPLSLLQDHQKQAKAHLLEVEPFEHAFGPKGKRKRPKLTALDYESLLKRADDSQDVFEQKYASSKLPREEEEDGLRDLVRHTMFEKGQSKRIWGELYKVIDSSDVVVQVLDARDPMGTRCYHLERHLKENCKHKHLVFLLNKCDLIPAWATKGWLRTLSKDYPTLAFHASINKSFGKGSLLSVLRQFARLKNDKQAISVGFVGYPNVGKSSIINTLRSKSVCKVAPIPGETKVWQYITLTKKIFLIDCPGVVYQNNDSETDIVLKGVVRVTNLADAAEHIGEVLRRVKKEHLQRAYKIQDWSDDNDFLVQLCRTTGKLLKGGEPDLTTAAKMILHDWQRGKIPFFVPPPQQSDGGASESAEQPIGITKEDGVSSDRTAAAMKAIAGIISSQQNMNVPCHKENNADNEDTENADNEDIESSDNEDNDDIEPAERSE

SEQ ID NO: 874 - protein, 353 aa, Zea mays
MATITAAARWSFPARLQFLTSRRFCFPASSAAPPTSVAGFSWADALRVAGDGGRGDESDLSGYFRKVKSCNRGMDKKGQFVEFSVEDQVVGYIHKGFIEHIRDFHDVFTIVMDDNGSNTVEHVSLQSSLRTPEDRTHAIGSVIKSLGELIPGIRNELYPVTSSYGMPVYFSLERAAAPYFGIKAYGVHMNGYVEKDGQKFLWIGKRSDVKQTYPGMLDHLVAGGLPYGMSCKENIIKECEEEAGITRSISTNATSVGAVSYMDIEGFRYKRDVLFCYDLQLPADFVPNNEDGEVDSFRLVPVIHAANIIRRTDFFKPNCNLVIIDFLFRHGYINPDSRGYLDLLQSLRSGDCS

SEQ ID NO: 875 - protein, 261 aa, Zea mays
MPPAAAALLRCAPAVPFAARSSAVSRSGMARRLVAASAAAGRLAPAYRGLLLDAGGTLLQVARPVAETYASIGRRYGVTKTKKRIMEGFKRAFSAPWPKTLRYQGDGRPFWRIVVAEATDCTDGDYFEEVYQYYAHGDAWRLPTGADAALRELKDAGVKLAVVSNFDTRLRKLLKDLNVSEMFDAIVVSSEVGYEKPSPEIFKIALDQIGVEASKAIHVGDDETADMAGANATGLECWLWGKDVTTFSEIQERILTTDDPQ

SEQ ID NO: 876 - protein, 442 aa, Zea mays
MASSCIPAGGIRLPDLEMVKAAPPAHSAASSTLSEASSASAVSSSATSSSVASLSLKRPRTPRKRSSQTYNEAAALLASMYPSVFPVARGGAAPRRLLGLASALADDSSCSDLLPPFPVAGGHAAFLLRDLPPPSLPLTPRIPAAESCPSPAAVSSVFSEFRDPAPSPATPDDAAAAPDEPRDLGFDDDDGFDADSILCGVDQSAAEGIDGIMGKLSMENNGASVSGSSVDSNMPGSKMHPYLRNLMVLGLSFRQDQNIIINQALKRHSVDPEWWMCPAIPVKDITPAPPPSVAMAKVTDKKKTKKKSLGTIYEEGSPEPANGDDDGALALPETGLGLSLNTDGVLKAWCGRGSAFADGNGPDLPLSPAHVVVKHEDNDLFPKNGTGAVIREGNILKMQRKQKPCTPLPSNKQSRYYRPRVKGRFVSKACFLQRQQALEKES

SEQ ID NO: 877 - protein, 118 aa, Zea mays
MCSGSWSWSSSKKRKRPSLVVVNLKRRQLQKTPPPTPPRSSVAIRRKRLRLRRLRAGAEAMEMVNLKLYLENRCIIAENEKLRERASALRRENLALLQDLSKTPAVPEAGAGAGAGAA

SEQ ID NO: 878 - protein, 212 aa, Zea mays
MHPVPVPSQPFTATPAKKLVSRSTAVRKAIHFVNLWTAGRSSGNLAMNSVPKPAPGSETSGREDFAVGDKDAVVIVDHGSRRQESNLMLNDFVEMFRAKTSYRIVEPAHMELAEPTIKDAFGKCVQQGASRVIISPYFLSPGRHWKQDIPALAAVASKEHSNIPYIVTAPLGLHELMVDIMNDRIKYCLRHVAGDVDECTVCAGTGKCRMYS

SEQ ID NO: 879 - protein, 197 aa, Zea mays
MAASNGGGGPGPISAEAEAALGEAIKLVFGRWTALQMAVENQWGGRDSRAKADQLGESILFWFCRTKGPYYFEDLVDMMYDKISESFNAYFEDNSIEEVAEQFLIIHEECLQNNYSSIEKLRNSHVPGNAVSQSRQIVGDEDDDSDSSDDGDDTSMVADEEAGPEEMAVDRPRPPKPTPDADGWTVVPPRRGGRSKK

SEQ ID NO: 880 - protein, 1086 aa, Zea mays
MPAAKYLGPGALAEDRRQDLHRQVGCVTGILQAFDRRHPLASSSHKRLLPPTGHAVSSNPSKEGDCTRYSPQIVLVNSSKTWADSQRAPATELSQTSYSSSPSSSLSSLDGNKSTQQDLSSTDRMLFPERPFKSSPKLKSYFDSDTGLDYPDDALTKSKDMPIVQASLPTLGIRNLVKDSIYMNSRELSVRICTEEVTDHPSNCGDQPRELNGPPRDSTQEKSKGLVDINESLRVLAKLREASWTPAESVHHATLSYDAPRFSYDGKEAASKLREVPRLSLDIKESHLRNGEIDSRSNPSLSSTDRSSNTVIGSNAAFEIQQKQPACKRLPSVVAKLMGLEELPEHNQSIASSHACKTVQGSKQEAMLNPLSISSHNEHALRQQRNHDSTVRNLPNSKFPVETAPWKQQERIVLPRKLPKGSKGAHGREQPAASVISDIEKRLKDLDFRQSYKDLRALKHILDSMQAKGLLENKNREEISMPKLSDGNHNGQEIASVNMRVNSNTNNVCMPEESNAESSFKSPIVIMKPSKCANLFNEVDSSVFPLGGSSDPPQPQTSNSTYRRKASTRNRTAKEPHAKFSSKVPTSQPLVSYDRRSYVRNDDSSNNQKSSSLLVTESSSRRQQLPRDSSISMKKNKHSTTPRLQQRKLGSERRARPPIPCAESNKSQRQSGDRNNAETVSPRSKFRRKLLCPQEGDDGMPSGLNNRTRSLNQHGNDMSTRSDGSITVASELDIISNDRSTEVDISNFDQGIGTPSGRNPQKVKTSYDASKDVPSVDPSAGISERPSPVSVLDSSFDHEDLFPSSRNPNSLAVDDERQTLGEPWKPSVTKPTEVGMQSKNNKLANVVSLLQKLQQLSVSKDEDAPPVDHMAFLCETESPDHRYVSEILLASGLLMKELGSGQAGLQLQLHSSGYPINPDLFHVLEQRKAGWASIPDGIHQSRSGAKSDPKRAHRKLVFDTANELLLQKFEKETTVYAVSSSTGAKDHPPAKALSGQQLLKFVSSEIEGMGTERSSTCQMEGGVIPDAEILQRLQGWTSFSRELPGMVLEIERSVFKELVDEVVHGESADGPEMKAAGRRRRRRLFA

SEQ ID NO: 881 - protein, 100 aa, Zea mays
MLLARAMVMEHRKKSNYLVALVLASLLLSAMAGGHRKKLLNKDDASESMETLESTQQLQEDDEMAVVVHERILRQAKMNDYGSYDSSPTMAKPHFKDIPN

SEQ ID NO: 882 - protein, 267 aa, Zea mays
MDKDGSSERSRPDHGDVKMLKFKPKVPRQKQKPKQQDPKPIDEDVMKILRTRQVAAKSAPNTEDECSPQKTLSTPPSADVVCLSPAQLGVQKQNQLPLQIPRSFPVPVNSGLVYEEESSDDDDDNDSDNVGLLETQPDSIESEALTCPAEELDLLQEGSKERMFFFQFPNSLPLPKRSSSAGKEVMEGSNLQQLPQGYLGKMLVYKSGKIKMKLGDIIFDVNPGVESRMLQRAVALNTRDKHCCLLGEIENRHVIVTPNVDSLLNDK

SEQ ID NO: 883 - protein, 475 aa, Zea mays
MPRTTVVESPGCPPLRALTTDILGLVKVVEAHARPAGAAKVVETWGAPDASCAIVAASLADRATDPVLAVARKNGVVELLNPLNGDTLAAVKAVGPAPNDGGAEGDPLTALHLFTRQASDSILGTFLACTEQGKASIRSITKENAASGSHIEPSATWDVCGGANVQFCSVDHGENYVMFGGKGIEVSLWDITSCSKTWSAKSPRTNSLGIFTRPWFTAGTFLCKDDHRKIVACTNSHQVRLYDTALQRRPAISVEFKESPIKAVAADPNGHDVYIGTGTGDLASFDMRTGKLLGCYFGKCSGSIRSIVRHPDLPLIASCGLDSYLRIWDTNTRQLLSAVFLKQHLTTVVLDSHFSVEEPGEMKSKQLESSVETETEVRKEKKKKSKAITEDETEAQIRKEKKSRTIEEEEQAGLVDHSDINDEVYARKEKKKKKSRGIEGGKERDSDGEICSPKRRKSGERSKCLKKRSKKQLVA

SEQ ID NO: 884 - protein, 129 aa, Zea mays
MAKYNVVQKNKRQCNQDRKRAAHGEPGTGKLKQRTAPVSMSGKRKKKLERRLNRKQKEAAMIKALENNMGDVDMISVEGSSEAAKGKSQVKFSVKKNSRIQIKRLKGKGRKKAKNSKPPAKERVDAMVE

SEQ ID NO: 885 - protein, 235 aa, Zea mays
MATYLNAPPAATTTTASCRHAFSGGSLRLLRPSRPTLHVTCQAAVSSSSSSQPPSSPSRRSACLLGIACAVLLRPRAASAAETDEEPANNGWWLTEFPLPVPKIVNKEINNAETGTRSFLKNGIYMADIGPSFAAHAYRLRSTAFDLLALEDLLGKDASNYVNKYLRLKSTFMYYDFDKLISAAEDKPPFVDLANRLFDSFETLQEAVTAKDDARIGDRYAETKLILQELMAKMA

SEQ ID NO: 886 - protein, 255 aa, Zea mays
MAIDDESPLRVNTRGGAMGGGERDGAENQRWPPWLKPLLGTSFFGQCKLHADAHKSECNMYCLDCMNGALCSQCLAYHRDHHAIQIRRSSYHDVIRVSEIQKVLDISGVQTYIINSARVVFLNERPQPRPGKGVTNTCEVCERSLLDTFRFCSLGCKIVRTSGDFRIRKKHAIVAKKKREKKHAPPQQQQHRGAADSADDDDSSTSTSGGSDKSSVVQSFTPSTPPATTANSFRAGKRRKGVPHRSPFGSLVVEF

SEQ ID NO: 887 - protein, 920 aa, Zea mays
MTTNTKRAYKLQEFVAHSSNVNCLKIGRKTSRVLVTGGEDHKVNLWAIGKPNSILSLSGHTSAVESVGFDSTEVFVAAGAASGTIKLWDLEEAKIVRTLTGHRSNCMSVDFHPFGEFFASGSLDTNLKIWDIRRKNCIHTYKGHTRGVNTIRFTPDGRWVVSGGEDNIVKLWDLTAGKLLHEFKCHEGQIQCIDFHPHEFLLATGSADKTVKFWDLETFELIGSTGPETTGVRSMTFNPDGRSLLCGLHESLKVFSWEPIRCHDTVDVGWSRLADLNVHEGKLLGCSFNQSCVGIWVVDLTRLEPYTMGTSTKVNGHSELKTVSSGTLPLQNDSGSRANIGRSSVLQNTENNLKTTSGRLSASQNSDSAPKETNSAPSSGLIPSTPHRAGVGSHNRSVGNSAFQSGGTTLKRSSLRNNSASNVHNFSKADVVPVIVPRTSSGGELATDSRSDAADVAPVLPKVTRRVEPATDSRKESNDVELVVPRASSRMEIADLAPISSSKSGRRLESAPDSKEESADTAPVVVSNPRANVRMEIVSDSAPALSKSNRKLDSGTNSKKESADAVIVPRTNSRMEMISDSRREPSAGRISPFRIQSRYAEPRKLAHARTDSNKVDSRSKITETEDFNCQIFLPRRNSVFQTISSEEPREDVKCGPVDRVGFSNSSEPNASVRNENYVPRMRKPGDNCYIEVSRAGRARSSVSNWEGRDQPPSHEEPTTSSSTLAPTGHPYSSRGSNQASEAPIIASDEDVLSLIMERHDLFLSSTKSRLMKLQIIHQMWERNDIRGVLSAMDRMGDHAVCADMASVLMEKSETITLDLCTSILPVVTDLLESKIDRHLVVALELLVKLVRTFGPMIHSTVSSGPCVGVDLEAEQRRERCNLCFIELEKAKNKLPSLTRRKGAVANAAQELALVFQEIMS

SEQ ID NO: 888 - protein, 133 aa, Zea mays
MDGKSFSNEQQAQQKNPDAVTNSVPSQGQEPLNTFPDSDDGNTNTGPLNGHAAAHVNMEAAISTEDVIRAGGFGAKDDIGSLLPTAIDSTDFEASLRDARGFEGEKAAPSHPGLGWKGEKADGGTKLADVAKQ

SEQ ID NO: 889 - protein, 446 aa, Zea mays
MVTSDPDGNGGAPDVSELFCHYNSLYFRDSLGSCAVSWTEDPLPDCDVSTCDYYPGGGGCIILLSKSLCGSHNGSDLKNALLHEMIHAYICIKDNNSNHSDHGAKFQKLMNTINLSSVADPHRPVDGYSITLLHEIHKKYYHYKCQSCADFIKSTNMRGPSGDDCIERKGVDDPCHNSNCHWHRHKQQCSGNYCRVQESSPGGPELKCLEAVEAYNEGKVEEPACTSWHTTHTSNKSRRSNKNEREDASVEFLHVADNAVVCSGLDSSSKDRSNKKIKISKDVNSDLGRTETVQEAPKRRRTAVLDNQECSRRKKRKQSNRCGSYSVIIEWLNYYCLSESDEDEVPLINKRTERRRRQRLHEMYLARESNDVEFGSSTSHTVGSCSLAPKDNNKGEIVPSSQPEERSCSSHPVSSNGVAGNQAGHEHMSSPTDSPIRGEIVDISDG

SEQ ID NO: 890 - protein, 197 aa, Zea mays
MELCVSTPPSSVRATAAPIFFAPPRRGASASTAVPPHRRIPTRGWRCASAAVPGPVPSEEPASASYAVVVTDKPDTPADDKAEEVSAAPSGSAEAPMAELVPSEASPSPDDGGLDEILSKLNIEVSPTLLLTGFGAFIALWILSSVVAAVDSVPLLPKLLELIGTAYTIWFIARYLLFKESRDDLFAKFEDLKQRII

SEQ ID NO: 891 - protein, 802 aa, Zea mays
MPDVMAAALTGFSPRGVIPSRGRASLPGVARAYAERRLVAENTSLPNMHKEDLETIIRNQLRKPQLPPSSYDTAWVSMVPVRGSHQTPRFPQCVEWILQNQQDDGSWGVSQSDSSVSKDVLLSTLACVLALKRWNVGRENIWRGLHFIGRNFSVAMDEQFTSPIGFNFTFPGLLSLGIDMGLEFPVRQTDVCGILHRREMELKRLAVDSSFGRKAYMAFIPEGFGNMLDWDQVMKFQRKNGSLFSTPSTTAVALIHKYNDQALQYLNLLVSEFGSAVPAMYPSMVHCQLSMVDALEKMGISQRFVSEIESILDMAYNCWLQKDEEIMMDIATCAMAFRLLRMNGYNVSSDELSHVAGASTFHDSLQGYLNDTKSLLELYKTSKVTLSENDLILDRIGSWSGNLLKDKMCCSRVQKDSIFGEMEYAVNFPLYSTLERLEHKRNIEHFDAWGSLMLTTKSSSFRINQEFLALAVEDFSFSQRVYRDELRHLDSWVKENKLDQLQFARQKLTYCYLSAAATVFSSELSDARISWAKNGVLTTVVDDFFDVGGSKEELENLIALVEKWHAHHAVEFYSEQVKIVFSAIYTTVNHLGAMASAAQGRDLTNHLVEIWLDLLRSMMVEAEWQRCQYVPTVEEYMTNAVVSFALGPIVLPALYFVGQELLEHAVKDEEYDKLFRLVSTCGRLLNDYQSLEREGNQGKLNSVSLLVLHSGGSMSIEAAKKAMQKSIDVSRRDLLRLVLRKESAVPRPCKELFWKMCKILHLFYSQNDGFSSPKEMVSAVNAVINEPLKVQNSTTFLSSSSR

SEQ ID NO: 892 - protein, 711 aa, Zea mays
MKALASPAASFLPGIPSPSPSHLARAPPRSAAAALSRPPSGRSVAAAAAAATGDHWGADHQHYHGGRAGASEAGPTASARGVKCDVDVVSWRERRVLASVPVAADVDTLWQVITDYERLADFIPNLVQSVTIPCPHEGRIWLEQRGLQRALYWHIEARVVLDLQEIPDSINGRELHFSMVDGDFKKFEGKWSIRSGPRSSSAVLLYEVNVIPRFNFPAIFLERIIRSDLPVNLRALACRAEKIYLENQGCGSRKFSVEDLKPSYTSQLNNYHSTTVETSKFKQAPPRSGVSSVLPSPSSELISKWGVYGNICRIDKPCVVDEIHLRRFDGMLEHEGAHRCVFASITVKAPVREVWNVLTAYENLPEFVPNLAISRIVLRDNNKVRIMQEGCKGLLYMVLHARVVMDLCEKHEQEISFEQVEGDFYTFKGKWRLEQLGDQHTLLKYMVETKMHRDTFLSESILEEVIYEDLPSNLCAIRDYIEKAGAKSSNSTDPDPDVDHDESRQSEQTCVSCSSSTMKQRPKVPGLQKDIEVLKSELDNFIAEYGQYGFMPKRKHLRSHGRVDIEKAITRMGGFRKIASIMNLSLSYKNRKPRGYWDNLENLQEEISRFQKIWGLDPSYMPSRKSFERAGRYDIARALEKWGGVQEVSRLLSLELRYPRRQADPDDERQSESPSGMMKKHGVKPDEGNVSPNAQKWLLKLKDLDVNWVEY

SEQ ID NO: 893 - protein, 277 aa, Zea mays
MSSGEDGYCSSDSPRAESPDQPQAAAAADADADAESPRAGAGPNKRDLHASSPAAKRSRRSVEKRVVSVPLAECGEGPPPSDSWAWRKYGQKPIKGSPYPRGYYRCSSSKGCPARKQVERSRADPAVLLVTYTFDHNHEAPRPKSSCCHQQGRPPAPKPDEPVAEQEDELGPEHEPEDEQEPEQKVVPGLAGPETAPATATLAPVAEEDESFDLGWFDQYPTWHRSALYAPLLPPEEWERELQGEDALFAGLGELPECAVVFGRRRELSLAATAPCS

SEQ ID NO: 894 - protein, 241 aa, Zea mays
MDDDWELLLASPKAASAAEPYAGGGEDDAGAIKHDYFDLGSDAKYPRRASLSTGDEEEGVEEGLLRASDSASWVEPDPDDLLFPGRDRAALWSDSSSDGERPEVEATDPVERAREEAGVTAAAADGVEGAVAKGGEHVRWWKLPLDALRVWAMRAARSAWSVPFAVALLGFAVLGRRLYRMRRQSKAAARVRLVFDEMKASQFKGQSSRLNESTTMVRRTPFIKPMLPANGVTPWPVLGHL

SEQ ID NO: 895 - protein, 345 aa, Zea mays
MDEASTSASGAATRRGFVPARSGVFYRFTQQNLPAWKPAMTPGCIIAMFLIIGIIFIPFGLLCLQTSNHIAEIIYRYDVDCVPDAYRGNRQAYIKDSSISKNCTLEAKVLEYMRAPIYVYYELENFYQNHRRYVKSRSDKQLRFGAKYTADSCSPVEWDNNGSPIVPCGLIAWSLFNDTYGFTRGSKEIKVNRKNISWKSDREHKFGKHVFPSNFQNGTLIGGGKLDPTVPLSEQEDLIVWMRTSALPKFRKLYGVIEDDLHADETISVLVGNNYNTYTFGGKKSIVLSTASWLGGKNDFLGHAYIVTGSLSIIISILFALIHVKYPRPQGDPNCLSWNRKNSNS

SEQ ID NO: 896 - protein, 218 aa, Zea mays
MEVGRTPRRRASPAAAPVPSLLLFAVLFVGRAAAALGGPAPALYKHASFFDRDGDGVVSFAETYGAFRALGFGLGLSSASAAFINGALGSKCRPQNATSSKLDIYIEDIRRGKHGSDSGSYDAQGRFVPEKFEEIFARHARTVPDALTSDEIDQLLQANREPGDYSGWAGAEAEWKILYSLGKDGDGLLRKDVARSVYDGTLFHRLAPRWKSPDRERS

SEQ ID NO: 897 - protein, 96 aa, Zea mays
MAIRGVASTREEDMTLEEFKEWLKQFDADGDGRISRNELREALRRRGRGRGWLTAWRSDRALRHADKDSSGFLDDSEIENLVAFAQKDLGMKISTW

SEQ ID NO: 898 - protein, 714 aa, Zea mays
MGQDAGFKREDHSGLGSGPQTLKVSCCTSEENESRNRRYHQLKCSESNSGQLHLDYVPNFHCRSLPTRSRKTNAEQSTVGKRGSMYQSSSEISRIRKIQEGRRKIDSAFDGDAFLSFDIVDASSRPSTSGAYLHSHQNRRSGAKPSVDTAKRASKDFLDLQFREHPDENFKLDRPRLDSTLLKNDDGFLEISLEKEIAKGGPCRNAAPILLNTGSGKCTDLQKMNGCPSENNCGDKGRDSASSSKSTPVKVSSFDGTCQSDGAQHHITENNTKARSSPFKKMLDPIMKSKSPRSPSIMERGGSNSAAGPGSRKNSVSRKSLLGDFSRSEQASNCQPNGQTQQRVNKSALSPAHLQAVLRLDSKNGVQVFEFCVDGPGESISARNWKNGDELSSIYTFHSGGKRSSAAGRISKDGGWDLPPIVGQVQVSSYLCSEVGKDGTVNNSVVTEFVSYDIGHARRIVEEKTGALQQPQRTSLTEENKTGRNNSDVSTSCPWSEEDLHPYLEIAATVIEVPFSRYKSEEVKNGSSPCTVKVVAPSGLHGSPSDDEAGGPSPLLDRWRYGGGCDCGGWDMACPIDVIGNTYDNSWAESIATNVKHPMELFVQGSKEELPVLSMKENGRGQFVVDFHGRLSALQAFSVCISLLHCSEASIAISLKKGKQKLYSSSLKLLLEEDVRHLIEAVTAEEKKKKKRSREKAPPPSVLLDPPFSPIGRV

SEQ ID NO: 899 - protein, 183 aa, Zea mays
MKHLHLSSSLPLLLHRPSKPHLLHHSRRRASIRNAASGGGSGEPTPAAETASGTSPPAAAKPAGVKDRLKARNQARRVRLDSPPPEVVVVPKKKPAPAASSSPAPKKKVGRKGWEEMSLGEKAVDLYVGEKGLLFWLNKFAYASIFIMVGAWVLFRFVGPSLGLYQLDAPPLPPTAVFSGGSP

SEQ ID NO: 900 - protein, 268 aa, Zea mays
MGQDVVAHVYDVATAGSDTTVLHINRFFKDAIGLGGIFHTAIQVYGDEEWSFGYCERGTGVFSCPPCKNPMYTYRESIVLGKTNCCILKVNQILRELSWEWPGHSYELLSRNCNHFCNTFCEKLEVPKLPGWVNRFANAGDAALEVAETTAGKLKQAKKEIVTACKAASTFLTGTSSSASSNAEDTGGSTSTGNSLFEGAWIRSIIGMTMKPSKSLVCVDSSDSDSSGSESESDGDRPNSDDNAERQAKGVKQERGTKKKNNGPHCHS

SEQ ID NO: 901 - protein, 249 aa, Zea mays
MEVVGGVSLRPSPAPARIRTTLPPVDVGGRFLLRRVAGRQPARRALVVEARGGRGWSERQMQQQRRAPLLPKIEDDGNPRFVIFIRTANVYFWYPLNIITGGTTAKIMLAAKDNFLGRYIYKDTLARNLAAVIYKDEDEIIDTAKEQYRVLKTENEFRYGYKVVEKGNIRSALTTSNVIELPKKDELKTVVDKVKDFFGDVTAGAKESFAQITGSAVSKEEEEAESKEKFRSKRRKKQRKSKEGLKTEK

SEQ ID NO: 902 - protein, 80 aa, Zea mays
MSCSSGKCNCGSSCSCGSSCNCMSPDVETAAASSIKTMVLAAPTTKASAGGFEAATEGGGCDCNTCNCGTSCGCSCCSCN

SEQ ID NO: 903 - protein, 189 aa, Sorghum bicolor
MAGSARSSAAAKHAYRMFAPSRGGGAATRGPGAGAAEEFDESDVVWGSFGGGADSHSSPGAELQAAAGWARPIPASRAGAGRKKPAAVDGGGAAGSLPMNIPDWQKILGVEYRDHYRAGEWEPDADDDDHGRSRGGGGAGAEMVPPHELAWRSRAASMSVHEGIGRTLKGRDLSRVRDAVWKKTGFEAD

SEQ ID NO: 904 - protein, 125 aa, Sorghum bicolor
MARIHLVAVAMAMLLAVATAQAPGASPTPAPRAQPPATPPPAPAPAPASPPPASAPAPSPTQKPAPAPAPKATAPAPEIPASPPAPSSIGQTPTEAPTSPPPPSDASSVSPALFLAAGAAVAFFF

SEQ ID NO: 905 - protein, 477 aa, Sorghum bicolor
MKMAHLITNCSFSTSAVQTFSSSPNYCRSVGQLQNSKSSNLSLKSCSRRQKKSYVSCASAAVQGQTQTPLTGSQQAYEHSSSKPKKVMVIGGDGYCGWATALHLSNKGYEVAIVDNLVRRLFDHQLGLDSLTPITSIQNRVRRWKSLTGKTIQLFIGDICDFEFLSEAFKSFEPDAAVHFGEQRSAPYSMIDRSRAVYTQHNNVIGTLNVLFAIKEYSDECHLVKLGTMGEYGTPNIDIEEGFITITHNGRTDTLPYPKQASSFYHLSKVHDSHNIAFTCKAWGIRATDLNQGVVYGVRTDETALHEELSNRFDYDGVFGTALNRFCVQAAVGHPLTVYGKGGQTRGYLDIRDTVQCVELAIANPAKPGEFRVFNQFTEQFSVNELAKLVTAAGAKLGLEVQTKSVPNPRVEAEEHYYNAKHTKLIELGLVPHLLSDSLLDSLLNFAIQYKDRVDTAQIMPSVSWKKMGAKPRTVSV

SEQ ID NO: 906 - protein, 339 aa, Sorghum bicolor
MAGTWVKMEQKGGGPGARSSHSITLVGHTAYSFGGEFTPRVPVDNTMYAFDLATQTWSALDDATGDVPPPRVGVTMAAVGATVYTFGGRDLEHKELNELYAFDTATRAWTLLSSSGAGGGPPHRSYHSMVADAEGGRVYVFGGCGDAGRLNDLWAYDVASGRWEELPSPGEACRPRGGPGLAVAGGKVWVVYGFSGEEMDDVHCYDPATRAWAVVETTGDRPSPRSVFCGAGIGRHVVVFGGEVDPSDLGHLGAGKFSAEAFALDTETRAWTRLVDDDDKAEAEAEQQQHPGPRGWCAFAAGEKDGRQGLLVYGGNSPTNDRLDDIYFFAPVLEAAAAS

SEQ ID NO: 907 - protein, 170 aa, Sorghum bicolor
MSGNGVMKKVSDAATKAGKAIDWDGLAKMLVSDEARKEFANLRRTFEDVNHQLQTKFSQEPQPIDWEYYKKGIGSKVVDMYKEAYESIEIPKYVDTVTPQYKPKFDALLVEMKEAEKASLKESEKIEKEIAEMKEMKKKISTMTADEYFAKHPELKQKFDDEIRNDYWGY

SEQ ID NO: 908 - protein, 346 aa, Sorghum bicolor
MFPMASSSLSPPPLSLILLRPLPCRPVLLSRQRKPFPTVRVEARPEQRLQRRPVTGRWRRGGGFACFSYNANNKTPPPSDKSSDKWAILRRWDVPWEWQTVVLSMVGCGVSFVLTGLVEQSALQYLGFKAVEATIDEKAEILFFGQLSVTVVVLGVIFSITNTFRPFPDDVFRYDIKEPFKLQNGWLLWAGVGLFGAIISIALAGAAMTYLNGETPERETDSLVLLLPLIGSSTTSTAFLVGITGVLAPLLEETLFRGFLMVSLTKWFPTPFCVLVSAAVFALAHLTPGQFPQLFILGVALGFSYAQTRNLLTPITIHAFWNSGVILLLTFLQLQGYDLKELLGAS

SEQ ID NO: 909 - protein, 859 aa, Sorghum bicolor
MASPAGGGSPAKPVLLHGDLDLWILEARLLPNMDMFSEHVRRCLAACRPPSSCGTKHPTAAARGPGGGRGGRHHHRKIITSDPYVTLSVSGAVVARTAVIPNSQDPVWEERFAVPLAHRAAELEFQVKDNDTFGAQAIGTVTVPAERVVSGDEVEDWFPVIGTNGKPYKPDTALRLRFKFQPIANNPAYRHGIAGDPDHRGIEDSYFPLRHGGQVTLYQDAHVREGDLPEIELDDGKTFQHNACWEDICHAILEAHHMIYIVGWSVYDKVRLVREPSPSRPLPEGGDLTLGDLLKFKSQEGVRVCLLVWDDKTSHDKFFIKTGGVMATHDEETRKFFKHSSVICVLSPRYASNKLSIFKQQVVGTLFTHHQKCVLVDTQARGNKRKITAFIGGLDLCDGRYDTPEHRLFKDLDTVFQNDYHNPTFSAGAKGPRQPWHDLHCRIDGPAAYDVLLNFEQRWRKATKWRDRFRRVSHWKDDALIKLERISWILSPSPNVPNDHPSLWVSKEEDHEKWHVQVFRSIDSGSLKGFPSDSKEASKLNLVCRKNLVIDKSIHTAYVRAIRSAQHFIYIENQYFLGSSYAWPSYVNSGADNLIPIELALKIASKIRAGERFAVYVVIPMWPEGVPTAASVQEILFFQAQTMEMMYKIIADELKAMDIKDMQLEDYLNFFCLGNREEPPSNGSPESEKSTDKSAAGLATKYRRFMIYVHAKGMIVDDEYVILGSANINQRSLAGSRDTEIAMGAYQPHYAWSTKNGHPHGQVYGYRTSLWAEHLGTVDDRFKDPSSLECVRRVNQIAVENWQRFTAEEMSTLQGHLLKYPVKVEADGKISSLPDQECFPDVGGKILGASTSLPDSLTM

SEQ ID NO: 910 - protein, 330 aa, Sorghum bicolor
MAAALAASSAEAALLLLVLLVRLAAVALRCGEGLSLALYDESCPEAEAAVTAAVRQAMANDRTVAAGLLRMHFHDCFVRGCDGSVLLDSTGTVTAEKDGPPNVSLHAFYVIDNAKRAVEAQCPGVVSCADILALAARDAVALSGGPSWVVALGRRDGRVSLANETTTLPGPTASFEQLKQAFHGRGLSTKDLVVLSGAHTLGFAHCSSFQNRIRLQDQGTDADDPSLSPSFAAALRRACPANNTVRAAGSGLDATSAAFDNTYYRMLQAGQGLLSSDEALLTHPKTRAFVALYAASQEAFFRAFAKSMLRMAALNGGDEVRANCRRVNSS

SEQ ID NO: 911 - protein, 262 aa, Sorghum bicolor
MRRYSPPYRSPPRRAYGGRGRSPPPPRRGYGGRNKEGSGSLLVRNIPLSVRAEELRVPFERFGPVRDVYIPKDYYSGEPRGFAFVEFVDPYDASEAQYHMNRQVFFGREIAVVLAAESRKRPEEMRSRARVRGYSGHEGRRSSYYGRSRSRSRSPRYRGRPRSRSYSPAPRRRDDYSASPRRKEAHRTSPPRRPPKEHDEDKKRRSYSPASRDDADNGYEKRSPPADSNGSPPHRRSPKEEYSGSPPGSRSRSADESPVRSD

SEQ ID NO: 912 - protein, 422 aa, Sorghum bicolor
MSALLDLLMGILRQQTIGGAALELAAIAAPLWLAALVGLLIGWAWRPRWAAAVGGGGGDNNAQHQAAAHLLPTPPPPPPARATATAVVSRNEAPAVVPRTVVAPAAAAPEDEQLAVNTGDLMHLWRLVEEKDGGPSWIHMMDRTLPTMRYQAWRRDPPNGPPQYRSSTIFEDASPEVVRDFFWDDEFRIKNSWDDMLLQHETLEECARTGTLVVRWVRKFPFFCSDREYIIGRRIWASGKTFYCVTKGVPRPSVPRHNKPRRVDLYYSSWCIRPVESRKGDGSMTACEVLLFHHEDMGIPWEIAKLGVRQGMWGCVKRIEPGLRAYQVARTAGEPISKCAAMAHVTTRFNADELITEENTEGSSSNNTEVEKPKHWTNNIPKVLMIGGAVALACTFDGGLLTKAVIFGTARRFAGPGGPGRR

SEQ ID NO: 913 - protein, 299 aa, Sorghum bicolor
MAPPPATVAAVRHHSPHLLLRRGGGGLLPPPPAPATLPFATRGVASAPARLRLPPPRFSLSPVPKSLSASSSSHVPVRSLFTGIVEEVGRVRRLGPPLAPSSGGGGGEAPGLDLEVETRDLLTGTQLGDSVAVDGTCLTVAAIDPAASTLTFGVAPETLRRTSLGGRAPGDGVNLERALTPSSRMGGHFVQGHVDGTGEIAAFRPDGDSLWVTVRAPPEILRLLVPKGFVAVDGTSLTVVSVDDEGGWFDFMLVRYTQDNIVLPTKKVGDKVNLEADILGKYVEKLLAGRVEAMAKVGS

SEQ ID NO: 914 - protein, 331 aa, Sorghum bicolor
MPLHCSLPATCSALCLRAAARPDPRCPSSHARLVGLALSRPRHQRLVHTGCARAGTSDSKAVQLVLGGRARGDDDDTDSESSDGEDSQDRMTDEERKTLRRKIREMMDRVPETAGLTDPEERRAKMRELLTKYELVVEEEDPDWPEDAEDGMGFSLGQFFDKITIKAEKKDDAEEDDDSGYQSDKEIVWEDDNYIKPVRDVRTQDWDASVFTDFGPMIVLVHNRYKRPRENEMARAELTKAIEMFWEHNLPSPRCVAVDACAEPDLVDALKVSGFPEILFTNAGRIIHREKVVRSAEAWSRMMAFFYYKAARPPFLCEADGKGQEKVPLMS

SEQ ID NO: 915 - protein, 329 aa, Sorghum bicolor
MAADPDTEVQAEFPPLVRQYKSGRVERFFNPAPLPAGTDPATGVVSKDVVVDPATGLWARLFLPPGKKQQLPIVVYYHGGAYVIGSAADPWTHTYLNGLVAKAGVLAVALEYRLAPEHPLPAAYEDSWEGLKWVATHAAATAAAGGGPEPWLTEHGDFSRVFLAGASAGGTIAHYVAVRAGEQQGQGQGDLLGVRVRGLLIVHPYFSGAADIGDEGTTGKQRKAQADAFWRFLYPGSPGLDDPLSNPFSEAGGGSAARVAAERVLVCVAEKDDLRDRGVWYYESLKAGGYPGEVELLESKGEGHVFYCMNPSCDRAREMEERVLSFLRK

SEQ ID NO: 916 - protein, 420 aa, Sorghum bicolor
MELEAAPRQQQQQLEEEEEEVVVGCTCGGGAEAADQFERLHDAVLLDVLNRIGDVKALGRCALVSRRFHALVPLVDSVFVRVDCVIPDDPTPSAAAAAPGSAPHQAPATAARGRGGALAHMARVLLGGIARPIHALGQILSPAAAAVSRRSDPPLPASPPAPVADVSHHSPSEVLRSFRELRRLHIELPTGELGIDDGVLLKWKADFGSTLGSCVILGASSVLSKPPTGSTTQAEPAAADSTAAALDTSRETEEPGSLPDSLYTNGGLKLRVVWTISSLIAASARHYLLHPIICNHETLESLDLTDADGQGVLTMDKRQLQELRVRPVSPSGSSHRTLMPALSMRLHYAPLIELPGGTLLKGATLVAIRPSEDALREGQGAGAAGPVGTCWISEAFEEPYRTAAKVLLKRRAYCLEMNSF

SEQ ID NO: 917 - protein, 211 aa, Glycine max
MLVKSLSLHSHAFSSCSFSASEIGTNPSWVPLKSLNSLCCSSKPRNLCRFLCLSTQNGGFRENSGEVGLGDAVIIVDHGSRRKESNLMLNEFVEMFKHKTGYEIVEPAHMELAEPSIRDAFQSCVEQGAHRIIVSPFFLSPGRHWTQDIPSLSAEAAKEHPDVSYIVTAPLGLHELLVDVVNDRIKHCLKHVAGDVDECSVCSGTGKCRLY

SEQ ID NO: 918 - protein, 570 aa, Solanum lycopersicum
MVSVATVDAQKAEILSSVISTNQNQSSEELHVFRSKLPDISISNNIPLHVYLFERLSEFEERTCIIAGSSGETFTFGETYLICQKIAAGLTMVGIEKGDVIMTFLQNCSEFVFTILASSMIGAVITTANPFYTKSEAFKQLKASNAKLIVTQSQYVDKFRDPAENDPKIGEDFSVVTIDDPPENCLHFSVLSEAKAEDMPKGVVIHPDDPVALPFSSGTTGLPKGVILTHKSLITGVAQLVDGDNPNFYLKHDDVVLCVLPLFHIFALNSVLLVSLRAGASVLLMQKFEISALLELIQKHRVSVAAVVPPLVLALAKNPMVDSFDLSSIRLVLSGAAPLGKELEEALHRRVPQAIFGQGYGMTEAGPVVTMCPAFAKQPFSTKSGSCGSVIRNADLKVVDPETGSSLHRNQPGEICIRGSQIMKGYLNDDEATARTIDVDGWLHTGDIGYVDDDDEIYIVDRVKELIKFKGFQVPPAELESLLISHPDIADAAVVPQKDDAAGEVPVAFVVRSAQGFDLTEEAIKEFIAKQVVFYKKLHKVYFIHAIPKSPSGKILRKDLRAKLIATPQL

SEQ ID NO: 919 - protein, 234 aa, Triticum aestivum
MGLGVRAAPFTYVAHALALAAAAMVLYWCIHFRGGLAFEADNKNLIFNVHPVLMLIGFIILGSEAIMVYKVLPTVNHDTTKLIHLVLHAIALVLGAVGIYCAFKNHNETGIANLYSLHSWLGIGTISLYGIQWIFGFLTFFFPKAAPNVRKGALPWHVLLGIFVYILALATAELGFLEKLTFLQSSGIDKYGPESFLVNFTALVVVLFGASVVVAAVAPARLEEPQGYAPIPEN

SEQ ID NO: 920 - protein, 303 aa, Triticum aestivum
MGGGVMRTAAKVGLAGGAAAAAGRFRNVAPSFATAPAAEAAAAAPLLSAAGEIPAVAPAGSQWASWEVDDWEFADWRSESASEADVAVVGGPRLVFAPPSREEAEEATAELREAIDRVYFKETPVEVVKEHDQELSKLGADALIPAMPGHVVQAFTLLKSSPEAQSVVASLASDKNVWDAVLKNERVMEFYKSHQQTLVNTFPEGTDSSDSVESPEKFEEASPEYALPTASPLSDFVDNAKKTMMEMVDNITNFFQDLFHNPAEAEAGPGSSSKKPSFAEMAAGGSFMALAMAVILVVLFKRA

SEQ ID NO: 921 - protein, 990 aa, Triticum aestivum
MATQSAVRLIGGAGAGGWTKDFGAFDSPLGNLPGEGLGFVENGSGIYGGWGESVPNRSGSAPPSMEGSLAALGNLIGQRSGNFDTSLGNLDNVTGSSTAEEQLRADPAYFDYYGSKVNLNPRLPPPLISRESRRFMNRVGKVKEWRVVSQDDSNKGSLFIPRSTLSTHKEEPEDDKSPRLDSSSADDEQMNLVDFVQESFQQNPDSLYDNSSHLSSSSIGDGIAVHSNIDSSRNLPHDVVKPSGLNSWTPVPLASVLRSTLSNNLSSTSVPSSSCSDNNPTVQISEQQQEKQSIDMKPGNDVPVSGAVVTELDVVESSMKNLKLCLDSPTTSQVKQQWQGNFLQQYGFSPLVQGDHMPMTPHGAHLPNVPFVDNVSHTQLKLPTGDMQQLLPQLGMPTPFYTPNSFGSPYYQNLHPASVLANPYVTAGYALGGSGFPPVMTSYSPQSSAATPLDSPITPSFSGRPSGFPSAGNLTAGTEFVQPYKMYGQLGVPMQPPIPDPNFFQFFQHPSFPQYASGNQYNTLAPRGSVFGNVADNFDPRKLFPQAQYPSDQRLQLPKTGIFNSPTTLRGGTVPNYHGISPYVGAPLTYPTSPVFQGQPFSGIPPSGRNDSARFQSASRSITAVSGFQGQREREKFDNPKACTFLEELKSNRARRVELSDITGRIVDFSADQHGSRFIQQKLENCTAEEKAAVFAEVLPHASSLMTDVFGNYVIQKFFEHGTPEQRRDLAAKLAGHVVPLSLQMYGCRVIQKALEVMELDQKIDLVRELDGNIMRCVRDQNGNHVIQKCIECVPTEHIGFVVSAFRGQVASLSMHPYGCRVIQRVLEHCGGDSRGQCIIDEILQSACILAQDQYGNYVTQHVVEKGKSHERAQIISKLAGQVVTMSQNKFASNVIEKCFQHGDIAERDLLIREIVEQTDGNDTLLAMMKDQYANYVVQKILETCNDEQRELLVSRVKGHLQALRKYTYGKHIASRVEQLCGEGDAECDS

SEQ ID NO: 922 - protein, 190 aa, Triticum aestivum
MEAAAATGLRPFAAPLGAATRAGAGAGWRCAPGQRRLGRGARVAARLDGGVGKGVPTTNYVVPLDKATGITRPLVEILRDLNKRVPDKIIDPDTNAVPWYHANRMLSFYAPGWCGEVRDVTYSNSGTVTVVYRVILKGTDGEAFRDATGTAKVHEGRNDDAVAAAEEAAFSKACARFGFGLYLYHQDEIL

SEQ ID NO: 923 - protein, 111 aa, Triticum aestivum
MKEATASGGGATAGANDPRQPGTARPYAPPKLSSQDLPVDYAGFLAVVFGVVGVMLHYKVCSWIAIIFCAQSLANMKNFENDLKQLSMAFMFAVMGLVTNYFGPRPGGTKR

SEQ ID NO: 924 - protein, 278 aa, Triticum aestivum
MALPLVRLLLPSLHACQPPLRHPEYSAPPRHSHVSFAVPAAARSSGNRLAFAVCAASASVAPAPAETQADAEDEQPVGPKTRLIAMNIPWDFTPDDIRVLFEKQGTVVDVELSMHSSKKNRGLAFVTMGSEDEALSALKNLNLSTLNDRTIKVDFAKPKKKQPAVPSAPVEKNVVFVGNLTWRVRSRHLRELFASTPGVQSVEVIFHTTTPRRSAGYAFVSFSSKEEAEAAISTSNGKELMGRSINVMFKEDTVKKNKSSDSEEEKLEEAESSEESDS

SEQ ID NO: 925 - protein, 484 aa, Triticum aestivum
MSCFSCFGPALEAEGRKPVPDAKDPRAKDGAVSDRAGSDKLRLQGGSDPKNNHLTIPRDGSSQNIAAQIFTFRELAAATKNFRQDCMLGEGGFGRVYKGRLESGQAVAVKQLDRNGLQGNREFLVEVLMLSLLHHTNLVNLIGYCADGDQRLLVYEFMPLGSLEDHLHDVPPEKEPLDWNTRMKIAAGAAKGLEHLHDKASPPVIYRDFKSSNILLGEGFHPKLSDFGLAKLGPVGDNTHVSTRVMGTYGYCAPEYAMTGQLTVKSDVYSFGVVFLELITGRKAIDNTKPQGEQNLVAWARPLFKDRRKFPKMADPMLQGRFPMRGLYQALAVAAMCLQEQATTRPHIGDVVTALSYLASQTYDPNAPTQHTRSNSSTPRARNVGGRNSEQRNGRSPNHHSPRTSKHGGEVSRTSSTGGDSGRRSGLDEMDMAGSQAGSPAQTGRKRETPRTADRQRAIADAKMWGENSRERKRPNGSFDSTNE

SEQ ID NO: 926 - protein, 344 aa, Triticum aestivum
MDEAGTSSSAGSAPRGGRPARSGVFYKFTQQDLPAWKPAMTPGYVIAIFLIIGIIFVPLGLICLQASNRVAEIVHRYDIDCVPNAYRSNKQAYIKDSSISKECIQKVKVQYHMKAPIYVYYELDNFYQNHRRYIKSRSDKQLRYGLKYTDSSCSPIEKSDGLPIVPCGLIAWSLFNDTYDFTRGSMGIVVDRKNISWRSDREHKYGKDVYPFNFQNGSLIGGGKLDPDIPLSNQEDLIVWMRAAALPQFRKLYGVIEEDIQADEIITMHITNNYNTYSFGGKKSLVLTTSTWLGGKNDFLGYAYLITGSLSIFLSILFALIHVKIPRPHGDAAYLSWSRKNGNN

SEQ ID NO: 927 - protein, 597 aa, Triticum aestivum
MSQPAAAAVAAQPQGQAAAGRQGGGLGQSLAGIVRMAVFWYFASKFFGPKRAPTEPGLLMSNLFQKGEPMDMWMYLSENDKFSDFGNEDALIWHETNIPYAVWTPTSTRTHTLTYYPTEALKHNGSLYAHVYFSRSGYPVDPTDPEYEQKSAFGRTHPIVAYLRKSKAGHKKSLLGDSDESEEKLPPKENKESEDKEEGPVEYISYWKPNVTINLVDDFTRYPQNNIPPNVAPYLNVDPTTNSYYPTVFFNEFWLLRDKLTALNKTVKELTLNLEVSPISMTKWQLFLQIEQSFQVHRSYGSMLEGEADELKRVFLEGNPYLLGLTMIVSLFHSLFDFLAFKNDIQFWNKNKSMEGLSAKSVVLNFICQLIIFLYLLDNDTSWMILASSGVGVCIEFWKIGKAMHVEIDRSGKIPMLRFRDRESYAQNKTKEYDALAMKYLTYVLLVLMAGFAIYSLKYDKHKSWYSWILSSLTSCVYMFGFIMMCPQLFINYKLKSVAHMPWRQMTYKFLNTIIDDLFAFVIKMPWLHRLSVFRDDVIFLIYLYQRWVYPVDKKRVNEFGFGGEDEPAAPQTLEGAAAAQQIEAKAETSTEDKKTK

SEQ ID NO: 928 - protein, 192 aa, Triticum aestivum
MKHLLLPSQLPLLLHGRASKPLLLHARQRHRHAPSAAPDGNSGDTSTAASEPPPTNTQPSPPPSAPPSTNSGTTSVKTRLRSRNQARRVQEPYLPPVEVKMMRGKGKANASAAPRREKEKRKKTWDEMSLGEKAYELYVGEKGALFWLNKFAYASIFIMAGAWILFRFVGPATGLYQLDAPPLAPTDVLRGS

SEQ ID NO: 929 - protein, 570 aa, Triticum aestivum
MRSLLGEERSFIIESDDDDEEDPAHRGDGVGHGDDGSSSDSSSCATPRGGGGGGGDSQPNSYTNQWPQSYRQSIDILSNVQSPSLGFLGTPTLSRLSNSFLNSSFLNNSFRGKTPEIVSNLVKPLIRPTTSDEQQQQQQQHEDIRKSSQYLLPSRKPSLQQIPEDQKPLVVGHEVSPYQQCSYTQGAMNGINVLCGVGILSTPYAIKQGGWLGLVILVVFALLAWYTGVLLRRCLDSKEGLQTYPDIGHAAFGTTGRIAISIILYVELYACCIEYLILESDNLSKLFPNVHLSIGGLTINSHVFFAILTTLVVMPTTWLRDLTCLSYISAGGVVASILVVICLCWIGVVDHVGFENKGTALNLPGIPIAIGLYGYCYSGHGVFPNIYSSLKNRNQFPSILFTCIGFSTILFTAAAVMGYKMFGEATESQFTLNLPENLVVSKIAVWATVANPITKYALTITPLAMSLEELLPRSQQKYSNIILLRSALVVSTLIIALSVPFFALVMALIGSLFAMLVTYILPCACFLAILKAKATWYQTATCSFIIAVGVTCACVGTYSSLSGIVQNYAT

SEQ ID NO: 930 - protein, 126 aa, Triticum aestivum
MAMTVEVLAGLVCMFSTSVLLQILACALYNNWWPMLAALMYIIVPMPCLFFGDGSTRFLSSGEGGAWMKAAKFLTGMSAMGSLAIPAILRHAGLIETGAMFIEFTSFFILVCTVLCFHRATLDEEW

SEQ ID NO: 931 - DNA, 1538 bp, Arabidopsis lyrata
gtaaaaaaaaaaaccttatctccaaacctaatctcattaccttctcttccctccactcaaatctctcctctcttctttcttacaatcaaaagaacagagagataaggttagagcaaaacactgtctgaaacaaacaagaaaaaatggcttgctctaatctaacaacaatgtgggtttcatcaaaaccatctctttctgctgattcatcttccttatcattccgatctgttctcaagtgcccagttcctctcccaaatcacacttcctctccaccttcaagatcatcctctgtttcaccactccaagcgtctcttcgtgagctcagagaccgtatcgattcagtcaaaaacactcagaagatcaccgaagctatgaagcttgtcgctgcagctaaagtcaggagagctcaagaagctgtcgtcaatggtcgaccattctcagaaaccctagttgaagttctttacaacatcaacgaacagcttcaaaccgatgatgtcgatgtgcccttaaccaaagtcagaccggttaagaaagtagcactcgttgtcgtaaccggtgatcgtggattatgtggtggattcaacaatttcatcatcaagaaagcagaggcaagaatcaaagagcttaaaggtcttggtcttgattacacagtcattagcgtggggaagaagggaaattcttatttcctccgtcgtccgtacatacccgtcgacagataccttgaagccggaactttacctacggctaaagaagcacaagctgtggctgatgatgtcttctctctgtttataagcgaagaagtcgataaagtcgagctcttgtacacaaagtttgtgtctttggtgaaatcagaacccgtgatccacacgctattgcctctatcacctaaaggagagatctgtgacattaatgggacctgtgttgatgctgcggaagatgaattgttcaggctaacgacgaaaggagggaagttgacggttgaaagagagacttttagaacaccaacagctgatttctcgccgatcttgcaattcgagcaagaccctgttcagattcttgatgctttgttgcctctgtatctgaacagtcagattcttagggcattacaggagtcattggctagtgagcttgcagctagaatgagtgcaatgagtagtgcttcggataatgcatcggatcttaagaaatcgctttcaatggtgtataatagaaagcgtcaagctaagattactggagagattcttgagattgttgctggagctaatgcacaggtttgatttgttttgaaccctctttgagttggtacctatttgatatatgagcagacccttttttttttttatcatcgttctcgttggtataatgtataatttgtctagaacttgttctgatcttctctttaaaatcatgcaattacaaacataatgcggttgtatttattttggccttccattggataaatggtttaagaaaattgtgaatgtggatgttttgcaggatccttcaaagaataaaatttgtttttgtgaacaaaaaaa

SEQ ID NO: 932 - DNA, 1627 bp, Eutrema halophilum
aaacctcatccattaccttctcttccctccactcaatttctcttcattcctttcttctttctacaatcaaagaacagagataaggttaaagccaaaaactctgtctgaacaaacaacaaaaacaaacaaaaaaaaaaaggaagaaaaaagcttctcttctctctcgccaagatcaagaacaatggcttgcactaatctaacaacaatgtgggtttcgtcaaaaccatctctttctgattcctcttccttatccttccgatctgttctcaacccacttcctctcccaaatcacaactcatctccatcaagatcttcctctgtttctccaatccaatcgtctcttcgtgagctcagagacagaatcgattcagtcaaaaacactcagaagatcaccgaagcaatgaagctcgtcgctgcagcaaaagtcaggagagcacaagaagctgtcgtcaatggccgaccattctcagaaaccctagttgaggttctctacaacatcaacgaacagcttcaaaccgatgacatcgatgtgcccttaaccaaagtcagaccggttaagaaagtggccctcgttgtcgtaaccggagatcgaggattatgcgggggattcaacaatttcatcatcaagaaagcagaggcaaggatcaaagagcttaaaggccttggtcttgattacacagtgattagcgtggggaagaagggaaactcgtatttcctccgtcgtccgtacatccccgtcgacaaatacctcgaagccgggactttaccgacggcgaaagaagctcaagccgtggctgatgatgtcttctctctgttcataagcgaagaagtcgataaagtcgagctcttgtacacaaagtttgtgtctttggtcaaatcagaacccgtgatccacacgttattgcccctgtctcctaaaggagagatctgtgacatcaacggcaactgtgtggatgctgcggaagacgaattgttcaggttaacgacgaaagaagggaaactgaccgttgaaagagagactttccggacagcaactgctgatttctctccgatcttgcagttcgagcaagatcctgttcagattcttgatgctttgttgcctctgtatcttaacagtcagattcttagggctttacaggagtcgttggctagtgagctcgctgctagaatgagtgcaatgagtagtgcttcggataatgcttcggatcttaagaaatcgctttcgatggtgtacaatagaaagcgtcaagctaagattactggtgagattcttgagattgttgctggagctaatgcacaggcttgatttgtttggaacctctttgatcatctttgatatatggcagactctctttttttatttcgttttcgttcgtataatgtataatgatctagaactcgttatgatcctttctttattatcatggaattacaaaacataatgcggtgcggatatgtatttattttggcctgtcattggataaagtataagaaatcttcgttgaagattttaagatttctggttgtgaatgaggagcttttggaggatcctttgaaggaataagatttgtttttgtactcaattagttgcataatcctatcatattcatcaatcacataagttcat

SEQ ID NO: 933 - DNA, 1621 bp, Thellungiella halophila
  misc_feature (1467)..(1467): n is a, c, g, or t
gatccattaccttctcttccctccactcaatttctcttcattcctttcttctttctacaatcaaagaacagagataaggttaaagccaaaaactctgtctgaacaaacaacaaaaacaaacaaaaaaaaaaaggaagaaaaaagcttctcttctctctcgccaagatcaagaacaatggcttgcactaatctaacaacaatgtgggtttcgtcaaaaccatctctttctgattcctcttccttatccttccgatctgttctcaacccacttcctctcccaaatcacaactcatctccatcaagatcttcctctgtttctccaatccaatcgtctcttcgtgagctcagagacagaatcgattcagtcaaaaacactcagaagatcaccgaagcaatgaagctcgtcgctgcagcaaaagtcaggagagcacaagaagctgtcgtcaatggccgaccattctcagaaaccctagttgaggttctctacaacatcaacgaacagcttcaaaccgatgacatcgatgtgcccttaaccaaagtcagaccggttaagaaagtggccctcgttgtcgtaaccggagatcgaggattatgcgggggattcaacaatttcatcatcaagaaagcagaggcaaggatcaaagagcttaaaggccttggtcttgattacacagtgattagcgtggggaagaagggaaactcgtatttcctccgtcgtccgtacatccccgtcgacaaatacctcgaagccgggactttaccgacggcgaaagaagctcaagccgtggctgatgatgtcttctctctgttcataagcgaagaagtcgataaagtcgagctcttgtacacaaagtttgtgtctttggtcaaatcagaacccgtgatccacacgttattgcccctgtctcctaaaggagagatctgtgacatcaacggcaactgtgtggatgctgcggaagacgaattgttcaggttaacgacgaaagaagggaaactgaccgttgaaagagagactttccggacagcaactgctgatttctctccgatcttgcagttcgagcaagatcctgttcagattcttgatgctttgttgcctctgtatcttaacagtcagattcttagggctttacaggagtcgttggctagtgagctcgctgctagaatgagtgcaatgagtagtgcttcggataatgcttcggatcttaagaaatcgctttcgatggtgtacaatagaaagcgtcaagctaagattactggtgagattcttgagattgttgctggagctaatgcacaggcttgatttgtttggaacctctttgatcatctttgatatatggcagactctctttttttatttcgttttcgttcgtataatgtataatgatctagaactcgttatgatcctttctttattatcatggaattacaaaacataatgcggtgcggatatgtatttattttggcctntcattggataaagtataagaaatcttcgttgaagattttaagatttctggttgtgaatgaggagcttttggaggatcctttgaaggaataagatttgtttttgtactcaattagttgcataatcctatcatattcatcaatcacataagttcat

SEQ ID NO: 934 - DNA, 1419 bp, Brassica juncea
gaaacctcatccgttaccttctcctccctccactcaattttctcttccttcctttcttctttcttctcacaatcaaagaacatagataaggtttaaccaaaactctgtccgaacaaaacaacaccttctcttctctctcagaacaagatcaacaacaatggcttgcacaaacctaacaacaatgtgggtttcatcaaaaccatctctttctgattcatcctccttgtccttccgctctgttctcaacccacttcctctcccaaaccacaacacctctccctcaagatcatcctctgtttcaccaatccaatcctccctccgtgagctcagagaccgaatcgattctgtcaaaaacactcagaagatcaccgaagccatgaagcttgtcgctgcagcaaaagtcaggagggctcaagaagccgtcgtcaacggccgaccattctcagaaaccctagtcgaagtcctttacaacatcaacgaacagctccaaaccgatgacatcgacgtgcccttgaccaagatcagaccggttaagaaagtcgcactcgtcgtcgtgaccggagaccgagggttatgcggtgggttcaataacttcatcatcaagaaagcagaggcgaggatcaaggagcttcaaggtctaggtcttgactacactgtgattagcgtggggaagaagggaaactcttacttcctccgtcgtccttacatccccgtcgataagtacctcgaagccgggaccttaccgacggcgaaagaggctcaagctgttgctgatgatgtcttctctctgtttataagcgaagaagtcgacaaagtcgaactcttgtacacgaagttcgtgtctctggtcaaatcagaacccgtgatccacacgctactgcctctatcgcctaaaggagagatctgcgacattaatgggaactgtgtggacgctgctgaagacgagctcttcaggttaacgaccaaagaagggaagctgacggtcgaaagagagactttccggacaccaactgctgatttctcgcccatcttgcagttcgagcaagaccctgttcagattcttgatgctttgttgcctctgtatcttaacagtcagattcttagggctttacaggagtcattggcgagtgagcttgcagctagaatgagtgcaatgagtagtgcttcagataatgcttctgatcttaagaagtcgctttctatggtgtataatagaaagcgtcaagctaagatcactggtgagatccttgagattgttgctggagctaatgcacaggcatgatttggttggaacctctttgatatatgagcagactcttccttttttttgcgtttttgttgttataatgtttaatatgtctagaagttacaagcataatgcggttgtatttgttttggccttccattggatgaatgtta

SEQ ID NO: 935 - DNA, 1680 bp, Eutrema parvulum
caacgccacgtcaacaaaatgggtcctacattaaagatttcaaaaaccaaaggtaaaaaaccttatctcttaacctcatccgttaccttctcttccctccactcaatttctcttctttcctttcttctttcttctcagaatcaaagaacatagataaggttcaagcaaaactctgtccgaacaaacaacaaacaacaaaacaaaaaagaagaaaaaacttctcttttctctgaacaagatcaagagcaatggcttgcactaatctaacaacaatgtgggtttcatcaaaaccatctctttctgattcctcttccttgtccttccgatctgttctcaacccacttcctctcccaaatcacaattcctctccttcaagatcttcctctgtttctccaatccaatcctctcttcgtgagctcagagaccgaatcgattcagtcaaaaacactcagaagatcactgaagcgatgaagcttgtcgctgcagcaaaagtcaggagagctcaagaagctgtcgtcaacggacggccattctcagaaaccttggtcgaggttctctacaacatcaacgaacagcttcaaaccgatgatatcgatgtgcccttaaccaaaatcagaccggttaagaaagtggcactcgttgtcgtaaccggggatcgaggtttatgcggtggattcaacaatttcatcatcaagaaagcagaggcaaggatcagagagcttaagggtcttggtcttgattacactgtgatcagcgtggggaagaagggaaacacgtatttcctccgtcgtccgtacatccccgtcgacaaatacctcgaagccggaactttaccgacggcgaaagaggcccaagctgttgctgatgatgtcttctctctgtttataagcgaagaagtcgataaagtcgagctcttgtacacaaagtttgtgtctttggtcaaatcagaacccgtgatccacacgctactgcctctatctcctaaaggagagatctgtgacatcaatgggacctgtgtggatgctgctgaagacgaactgttcaggctaacgacgaaagaagggaaattgacggttgaaagagagactttccggacaccaactgccgatttctcgccgatcttgcaattcgagcaggatcctgtccagattcttgatgctttgttgcctctgtaccttaacagtcagattcttagggctttacaggaatcattggcgagtgagctcgcagctagaatgagtgccatgagtagtgcttcggagaatgcctcagatcttaagaaatcgctttcgatggtgtacaatagaaagcgtcaagctaagatcactggagagattcttgagattgttgctggagctaatgcacaggcttgatttgtttggaacctctttgatgatatttgatatatgagcagactcttctttttctttttcgttttcgttggtataataatgtatactctgtctagaactcattatgatctttttataatcatgcaattacaaacataatgcgattgtgtttattttggcctttcattggataaatgataaaaaacttcgttgatgattttgtggatgatgagcttttgtatgatcctttgaaggaattagatttctctttgtattcaattagctgaataatcctattccattgatgcattgaaggatcttagttaag

SEQ ID NO: 936 - DNA, 1364 bp, Brassica oleracea
  misc_feature (22)..(22): n is a, c, g, or t
  misc_feature (707)..(707): n is a, c, g, or t
  misc_feature (740)..(740): n is a, c, g, or t
  misc_feature (743)..(743): n is a, c, g, or t
  misc_feature (755)..(755): n is a, c, g, or t
  misc_feature (791)..(791): n is a, c, g, or t
ggacgcgtccgaacagaaaganaaaaaacgtatcttctctcagaacaagatcaagaacaatggcttgcactaacctaacaacaatgtatctttcatcaaaaccatctctctctgattcctcttccttgtccttccgatctgttctcaacccacttcctctcccaaaccacaactcctctccttcaagatcctcctctgtttcaccaatccaatcctcccttcgtgagctcagagaccgtatcgattccgtcaaaaacacacagaagatcaccgaagccatgaagcttgtcgctgcagcgaaagtcaggagagctcaagaagccgtcgtcaacggccgaccgttctcagaaaccctagtcgaggttctttacaacatcaacgaacagcttcaaaccgatgacatcgacgtgcccttaaccaagatcagaccggttaagaaagttgcactcgttgtcgtgaccggagatcgagggttgtgcggtgggttcaataacttcatcatcaagaaagcagaggcaaggatcaaggagcttcaaggtctaggtcttgactacacagtgattagcgtggggaagaagggaaactcttacttcctccgtcgtccttacatccccgtcgacaagtacctcgaagccgggaccttaccgaccgcgaaagaagctcaagctgttgctgatgatgtcttctctctgtttataagcgaagangtcgacaaagtcgagctcttgtacacaaagttngtntctttggtcaantcagaacccgtgatccacacgctactgcctctatcncccaaaggagagatctgtgacatcaatgggaactgtgtggacgctgctgaagacgaactcttcaggctaacgaccaaagaagggaagcttacggtcgaaagagagacttttcggacaccaaccgctgatttctcgccgatcttgcagttcgagcaagaccctgttcagattcttgatgctttgttgcctttgtatcttaacagtcagattcttagggctttacaggagtcattggcgagtgagcttgcagctagaatgagtgcgatgagtagtgcttcggataatgcatctgatcttaagaagtcgctttcgatggtgtataatagaaagcgtcaagctaagattactggagagattcttgagattgttgctggagctaatgcacaggcttgatttgtgttggtacctatttgatatatgagcagactcttttttatcatcgttctcgttggtataatgtataatttgtctagaacatgttctgatcttctctttaaaatcatgcaattacaaacataatgcggttgtatttattttggccttccattggataaatgattttaaaaagatttg

SEQ ID NO: 937 - DNA, 1520 bp, Brassica rapa
aaacctcatccgttaccttctcttccctccactcaatttctcttctttcctttcttccttcttcttacaatcaaagaacatagataaggttacacaaaatctctgtccgaacagaaagaagaaaaacttgtcttctctcacaacaagatcgagaacaatggcttgcactaacctaacaacaatgtatctttcatcaaaaccatctctctctgattcctcttccttgtccttccgatctgttctcaacccacttcctctcccaaaccacaactcctctccttcaagatcctcctccgtttcaccaatccaatcctctctccgtgagctcagagaccgtatcgactccgtcaaaaacactcagaagatcaccgaagccatgaagcttgtcgctgccgcaaaagtcaggagagctcaagaagccgtcgtcaacggccgacccttttcagaaaccctagtcgaggttctttacaacatcaacgaacagcttcaaaccgatgacatcgatgtgcccttaaccaagatcagaccggttaagaaagttgcactcgtggtcgtgaccggagatcgtgggttatgtggtgggttcaataacttcatcatcaagaaagcagaggcgaggatcaaggagcttcaaggtctaggtcttgactacacagtcattagcgtggggaagaagggaaactcttacttcctccgtcgtccgtacatccccgtcgacaagtacctcgaagccgggaccttaccgaccgcgaaagaagctcaagctgttgctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgtgacatcaatgggaactgtgtggacgctgctgaagacgagctcttcaggctaacgaccaaagaagggaagctgacggtcgaaagggagacttttaggacaccaaccgctgatttctccccgatcttgcagttcgagcaagaccctgttcagattcttgatgctctgttgcctttgtatctcaacagtcagattcttagggctttacaggagtcgttggcgagtgagcttgcagctagaatgagtgcaatgagtagtgcttcggacaatgcatctgatcttaagaagtcgctttcgatggtgtataatagaaagcgtcaagctaagattactggagagattcttgagattgttgctggagctaatgcacaggcttgatttgtgttggtaccctatttgatatatgagcagacccttttttttttttatcatcgttctcgttggtataatgtataatttgtctagaacttgttctgatcttctctttaaaatcatgcaattacaaacataatgcggttgtatttattttggccttccattggataaatggtttaagaaaattgtgaatgtggaggttttgcaggatccttcaaagaataaaatttgtttttgtgaa

SEQ ID NO: 938 - DNA, 1646 bp, Brassica rapa
aaacaaaggttcaaaaccttatctccaaacctcatccgttaccttctcttccctccactcaatttctcttctttcctttcttccttcttcttacaatcaaagaacatagataaggttacacaaaatctctgtccgaacagaaagaagaaaaacttgtcttctctcacaacaagatcgagaacaatggcttgcactaacctaacaacaatgtatctttcatcaaaaccatctctctctgattcctcttccttgtccttccgatctgttctcaacccacttcctctcccaaaccacaactcctctccttcaagatcctcctccgtttcaccaatccaatcctctctccgtgagctcagagaccgtatcgactccgtcaaaaacactcagaagatcaccgaagccatgaagcttgtcgctgccgcaaaagtcaggagagctcaagaagccgtcgtcaacggccgacccttttcagaaaccctagtcgaggttctttacaacatcaacgaacagcttcaaaccgatgacatcgatgtgcccttaaccaagatcagaccggttaagaaagttgcactcgtggtcgtgaccggagatcgtgggttatgtggtgggttcaataacttcatcatcaagaaagcagaggcgaggatcaaggagcttcaagggttaggtcttgactacacagtcattagcgtggggaagaagggaaactcttacttcctccgtcgtccgtacatccccgtcgacaagtacctcgaagccgggaccttaccgaccgcgaaagaagctcaagctgttgctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgtgacatcaatgggaactgtgtggacgctgctgaagacgagctcttcaggctaacgaccaaagaagggaagctgacggtcgaaagggagacttttaggacaccaaccgctgatttctccccgatcttgcagttcgagcaagaccctgttcagattcttgatgctctgttgcctttgtatctcaacagtcagattcttagggctttacaggagtcgttggcgagtgagcttgcagctagaatgagtgcaatgagtagtgcttcggacaatgcatctgatcttaagaagtcgctttcgatggtgtataatagaaagcgtcaagctaagattactggagagattcttgagattgttgctggagctaatgcacaggcttgatttgtgttggtaccctatttgatatatgagcagacccttttttttttttatcatcgttctcgttggtataatgtataatttgtctagaacttgttctgatcttctctttaaaatcatgcaattacaaacataatgcggttgtatttattttggccttccattggataaatggtttaagaaaattgtgaatgtggaggttttgcaggatccttcaaagaataaaatttgtttttgtgaacagttactttagtcatattgaattgttgttatgaacgatcttagttaggcagaaaagagagagttatcatgagtattattgctaagtgtttgtttatctt

SEQ ID NO: 939 - DNA, 1301 bp, Brassica napus
agataaggttacaccaaaactctgtccgaacagaaagaagaaaaacttgtcttctctcacaacaagatcgagaacaatggcttgcactaacctaacaacaatgtatctttcatcaaaaccatctctctctgattcctcttccttgtccttccgatctgttctcaacccacttcctctcccaaaccacaactcctctccttcaagatcctcctccgtttcaccaatccaatcctcccttcgtgagctcagagaccgtatcgattccgtcaaaaacacccagaagatcaccgaagccatgaagcttgtcgctgccgcaaaagtcaggagagctcaagaagccgtcgtcaacggccgaccgttctcagaaaccctagtcgaggttctttacaacatcaacgaacagcttcaaaccgatgacatcgacgtgcccttaaccaagatcagaccggttaagaaagttgcactcgtggtcgtgaccggagatcgtgggttatgcggtgggttcaataacttcatcatcaagaaagcagaggcgaggatcaaggagcttcaaggtctaggtcttgactacacagtcattagcgtggggaagaagggaaactcttacttcctccgtcgtccgtacatccccgtcgacaagtacctcgaagccgggaccttaccgaccgcgaaagaagctcaagctgttgctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgtgacatcaatgggaactgtgtggacgctgctgaagacgagctcttcaggctaacgaccaaagaagggaagctgacggtcgaaagggagacttttaggacaccaaccgctgatttctccccgatcttgcagttcgagcaagaccctgttcagattcttgatgctctgttgcctttgtatctcaacagtcagattcttagggctttacaggagtcgttggcgagtgagcttgcagctagaatgagtgcaatgagtagtgcttcggacaatgcatctgatcttaagaagtcgctttcgatggtgtataatagaaagcgtcaagctaagattactggagagattcttgagattgttgctggagctaatgcacaggcttgatttgtgttggtaccctatttgatatatgagcagtacccttttttttttttatcatcgttctcgttggtataatgtataatttgtctagaacttgttctga

SEQ ID NO: 940 - DNA, 1345 bp, Brassica napus
aaaaaaacgtatcttctctcagaacaagatcaagaacaatggcttgcactaacctaacaacaatgtatctttcatcaaaaccatctctctctgattcctcttccttgtccttccgatctgttctcaacccacttcctctcccaaaccacaactcctctccttcaagatcctcctctgtttcaccaatccaatcctcccttcgtgagctcagagaccgtatcgattccgtcaaaaacacacagaagatcaccgaagccatgaagcttgtcgctgcagcgaaagtcaggagagctcaagaagccgtcgtcaacggccgaccgttctcagaaaccctagtcgaggttctttacaacatcaacgaacagcttcaaaccgatgacatcgacgtgcccttaaccaagatcagaccggttaagaaagttgcactcgttgtcgtgaccggagatcgagggttgtgcggtgggttcaataacttcatcatcaagaaagcagaggcaaggatcaaggagcttcaaggtctaggtcttgactacacagtgattagcgtggggaagaagggaaactcttacttcctccgtcgtccttacatccccgtcgacaagtacctcgaagccgggaccttaccgaccgcgaaagaagctcaagctgttgctgatgatgtcttctctctgtttataagcgaagaagtcgacaaagtcgagctcttgtacacaaagttcgtgtctttggtcaagtcagaacccgtgatccacacgctactgcctctatcgcccaaaggagagatctgtgacatcaatgggaactgtgtggacgctgctgaagacgaactcttcaggctaacgaccaaagaagggaagcttacggtcgaaagagagacttttcggacaccaaccgctgatttctcgccgatcttgcagttcgagcaagaccctgttcagattcttgatgctttgttgcctttgtatcttaacagtcagattcttagggctttacaggagtcattggcgagtgagcttgcagctagaatgagtgcgatgagtagtgcttcggataatgcatctgatcttaagaagtcgctttcgatggtgtataatagaaagcgtcaagctaagattactggagagattcttgagattgttgctggagctaatgcacaggcttgatttgtgttggtacctatttgatatatgagcagactcttttttatcatcgttctcgttggtataatgtataatttgtctagaacatgttctgatcttctctttaaaatcatgcaattacaaacataatgcggttgtatttattttggccttccattggataaatgattttaaaaagatttgaa

SEQ ID NO: 941 - DNA, 1218 bp, Brassica juncea
atcaaagaacatagataaggttaaaccaaaacactgtctgaacaaacaaaaaaacttgtcttctgtctgaaccaagatcaagaacaatggcttgcactaatctaacaacaatgtggggtgtttcatcaaacccatctctttcagactcctcctccttgtcgttccgctccgttctcaacccgcttcctctcccaaaccacaactcctctccttcaagatcctcctccgtcgctccaatccaatcctccctccgtgagctcagagaccgaatcgactcagtcaaaaacactcagaagatcaccgaagccatgaagctcgtcgccgcggcaaaagtcaggagagctcaagaagccgtcgtcaacggacgtcccttctccgaaaccctagtcgaagttctctacaacatcaacgaacagcttcagaccgatgacatcgacgtgcccttaaccaagatcagaccggttaagaaagtggcactcgtcgtcgtgaccggagaccgtggattgtgcggtgggttcaataacttcatcatcaagaaagcggaagcgaggatcaaggagcttcaagggttaggtctcgactacacagtcattagcgtggggaagaagggaaactcttacttcctccgccgtccgtacatccccgtcgacaagtacctcgaagccggaaccttaccgacggcgaaagaggctcaagccgtcgccgatgatgtcttctctctgttcataagcgaggaagtcgacaaggtggagctcttgtacacgaagttcgtgtctctggtcaaatcagaacccgtgatccacacgctactgcctctatcgcccaaaggagagatctgcgacatcaacgggaactgtgttgacgctgccgaagacgagctcttcaggttaacgaccaaagaagggaagctgacggtcgagagagagacgtttcggacaccgactgctgatttctcgccgatcttgcagttcgagcaggaccctgttcagattctcgatgctttgttgcctttgtatctgaacagtcagattctcagggcgttacaggagtctttggcgagtgagctcgcggctaggatgagtgcgatgagtagtgcttcggataatgcgtcggatcttaagaaatcgctttcgatggtttataataggaaacgtcaagctaagattactggtgagattcttgagattgttgctggagctaatgcacaggcttgatttg

SEQ ID NO: 942 - DNA, 1681 bp, Brassica rapa
caacaccacgtcaatacaataagatgtgtcctacgctgaagaatataagggcctaaagaagaataaaccttatctccaaacctcatccattaccatctcttccctccactcaaatacctcttctttcttacaatcaaagaacatagataaggttaaagcaaaacaaattctaaacaaacaacaaaaagagagaagaaacatctctcctctgttggaacaagaacatcaagaacaatggcttgtactaatctaacaacaatgtgggtttcatcaaaactatctgtttctgattcctcttccttgtccttccgttctattctcaacccacttcctctcccaaaccacaactcatctccttcaagatcttcctctgtctctccaatccagtcctctcttcgtgagctccgagaccgtatcgactcagtcaaaaacactcagaagatcactgaagccatgaagcttgtcgctgcagcaaaagtcaggagagctcaggaagctgtggtcaacggccgaccattctcagaaaccctagttgaagttctttacaacatcaacgaacagcttcaaaccgatgatatagatgtgcccttaaccaaaatcagaccggttaagaaagttgcactcgttgttgtaacaggagaccgaggattatgcggtggattcaacaacttcatcatcaagaaagcagaggcaaggatcaaagagcttcaaggcctaggtcttgactacacagtcattagcgtggggaaaaagggaaactcttatttcctccgtcgtccttacatccccgtcgacaagtacctcgaagccggaaccttaccgaccgcgaaagaagctcaagctgtagctgatgatgtcttctctctgtttataagcgaagaggtcgacaaagtcgagctcttgtacacaaagtttgtctctttggtcaaatcagaacccgtgatacacacgctactgcctctatctcccaaaggagagatctgtgacattaatgggaactgtgtggacgctgctgaagacgagctcttcaggttaacgaccaaagaagggaaacttacggttgaaagagagacttttcggacaccaactgctgatttctcacccatcttgcagttcgagcaagaccctgttcagattcttgatgctttgttgcctctgtatcttaacagtcagattctaagggctttacaggagtcattggcgagtgagcttgcagctagaatgagtgcaatgagtagtgcttcagataatgcttctgatcttaagaagtcgctttctatggtgtataatagaaagcgtcaagctaagatcactggtgagatccttgagattgttgctggagctaatgcacaggcttgatttgtttggaacctctttgatcatatatcatatatgagccgactcttccttcttcttttttttttgcgtttttggtgttataatgtttaatttgtcaagaactcgtaatgatgtttataaataatgcagttacaagcataattcggttgtatttgttttggcctttcattggataaatattttatttatgtcggaaattttgtgactgaagaggttttgtaggactttcatgaaatttattttctttttgtaaccaactaggtagtgaccttgcgcaaaatactttaaaatattaatgttacataaatgcaattttctttaa

SEQ ID NO: 943 - DNA, 1503 bp, Raphanus sativus
ggaaaggagaataaaccttatctccaaacctcatccattaccttctcttcccccactcaatctctcttctcttctgtcttacaatcaaagaaaacgtagataaggttaaaccaaaacactgtctgaacaaaaaaaaattgtctttccgtttgaaccaaaatcaagaacaatggcttgcagtaatctaacaacaatgtgggtttcatcaaacccatctctttccgattcctcttccttgtccttccgttctgttctcaacccacttcctctcccaaaccacaactcctctccttcaagatcctccttcgttgctccaatccaatcctcccttcgtgagctcagagaccgaatcgactcagtcaaaaacactcagaagatcactgaagccatgaagcttgtcgctgcagcaaaagtcaggagagctcaagaagctgtcgtcaacggacgaccattctccgaaaccctagtcgaagttctttacaacatcaacgaacagcttcaaaccgatgatatcgatgtgcccttaaccaagataagaccggttaagaaggttgcactcgttgtcgtaacgggagaccgtggattatgcggtgggtttaataacttcattatcaagaaagcagaggcgaggatcaaggagcttcaagggttaggtcttgactacacagtcattagcgtggggaagaagggaaactcttacttcctccgccgtccctacatccccgtcgacaagtacctcgaggccggaaccttaccgacggcgaaggaagctcaagctgttgccgatgatgtcttctctctgtttataagcgaggaagtcgacaaagtggagctcttgtacacgaagtttgtgtctttggtcagatcagaacccgtgatccacacgctactgcctctatcacccaaaggagagatctgtgacatcaacgggaactgtgttgacgctgctgaagacgagttcttcaggttgacgactaaagaagggaagctgacggtcgagagagagacttttcggacagcaactgctgatttctcgccgatcttgcagttcgagcaagaccctgttcagattcttgatgctttgttgcctttgtatctgaacagtcagattcttagggcgttacaggagtctttggcgagtgagctcgcggctcggatgagtgcgatgagtagtgcttcggataatgcatcggatcttaagaaatcgctttccatggtttataatagaaaacgtcaagctaagattactggtgagattcttgagattgttgctggagctaatgcacaggcttgattcgatatgagcaggttgttttttaaatatatatcattttcggtcgtataatgtataatcgtctagactcctatgatctttatataatcatgcaattacaaacataatgcggttgtatttattttggtctttcattggataaatgattaagaaaaaacttcgtgatgatttcgtggattatgagctttgctaggatgttttgaaggaat

SEQ ID NO: 944 - DNA, 1430 bp, Brassica juncea
gaaacctcatccgttaccttctcctccctccactcaattttctcttccttcctttcttctttcttctcacaatcaaagaacatagataaggtttaaccaaaactctgtccgaacaaaaacaacaccttctcttctctctcagaacaagatcaacaacaatggcttgcacaaacctaacaacaatgtgggtttcatcaaaaccatctctttctgattcatcctccttgtccttccgctctgttctcaacccacttcctctcccaaaccacaacacctctccctcaagatcatcctctgtttcaccaatccaatcctccctccgtgagctcagagaccgaatcgattctgtcaaaaacactcagaagatcaccgaagccatgaagcttgtcgctgcagcaaaagtcagggagggctcaagaagccgtcgtcaacggccgaccattctcagaaaccctagtcgaagtcctttacaacatcaacgaacagcttcaaaccgatgacatcgacgtgcccttaaccaagatcagaccggttaagaaagtggccctcgtcgtcgtaaccggagaccgtggactatgcggtgggttcaataacttcatcatcaagaaagcagagacgaggatcaaggagcttcaagggttaggtcttgactacacagtcattagcgtggggaagaagggaaactcttacttcctccgccgtccgtacatccccgtcgacaagtacctcgaggccgggaccttaccgacggcgaaagaggctcaagccgttgccgatgatgtcttctctctgtttataagcgaggaggtcgacaaggtcgagctcttgtacacgaagttcgtgtctttggtcaaatcggaacccgtgatccacacgctactgcctttatctcccaaaggagagatctgcgacattaacgggaactgtgttgacgctgctgaagacgagctcttcaggctgacgaccaaagaagggaagctgacggtcgagagagagacttttcggacaccgaccgctgatttctcgcccatcttgcagttcgagcaagaccctgttcagattctcgacgctctgttgcctttgtatctgaacagtcagattcttagggccttgcaggagtcgttggcgagtgagctcgcggctaggatgagtgcgatgagtagtgcttcggataatgcatcggatcttaagaaatcgctttcgatggtttataatagaaaacgtcaggctaagattactggtgagattcttgagattgttgctggagctaatgctcaggcctgatttgttatgatcagactctttttttttatatataccattttcggtcgtacaatgtataatcgtcaagaactcctattatctttatataatcatgcgattaccaacataataaggttgtatattctcgcagctttgctaggatattt

SEQ ID NO: 945 - DNA, 1281 bp, Triticum aestivum
aacatctctcctctgttggaacaagaacatcaagaacaatggcttgtactaatctaacaacaatgtgggtttcatcaaaactatctgtttctgattcctcttccttgtccttccgttctattctcaacccacttcctctcccaaaccacaactcatctccttcaagatcttcctctgtctctccaatccagtcctctcttcgtgagctccgagaccgtatcgactcagtcaaaaacactcagaagatcactgaagccatgaagcttgtcgctgcagcaaaagtcaggagagctcaggaagctgtggtcaacggccgaccattctcagaaaccctagttgaagttctttacaacatcaacgaacagcttcaaaccgatgatatagatgtgcccttaaccaaaatcagaccggttaagaaagttgcactcgttgttgtaacaggagaccgaggattatgcggtggattcaacaacttcatcatcaagaaagcagaggcaaggatcaaagagcttcaaggcctaggtcttgactacacagtcattagcgtggggaaaaagggaaactcttatttcctccgtcgtccttacatccccgtcgacaagtacctcgaagccggaaccttaccgaccgcgaaagaagctcaagctgtagctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgtgacatcaatgggaactgtgtggacgctgctgaagacgagctcttcaggctaacgaccaaagaagggaagctgacggtcgaaagagagacttttaggacaccaaccgctgatttctcgccgatcttgcagttcgagcaagaccctgttcagattcttgatgctctgttgcctttgtatctcaacagtcagattcttagggctttacaggagtcattggcgagtgagcttgcagctagaatgagtgcgatgagtagtgcttcggataatgcatctgatcttaagaagtcgctttcgatggtgtataatagaaagcgtcaagctaagattactggacagattcttgagattgttgctggagctaatgcacaggcttgatttgcgttggtacctatttgattacatgagcagtactctttttaccatcgttctcgttgtatatgtataattgtctagacatgttctgatcttctactttaaaagtcatgcaattaac

SEQ ID NO: 946 - DNA, 1690 bp, Brassica rapa
caagcattggttggctgataaacaaaacaggtagatatgccacctttttttttcttgaagatctcggttcctccatttatacaacgccacgtcaacaaaagggtcccacattcaagactttgagaaactcaaaggagaataaaccttatctccaaacctcatccgttaccttctcttccctccactcaattcctcttctttcgtttctcttccttcttacaatcaaagaacatagataaggttaaaccaaaacactgtctgaacaaacaaaaaaacttgtattctgtctgaaccaagatcaagaacaatggcctgcactaatctaacaacaatgtggggtgtttcatcaaacccatctctttcagactcctcctccttgtcgttccgctccgttctcagcccgcttcctctcccaaaccacaacatctccccttcaagatcctcctccgttgctccaatccaatcctccctccgtgagctcagagaccgaatcgactcagtcaaaaacactcagaagatcaccgaagccatgaagctcgtcgccgcagcaaaagtcaggagagctcaagaagctgtcgtcaacggacgacccttctccgaaaccctagtcgaagttctctacaacatcaacgaacagcttcaaaccgatgacatcgatgtgcccttaaccaagatcagaccggttaagaaagtggccctcgtcgtcgtaaccggagaccgtgggttatgcggtgggttcaataacttcatcatcaagaaagcagaggcgaggatcaaggagcttcaagggttaggtcttgactacacagtcattagcgtggggaagaagggaaactcttacttcctccgccgtccgtacatccccgtcgacaagtacctcgaggccgggaccttaccgacggcgaaagaggctcaagccgttgccgatgatgtcttctctctgtttataagcgaggaggtcgacaaggtcgagctcttgtacacgaagttcgtgtctttggtcaaatcggaacccgtgatccacacgctactacctctatctcccaaaggagagatctgcgacattaacgggaactgtgttgacgctgctgaagacgagctcttcaggttaacgaccaaagaagggaagctgacggtcgagagagagactttccggacgccgactgctgatttctcgccgatcttgcagttcgagcaagaccctgttcagattcttgatgctttgttgcctttgtatctgaacagtcagattcttagggccttgcaggagtcgttggcgagtgagctcgcggctaggatgagtgcgatgagtagtgcttcggataatgcatcggatcttaagaaatcgctttcgatggtttataatagaaaacgtcaggctaagattactggtgagattcttgagattgttgctggagctaatgctcaggcctgatttgttatgatcagactcttttttttttatatatactattttcggtcgtacaatgtataatcgtcaagaactcctattatctttatataatcatgcgattaccaacataataaggttgtatattctcgcagctttgctaggatattttaaaggaatgttttatttctgtttatatcattttgtgtcctactcgattattcttacgaaagatcttagaaatacatgatctcagtgactttgcttatgacaaaacta

SEQ ID NO: 947 - DNA, 1270 bp, Brassica napus
ctgaacaagatcaagaacaatggcttgcactaatctaacaacaatgtggggtgtttcatcaaacccatctctttccgactcctcctccttgtccttccgttccgttctcaacccactttctctcccaaaccacaacatctccccttcaagatcctcctccgtcgctccaatccaatcctccctccgtgagctcagagaccgaatcgactcagtcaaaaacactcagaagatcaccgaagccatgaagctcgtcgccgcagcaaaagtcaggagagctcaagaagctgtcgtcaacggacgacccttctccgaaaccctagtcgaagttctctacaacatcaacgaacagcttcaaaccgatgacatcgatgtgcccttaaccaagatcagaccggttaagaaagtggccctcgtcgtcgtaaccggagaccgtggactatgcggtgggttcaataacttcatcatcaagaaatcagaggcgaggatcaaggagcttcaagggttaggtcttgactacaccgtcattagcgtgggaaagaagggaaactcgtacttcctccgccgtccgtacatccccgtcgacaagtacctcgaggccggaaccttaccgacggcgaaagaggctcaagccgttgctgatgatgtcttctctctgtttataagcgaggaggtcgacaaggtcgagctcttgtacacgaagttcgtgtctttggtcaaatcggaacccgtgatccacacgctactgcctttatctcccaaaggcgagatctgcgacattaacgggaactgcgtggacgctgctgaagacgagctcttcaggttaacgaccaaagaagggaagctgacggtcgagagagagacttttcggacaccgaccgctgatttctcgccgatcttgcagttcgagcaagaccctgttcagattcttgacgctctgttgcctttgtatctgaacagtcagattcttagggcgttgcaggagtcgttggcgagtgagctcgcggctaggatgagtgcgatgagtagtgcttcggataatgcgtcggatcttaagaaatcgctttcgatggtttataatagaaaacgtcaggctaaaattactggtgagattcttgagattgttgctggagctaatgcacaggtttgattcgttatgagcagaactcttttataaatttatatatatcattttcggtcgtataatgtataatcgtctagaactcttatgatttttatataatcatatgccattacaaacataatgcggttg

SEQ ID NO: 948 - DNA, 1272 bp, Brassica juncea
aatcaaagaacatagataaggttacacaaaatctctgtccgaacagaaagaagaaaaacttgtcttctctcacaacaagatcgagaacaatggcttgcactaacctaacaacaatgtatctttcatcaaaaccatctctctctgattcctcttccttgtccttccgatctgttctcaacccacttcctctcccaaaccacaactcctctccttcaagatcctcctccgtttcaccaatccaatcctctctccgtgagctcagagaccgtatcgactccgtcaaaaacactcagaagatcaccgaagccatgaagcttgtcgctgccgcaaaagtcaggagagctcaagaagccgtcgtcaacggccgacccttttcagaaaccctagtcgaggtcctttacaacatcaacgaacagcttcaaaccgatgacatcgatgtgcccttaaccaagatcagaccggttaagaaagtggcactcgttgtcgtaaccggagaccgtggattatgcgtggggttcaataacttcatcatcaagaaagcagaggcgaggatcaaagagcttaaagggtgaggtcttgactacacagtcattagcgtggggaagaagggaaacacttatttcctccgtcgtccttacatccccgtcgacaagtacctcgaagccggaaccttaccgaccgcgaaagaagctcaagctgttgctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgtgacatcaatgggaactgtgtggacgctgctgaagacgagctcttcaggctaacgaccaaagaagggaagctgacggtcgaaagggagacttttaggacaccaaccgctgatttctccccgatcttgcagttcgagcaagaccctgttcagattcttgatgctctgttgcctttgtatctcaacagtcagattcttagggctttacaggagtcgttggcgagtgagcttgcagctagaatgagtgcaatgagtagtgcttcggacaatgcatctgatcttaagaagtcgctttcgatggtgtataatagaaagcgtcaagctaagattactggagagattcttgagattgttgctggagctaatgcacaggcttgatttgtgttggtaccctatttgatatatgagcagacccttttttttttatcatcgttct

SEQ ID NO: 949 - DNA, 1403 bp, Brassica napus
gaaacatctctcctctctttgaacaagaacatcaagaacaatggcttgtactaatctaacaacaatgtgggtttcatcaaaactatctgtttctgattcctcttccttgtccttccgttctattctcaacccacttcctctcccaaaccacaactcatctccttcaagatcttcctctgtctctccaatccagtcctctcttcgtgagctccgagaccgtatcgactcagtcaaaaacactcagaagatcactgaagccatgaagcttgtcgctgcagcaaaagtcaggagagctcaggaagctgtggtcaacggccgaccattctcagaaaccctagttgaagttctttacaacatcaacgaacagcttcaaaccgatgatatagatgtgcccttaaccaaaatcagaccggttaagaaagttgcactcgttgttgtaacaggagaccgaggattatgcggtggattcaacaacttcatcatcaagaaagcagaggcaaggatcaaagagcttcaaggcctaggtcttgactacacagtcattagcgtggggaaaagggaaactcttatttcctccgtcgtccttacatccccgtcgacaagtacctcgaagccggaaccttaccgaccgcgaaagaagctcaagctgtagctgatgatgtcttctctctgtttataagcgaagaggtcgacaaagtcgagctcttgtacacaaagtttgtctctttggtcaaatcagaacccgtgatccacacgctactgcctctatctcccaaaggagagatctgtgacattaatgggaactgtgtggacgctgctgaagacgagctcttcaggttaacgaccaaagaagggaaacttactgttgaaagagaaacttttcggacaccaactgctgatttctcaccgatcttgcagttcgagcaagaccctgttcagattcttgatgctttgttgcctctgtatcttaacagtcagattctaagggctttacaggagtcattggcgagtgagcttgcagctagaatgagtgcaatgagtagtgcttcagataatgcttctgatcttaagaagtcgctttctatggtgtataatagaaagcgtcaagctaagatcactggtgagatccttgagattgttgctggagctaatgcacaggcttgatttgtttggaacctctttgatatatgagccgactcttccttttttttttttttgcgtttttggtgttataatgtttaatttgtcaagaactcgtaatgatgtttataaataatgcagttacaagcataattcggttgtatttgttttggcctttcattggataaatatttaatttatgtcggaaaaaaaaaaaaaaagggcggcggacgcggtgtcgacccggaattccggaccggtcc

SEQ ID NO: 950 - DNA, 1105 bp, Brassica juncea
accatctctctctgattcctcttccttgtccttccgatctgttctcaacccacttcctctcccaaaccacaactcctctccttcaagatcctcctccgtcgctccaatccaatcctccctccgtgagctcagagaccgaatcgattctgtcaaaaacactcagaagatcaccgaagccatgaagcttgtcgctgcagcaaaagtcaggagggctcaagaagccgtcgtcaacggccgaccattctcagaaaccctagtcgaagtcctttacaacatcaacgaacagctccaaaccgatgacatcgacgtgcccttgaccaagatcagaccggttaagaaagtcgcactcgtcgtcgtgaccggagaccgagggttatgcggtgggttcaataacttcatcatcaagaaagcagaggcgaggatcaaggagcttcaaggtctaggtcttgactacactgtgattagcgtggggaagaagggaaactcttacttcctccgtcgtccttacatccccgtcgataagtacctcgaagccgggaccttaccgacggcgaaagaggctcaagctgttgctgatgatgtcttctctctgtttataagcgaagaagtcgacaaagtcgaactcttgtacacgaagttcgtgtctctggtcaaatcagaacccgtgatccacacgctactgcctctatcgcctaaaggagagatctgcgacattaatgggaactgtgtggacgctgctgaagacgagctcttcaggttaacgaccaaagaagggaagctgacggtcgaaagagagactttccggacaccaactgctgatttctcgcccatcttgcagttcgagcaagaccctgttcagattcttgatgctttgttgcctctgtatcttaacagtcagattcttagggctttgcaggagtcattggcgagtgagcttgctgctagaatgagtgcaatgagtagtgcttcggataatgcatcggatcttaagaagtcgctttcgatggtgtataatagaaagcgtcaagctaagattactggagagattcttgagattgttgctggagccaatgcacaggcttgatttgagcagactctttctatc

SEQ ID NO: 951 - DNA, 1277 bp, Brassica juncea
caaaactatctgtttctgattcctcttccttgtccttccgttctattctcaacccacttcctctcccaaaccacaactcatctccttcaagatcttcctctgtctctccaatccagtcctctcttcgtgagcttcgagaccgtatcgactcagtcaaaaacactcagaagatcactgaagccatgaagcttgtcgctgcagcaaaagtcaggagagctcaggaagctgtggtcaacggccgaccattctcagaaaccctagttgaagttctttacaacatcaacgaacagcttcaaaccgatgatatagatgtgcccttaaccaaaatcagaccggttaagaaagttgcactcgttgttgtaacaggagaccgaggattatgcggtggattcaacaacttcatcatcaagaaagcagaggcaaggatcaaagagcttcaaggcctaggtcttgactacacagtcattagcgtggggaaaaagggaaactcttacttcctccgccgtccgtacatccccgtcgacaagtacctcgaagccggaaccttaccgaccgcgaaagaagctcaagctgtagctgatgatgtcttctctctgtttataagcgaagaggtcgacaaagtcgagctcttgtacacaaagtttgtctctttggtcaaatcagaacccgtgatccacacgctactgcctctatctcccaaaggagagatctgtgacattaatgggaactgtgtggacgctgctgaagacgagctcttcaggttaacgaccaaagaagggaaacttacggttgaaagagagacttttaggacaccaactgctgatttctcacccatcttgcagttcgagcaagaccctgttcagattcttgatgctttgttgcctctgtatcttaacagtcagattctaagggctttacaggagtcattggcgagtgagcttgcagctagaatgagtgcaatgagtagtgcttcagataatgcttctgatcttaagaagtcgctttctatggtgtataatagaaagcgtcaagctaagatcactggtgagatccttgagattgttgctggagctaatgcacaggcttgatttgtttggaacctctttgatatatcatatatgagccgactcttccttcttttttttttctgcgtttttggtgttacaatgtttaatttgtcaagaactcgtaatgatgtttataaataatgcagttacaagcataattcggttgtatttgttttggcctttcattggataaatatttaatttatgtcc

SEQ ID NO: 952 - DNA, 2593 bp, Brassica rapa
aaacctcatccattaccatctcttccctccactcaaatacctcttctttcttacaatcaaagaacatagataaggttaaagcaaaacaaattctaaacaaacaacaaaaagagagaagaaacatctctcctctgttggaacaagaacatcaagaacaatggcttgtactaatctaacaacaatgtgggtttcatcaaaactatctgtttctgattcctcttccttgtccttccgttctattctcaacccacttcctctcccaaaccacaactcatctccttcaagatcttcctctgtctctccaatccagtcctctcttcgtgagctccgagaccgtatcgactcagtcaaaaacactcagaagatcactgaagccatgaagcttgtcgctgcagcaaaagtcaggagagctcaggaagctgtggtcaacggccgaccattctcagaaaccctagttgaagttctttacaacatcaacgaacagcttcaaaccgatgatatagatgtgcccttaaccaaaatcagaccggttaagaaagttgcactcgttgttgtaacaggagaccgaggattatgcggtggattcaacaacttcatcatcaagaaagcagaggcaaggatcaaagagcttcaaggcctaggtcttgactacacagtcattagcgtggggaaaaagggaaactcttatttcctccgtcgtccttacatccccgtcgacaagtacctcgaagccggaaccttaccgaccgcgaaagaagctcaagctgtagctgatgatgtcttctctctgtttataagcgaagaggtcgacaaagtcgagctcttgtacacaaagtttgtctctttggtcaaatcagaacccgtgatacacacgctactgcctctatctcccaaaggagagatctgtgacattaatgggaactgtgtggacgctgctgaagacgagctcttcaggttaacgaccaaagaagggaaacttacggttgaaagagagacttttcggacaccaactgctgatttctcacccatcttgcagttcgagcaagaccctgttcagattcttgatgctttgttgcctctgtatcttaacagtcagattctaagggctttacaggagtcattggcgagtgagcttgcagctagaatgagtgcaatgagtagtgcttcagataatgcttctgatcttaagaagtcgctttctatggtgtataatagaaagcgtcaagctaagatcactggctttgatcaccgaaccctagtttctctcgatcatcgattcgcttcttcttcttctttagatactgatcgaatcgccatggcaaaaaactccttcaagctttctaaccctctggaggtgagaatggctgaatctactcgtatcagagagaagtaccaagacagagttcctgtgattgtggagaaagctggacagagtgatgttcctgacattgacaagaagaagtatcttgtgccagctgatctaaccgttggacaatttgtgtacgttgtgcgcaaaagaatcaagcttggagccgagaaagcgatctttgtctttgtcaagaacacgttacctccaactgctgcattgatgtctgcaatctatgaagaacacaaagacgaagatgggtttctctacatgacatacagtggagagaacacgtttggatctgcctctgctaatattgctctgccatgacttactttgatcttctctgtgatgctctgattgtacattcgttttcccctctagcttctttcgctccgataatggatttttctttctgtggttttcactggatttgaacaaatattctattttcagttaatttgagactctgtttacattgcttttgtttcctccgtttcattcttctatcttgactcactagtcactagtcaactagtgctctctatggtcatctctgttagttacacttcatgataactgagtagaaatcacaaatgatttgagagagagtatgtactctggttctgattcttaaaatcacaaatctttgtaattgaggataatttgacatcaatgtgaagaaacaagagcttaatttcactaataaccacgagtttacattgaaaaatcttcactgtagtacaaaaactcaagctttgttgcacagtggatggatcggatctctaatgttatgaagtgttcttcaaacactaacttccatctgttatagcaaccaggaacgaaatgagaaggttcttctttgatctctctttctcatggaaatgtcagactggtttggctgtgatctaccggacaagattaaagaacaaggtcaaagaatcaacatctctcttctcagatggatccttgatcggtcttgaagagttcttggggaagacaagtatggtcgggaagctaccgagctgtaactcctgcttagcaaactccttctggtccccatcagctctgaacttcacaaccttgactccacttccagctaacttatcagccaactcagcatacgacaaaagggacaccaaggagcatacaacacaacaatccatggatcctttctgttctccaacttcatcagattctcaactccttgtctgctcaaagtcacaa

SEQ ID NO: 953 - DNA, 1077 bp, Brassica juncea
aaagatcaagaacaatggcttgcactaatctaacaacaatgtggggggtttcatcaaacccatctctttccgattcctcttccttgtccttccgctctgttctcaacccacttcctctcccaaaccacaacacctctccttcaagatcctcctccgttgctccaatccaatcctccctccgtgagctcagagaccggatcgactctgtcaaaaacactcagaagatcaccgaagccatgaagctcgtcgctgcagcaaaagtcaggagagctcaagaagctgtcgtcaacggacgacccttctcagaaaccctagtcgaagtcctttacaacatcaacgaacagcttcaaaccgatgacatcgatgtgcccttaaccaagatcagaccggttaagaaagtggcactcgttgtcgtaaccggagaccgtggattatgcggtgggttcaataacttcatcatcaagaaagcagaggcgaggatcaaagagcttaaagggttaggtcttgactacacagtcattagcgtggggaagaagggaaacacttatttcctccgtcgtccttacatccccgtcgacaagtacctcgaagccggaaccttaccgacagcgaaagaagctcaagctgttgcagatgatgtcttctctctgttttataagcgaggaagtcgacaaagtggagctcttgtacacaaagtttgtgtcattggtcaaatcagaacccgtgatccacacgctactgcctctatcacccaaaggagagatctgtgacatcaacgggaactgtgtggacgctgctgaagacgagctcttcaggttgacgacgaaagaagggaagttaacggtcgaaagagagacttttcggacaccaactgctgatttctcaccgatcttgcagttcgagcaagaccctgttcagattcttgatgcgttgttgcctttgtatctgaacagtcagattcttagggcattacaggagtctttggcgagtgagctcgcagctagaatgagtgctatgagtagtgcttcggataatgcatctgatcttaagaaatcgctttcgatggtttataataga

SEQ ID NO: 954 - DNA, 1216 bp, Brassica juncea
tcccaaaccacaactcctctccttcaagatcctcctccgtttcaccaatccaatcctcccttcgtgagctcagagaccgtatcgactccgtcaaaaacactcagaagatcaccgaagccatgaagcttgtcgctgccgcaaaagtcaggagagctcaagaagccgtcgtcaacggccgacccttctcagaaaccctagtcgaggttctttacaacatcaacgaacagcttcaaaccgatgacatcgacgtgcccttaaccaagatcagaccggttaagaaagttgcactcgtggtcgtgaccggagatcgtgggttatgcggtgggttcaataacttcatcatcaagaaagcagaggcgaggatcaaggagcttcaaggtctaggtcttgactacacagtcattagcgtggggaagaagggaaactcttacttcctccgtcgtccgtacatccccgtcgacaagtacctcgaagccggaaccttaccgaccgcgaaagaagctcaagctgttgctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgtgacatcaatgggaactgtgtggacgctgctgaagacgagctcttcaggctaacgaccaaagaagggaagctgacggtcgaaagggagacttttaggacaccaaccgctgatttctccccgatcttgcagttcgagcaagaccctgttcagattcttgatgctctgttgcctttgtatctcaacagtcagattcttagggctttacaggagtcgttggcgagtgagcttgcagctagaatgagtgcaatgagtagtgcttcggacaatgcatctgatcttaagaagtcgctttcgatggtgtataatagaaagcgtcaagctaagattactggagagattcttgagattgttgctggagctaatgcacaggcttgatttgtgttggtaccctatttgatatatgagcagaccctttttttttttatcatcgttctcgttggtataatgtataatttgtctagaacttgttctgatcttctctttaaaatcatgcaattacaaacataatgcggttgtatttattttggccttccattggataaatggtttaagaaaattgtgaatgt

SEQ ID NO: 955 - DNA, 1363 bp, Humulus lupulus
aaaacccacttaacagaccctcttctctgctcatccacaccacctcttccaccatatccaaccccctcgcagagcttcgtgaagaaaagcaatcatgtcttgctcaaatctaacaatgtgggtctcatcaaaaccttccctttccgacgcttcatccctatcctcccgctcgtttctcaccccttttcagcttccgtctcaaacttcttcacccaccccgaacccctccagatcgtcctcagtgactccgatccactgtaacctccgtgagctccgagatcgtatcgggtctgtgaaaaatacccagaaaatcactgaggccatgaagctggtggccgccgctaaagtccgtagagcacaagaagctgtcgtgaatggcagacccttctctgaaactttagttgaagttctttacaacattaacgagcagctccagacggatgacgtagaatctcctcttactaaagtcagacctgtcaagaaagttgctcttgtggttgtgacaggagaccgaggtctctgtggtggtttcaacaattttctcatcaagaaagccgaggcaagaatcgccgagttgaagagtcttggattgagctacacgatcattagcgttggcaaaaagggtaactcttactttctacgtaggccttatattccagtagataaatttctcgaagggggtaatctcccaacagccaaagaagctcaagccatagccgacgacgtcttttctctctttgttagtgaagaagttgacaaagtggagcttttgtacaccaagttcgtgtctttggtcaagtccaaccctgtaatccatactctgcttccgctctccccaaagggagagatttgtgacattaatggcgtctgtgtggacgcagctgaggatgagttcttcaggttaacgacaaaagaagggaaattgacggtggagagagattcagtgaggactgagacaatagatttctcacccattttgcagttcgagcaagacccggttcagattcttgatgccttgttgcctttatatctcaacagtcagattctaagagctctacaggagtctctggcaagtgagctggctgcaaggatgagcgccatgagcaatgccactgacaatgcatcggagcttaagaaaagtctttctatggtctacaacaggaaacgtcaagccaaaatcacaggagagattttggagattgttgctggtgccaatgccttgtcttaaacagagagagtgattggaagaaaaaaaaaaaaaaaaaagagaagataataagtgcatggttatgatgatctctgtgtaggtatttctattgggctctgcactattctttcaaacatgcatctttctgaacgattt

SEQ ID NO: 956 - DNA, 1585 bp, Quercus alba
gaagataagacttcacaaaaagaaaaaccaaacccacatagcagaccctctttctctccccatcgttagtccctccatagctcaaaaacctccattaaaaccatgtcttgctcaaatttaacaatgtgggtgtcctcaaaaccttccctttctgatgcatctgcactttccttccgttctttcctcaacccttttcaggttccttctcataactcaacctcttgcaatccttctcgatctgtaactccaatccattgtggtctccgtgagctcagagagcgtattgattctgtaaagaacacacagaagatcactgaggctatgaagcttgttgctgctgctaaagtcaggagagcacaagaagctgttgttaatggcaggcctttctcagaaactcttgtagaagtactttacaacatcaatgagcagctacaaactgatgatgtagatgtccctcttacaaaggttaggcctgtcaagaaggttgctttggttgttgtcactggtgataggggtctttgtggtaatttcaacaatctactcatcaaaaaagctgaggcaaggattgctgaattgaaggatcttggtcttgattatactgttattagtgttggtaaaaagggtaactcttacttccgcaggaggccttatattccggttgataagtttcttgagggtggttcacttcctactgctaaagaagctcaggctattgctgatgatgttttctcattctttgttagtgaggaggttgataaagttgagcttttgtacaccaagtttgtgtctttggttaagtctagtccagttattcataccttgcttccactctcaccaaagggagagatttgtgatataaatggaacatgtgtggatgctgctgaggatgagtttttcaggctaacaactagggaggggaaattgacagtggagagagatgttgtgaggactaagacagtagatttctcaccaattttgcagtttgagcaggacccagttcagattcttgatgctttgttgcctctctatttgaacagtcagattttgagggcattgcaggaatcactagcgagtgagcttgctgctaggatgagtgccatgagcagtgcatctgataatgcatctgagctaaagaagtccctgtctatggtctacaataggcagcgccaggccaaaattacaggcgagatattggagattgttgctggtgccaatgctcaaatctagtgaaaccctggttcttgtgtcccccacagtttgcttcttagtaggtacttttatgggggtttcttaatttattcaaatatgcttgtttaagaacagttattcagaatttacactttttcattgtaattctcatgcgtatgaactttgtgcacaatgagaactgcaatgtattttggaacataggagcaatattcttacttttttttttttttattttgttatttttttcttaccattataaacttgtattatttgaaattctcattgcatggtacgctgagttataatctatgcaataactgtacattgctgtgttattgcagctcttattaatttccatggtcacttgataattgat

SEQ ID NO: 957 - DNA, 1541 bp, Cleome spinosa
taagagcatgccaagtcagcaagtgaggatcttttgtcctaacaaaatacaaaacagaaccttatctcgaaacctcatccgtctccttctctttcctccactcgatttcctccctcctctcttatcaccagagagaagaaagagataagcaacttctggaaagaaaaaaaaagacttcgagcaagatcagtgaacaagcgacatgtcttgctctaatctgacaatgtgggtttcatcaaaaccctcccttcccgattcatctgccttgtccttccgctcagttctcagcccacttcaccatcatctccctaattacagctccaactccaacgtctcttccagatcctcgtctgtgacgccgatccaatgcggtctccgggagctcagagaccgtatcgattctgtgaagaacacccagaagatcacggaagccatgaagctcgtcgccgctgcgaaagtcaggagagctcaggaagctgtcgttaatggaagacccttctccgaaaccctagtcgaggttctttacaacatcaacgagcagcttcagacggatgacatcgatgtccctctcaccaaaatcagacccgtcaagaaagttgctttggttgtcgtcaccggggatcgcggcctgtgcggtggatacaacaatgcaatcatcaagaaagctgaagcaagaatcgctgagctcaagggtctgggccttgactacacggtcatcagcgttgggaagaaggggaatgcatatttcatccgaagaccgtacattccagtcgacaagttcctcgaagcaggtaatctcccgacagcaaaagaagcacaggccatagccgacgatgtcttttccctgtttgtgagcgaggaagtggacaaagtcgagcttctctacacaaagttcgtctctttggtgaaatccgacccagtgatccacactttgcttccactctcgccgaagggagagatctgcgacatcaacggaaactgcgtggacgctgcagaggacgagctgttccggctaacgaccaaggaagggaagttgacggtggaaagagagaccattcggacagcaactgtggatttctcaccgatcttgcagttcgagcaagacccagttcagatcctcgatgctctactgcctctctacctcaacagccagatcttgagggctttgcaggaatctttggcaagtgagcttgctgccagaatgagcgccatgagcagtgcctccgacaatgccgtggagctcaagaagacgctttccaccgtctacaacaggcagcgtcaagccaagatcaccggcgagatcctcgaaatcgtcgccggagcaaatgccttggtctgatctatatatacatatatatatgtattgatatattgatggcctcgttttgtaggttatacaaaaaaaaagtggaattctaattatgagtctctttgctcatatcgtttgtataataagactcacactctcgtttggttggcattatataaaaaatatccaccatttgctattttgaattcaaaacatatctttcttcgactat

SEQ ID NO: 958 - DNA, 1554 bp, Cucurbita pepo
ctgtcgaaatcgttatccttaagcctcatcctctctcagatttccactcctttcttgcggaccagaaccaccatcgccaatgaatgaagataagacttcactcaaacaataacccgaccccttctctgcacctcctcttctccgccaatctacaccttcctcctccgctgctacaccatgtcttgttcaaatctcaccatgttggtgtcctcaaaatccaccgtctctgatgcctcctccctttcattccgatcagttctaagcccttttaacctcccttcccacaacccaacctcatcctaccctacccgatcatggtcagttaccccaattcattgcggtcttcgggatctccgagaccgtatcgattcagtgaagaacacccagaagatcactgaagctatgaagcttgttgctgctgccaaagtccgcagagctcaagaagctgtcgttaatggaagacccttctcagaagccttggttgaggtcctttacaacatcaatgagcaacttcaaacagaagacgtagatgttcctttaaccaaagtaagaccagtcaagaaagttgcattagttgttgtcaccggcgacagaggtctttgcggcggtttcaacaactccatcatcaagaaagctgaagccagaatctcggaattgaaggaattgggtcttgactacactgtcatcagcgttggcaaaaagggtaactcctacttcctccgtcggccttacattccggtcgataagttcctcgaaggcggcacgcttccgacagccaaagaagctcaagccattgctgatgatgtcttctccctgttcatcagtgaggaggttgacaaagtagagcttttgtacaccaaattcgtgtcattggtcaaatccgaccctgttattcacacccttcttccgctgtcgcccaagggcgagatctgtgacataaacggtgtctgtgtcgacgccgccgaagatgaatttttcaggttgacaacaaaggaagggaagctgacagtggagagggatacggtgaggacaagcacctcagatttctccccaattttggagtttgagcaagacccagttcagatcttggatgctttattgcctctgtatttgaacagccagattttgaggtcactgcaggagtcactggccagtgagctcgcagctagaatgagcgccatgagcagtgcaagtgacaatgcttctgagctgaagagatctctgtcgatggtgtacaacagacagcgccaagctaagatcactggagaaatattggagattgttgctggtgctaatgccttgacatgatctcttccttcccttcccttatatacttcaacccatgtttctatatccactcatatcattcaattctgcaattttatcaaatatatgcgaactgtaagcctttcatattcgtgcaaactttatcttcccttggaactgtcaactttttaaagcaattccagtctctactgcctatattctatcgtaattgcttgtcttgtcttgaacatatatttaacaattgaattatgttcgagtattctacgt

SEQ ID NO: 959 - DNA, 1391 bp, Euonymus alatus
gactgcctccatctccctccactcattctttctcttttcttcctaatttaccaaacaaaactactcctacaacacatgaagaagataagcctctggctctgagaaaaacatatctttctcctcttcttgtactctcttagcaattcagacactgaaaaccatgtcttgctcgaatctaacaatgtgggtttcctcaaaaccctcccttgctgacccctccagcctctccttccgttcctctatcagccagtttcaacttccaaaccacaattcattccccagcagcccctccagatcctcctccgtgactccgattcagtgcagtcttcgagagattcgtgatcgtattgattcagttaagaatacgcagaagatcactgaggccatgaagcttgttgctgctgccaaagtgaggagagcacaagaagctgttgtcaatggaagacccttttctgagacccttgtagaggttctttacaacatcaatgagcagctccagactgaggatgtcgatactcccctcaccaaagttaggcctgtcaagaaagttgctttggttgtttgcactggtgaccgtggtctttgtggtggtttcaacaattttatcatcaagaaagcagaagctaggattgcagaattgaaggatcttggtcttgaatatacagtaataagtgttggaaagaagggtaatacttattttctaaggagaccttatattcctgtagataagtttcttcgagggagggtcattgccaacagctaaagaagctcaggcaattgcagatgatgtgttttcactctttgttagtgaagaggttgataaggttgaacttttgtataccaagtttgtgtcattggttaagtctgctcctgtaatccatacgttgctaccattatcaccaaagggagagatctgcgatttgaatggaaactgtgttgatgcagctgaggatgagttctttagactgacaactaaagaagggaaattgactgtggaaagggattcaatgaggactcagacagataatttctctccaattctgcagtttgagcaggacccagttcagattcttgatgccttattgcctttgtacctaaacagccagattttgagagcactgcaggaatcattggctagtgaacttgctgccaggatgagtgcaatgagcaatgcttctgataatgcagcggaactgacgaagaacctctcactcatttacaatcggaagcgccaggccaagattacaggggagatattggagattgttgctggtgccaatgctcaaggctagtgaattgtacatctccacagtcctcacaccaggcaggcctcacaagttactctgcttctttagtaggtgattttgtgaatgcttccttgtcgttcaaaa

SEQ ID NO: 960 - DNA, 2019 bp, Cannabis sativa
cactgagccaactcggatgatcatgatgccatggaagttacttattaggaccccactctcaaattcctgtccaaacattagattaccaacgctcgaaatccttatctccaaacctcatcctttccctccttcttcctccactcatttttcccactccatatcacaactaataaacacatcaacaagataagatttcatttcaccattaccaaataccattttgtcaaaaaataccacttaacacacaccctcttcctcttctcttctcttttcttcttcttcttcttccgccatttccaaccccttcctccttaaccaaagcttcgtgaagaaattcaaccatgtcttgctcaaatctaacaatgtgggtctcatcaaaaccttccctttccgaagcttcaaccctttcctctcgctctttcatcaccccttttcagcttccctctcaatcttcttccccaaccccaaacccttcctctagatcatcctcagtcactcccatccactgtaacctccgtgagcttcgtgaccgtattgggtctgtcaaaaatacccagaaaatcactgaggccatgaagctcgtcgcagccgctaaagtccgtagagctcaagaagccgtcgttaatggcagacccttctctgaaactctggttgaagttctctacaacattaacgagcaactccaaacagacgatgtagaatcccctcttactaaagtaagacctgttaagaaagttgctcttgtggttgtgacaggagacagaggactctgtggtggtttcaacaacttcctcatcaagaaagccgaggcaagaatcgccgaattgaagagtcttggattgagttacacagtcattagcgttggtaaaaagggtaactcttactttcttcgaaggccttatattccagtagataaatttctcgaagggggtaatcttccaacagccaaagaagctcaagccatagccgatgatgtgttttctctctttgttagtgaagaagttgacaaagttgagcttttgtacacaaagtttgtatctttagtcaaatccaaccctgtaatccacactcttcttcctctctcaccaaaaggagagatttgtgacattaatggagtctgtgttgatgcagctgaggatgagttcttcaggttaacaacaaaagaaggaaaattgactgttgaaagagattcagttaggactgagacattagatttctcaccaatcttgcagtttgagcaagacccagttcagattcttgatgccttattgcctttatatctcaacagtcagattctaagagctttacaggagtctttggcgagtgaactagctgcaaggatgagcgccatgagcagtgccactgataatgcatctgagcttaagaaaaatctttctatggtttacaacaggaaacgtcaagccaaaatcacaggagagattttggagattgttgctggtgccaatgccttgtcttgagttaaaaaacagagagtgtttcgaaaaaaagaagaagaaaataaatgcatggttatgatctctgtgtaggtatttgtattgggctctgcgctattctttcaaacatgcatctttctgaacgatttaaaaaactttttatatataatatactttcttcattgtaattctcaaactgagtataaactttgtgcactatgagaactgcaatgtattttggaacaagctatattgatgacagcaataagttcttttttgtacttaatattgtttttactacccccttgatttactaataataaatacttgatttaatcatctgggggcaaatgatctaaatatttgtactttaattgtatgagatgtgtttattgttcttacctgtgtttccctttattcatgttaaatagattataattctttgcagagctgtgttgtgattgatcgatccattcaattgatatctagagactagaattgtgattaattgaaatagttggtctgattgtagcagtctcaatgttgtatttaagatattattttc

SEQ ID NO: 961 - DNA, 1766 bp, Cannabis sativa
caacgctcgaaatccttatctccaaacctcatcctttccctccttcttcctccactcatttttcccactccatatcacaactaataaacacatcaacaagataagatttcatttcaccattaccaaataccattttgtcaaaaaataccacttaacacacaccctcttcctcttctcttctcttttcttcttcttcttcttccgccatttccaaccccttcctccttaaccaaagcttcgtgaagaaattcaaccatgtcttgctcaaatctaacaatgtgggtctcatcaaaaccttccctttccgaagcttcaaccctttcctctcgctctttcatcaccccttttcagcttccctctcaatcttcttccccaaccccaaacccttcctctagatcatcctcagtcactcccatccactgtaacctccgtgagcttcgtgaccgtattgggtctgtcaaaaatacccagaaaatcactgaggccatgaagctcgtcgcagccgctaaagtccgtagagctcaagaagccgtcgttaatggcagacccttctctgaaactctggttgaagttctctacaacattaacgagcaactccaaacagacgatgtagaatcccctcttactaaagtaagacctgttaagaaagttgctcttgtggttgtgacaggagacagaggactctgtggtggtttcaacaacttcctcatcaagaaagccgaggcaagaatcgccgaattgaagagtcttggattgagttacacagtcattagcgttggtaaaaagggtaactcttactttcttcgaaggccttatattccagtagataaatttctcgaagggggtaatcttccaacagccaaagaagctcaagccatagccgatgatgtgttttctctctttgttagtgaagaagttgacaaagttgagcttttgtacacaaagtttgtatctttagtcaaatccaaccctgtaatccacactcttcttcctctctcaccaaaaggagagatttgtgacattaatggagtctgtgttgatgcagctgaggatgagttcttcaggttaacaacaaaagaaggaaaattgactgttgaaagagattcagttaggactgagacattagatttctcaccaatcttgcagtttgagcaagacccagttcagattcttgatgccttattgcctttatatctcaacagtcagattctaagagctttacaggagtctttggcgagtgaactagctgcaaggatgagcgccatgagcagtgccactgataatgcatctgagcttaagaaaaatctttctatggtttacaacaggaaacgtcaagccaaaatcacaggagagattttggagattgttgctggtgccaatgccttgtcttgagttaaaaaacagagagagtgtttggaaaaaaagaagaagaaaataagtgcatggttatgatctctgtgtaggtatttgtattttgggctctgcactattctttcaaacatgcataatatatataatatactttcttcattgtaattctcaaactgagtataaaatttgtgcactatgagaactgcaatgtattttggaacaagctatattgatgacagcaataatttcttttttgtacttaattgtttttactacccctttgatttactaataataaatacttgatctaatcattttggggcatatgattaaatatttgtactttaattgtatgagatgtgtttattgttcttacctctgtgtttccctttatt

SEQ ID NO: 962 - DNA, 1552 bp, Cleome gynandra
tccgtttcgttactctctctcctcttcctccactcaaattccactcttcttgttctctcttattaggagagaagagagataagtcaagtaaagccgtcgctgtaacgaaactactgaaaactttctcttttctgttcaggcaagaccggtgatttgtgtagctccgggaatccgtggacgccgccatgtcttgcactaatctgacaatgtgggtttcaccaaaaccatctctttctgattcctcttcattgtccttccgctcggttctcagcccacttcagctccctaattacaactctgccaccggcgccaacggctcttccagatcctcgtctgtgatgccagtccagtgtggactccgggagcttagagaccgtattgattcagtgaagaacacgcagaagatcacagaggccatgaagctcgttgctgcagcaaaggtgaggagagctcaagaagctgttgttaatggtaggccgttctctgaaaccctagttgaggttctttacaacatcaatgagcagcttcagacagatgacatcgatgttcctctcaccaaaatcagacctgtcaagaaagttgcgttggttgtcgtcacgggtgatcgtggcctctgtggtggcttcaacaatttaatcatcaagaaagctgaggcaaggattagagagctcaaggagcttggcgtcgagtacacagtcatcagtgtcggcaaaaagggtaatacatatttcatccgacggccttacattcctgtcgacaaatttcttgaagcgggtaatctccccacagccaaagaagctcaagctatttctgacgatgttttctccctcttcgtaagcgaggaagtcgataaagtcgagcttctctacacgaaatttgtctcattggtgaaatcgagccccgtgattcacacgttactcccgctctcaccaaaaggagagatctgtgacataaatgggaactgcgttgatgccgcggaagacgagatgttcaggttaacgacgaaagaagggaagttaactgtggaaagagagacggttcggacagcaacagcggatttctcgccgatcttacagtttgaacaagaccctgttcagatccttgatgctctgttgcctctttatctcaacagccaaatcttgagggctctgcaggaatcattggccagtgaactggcagctcgaatgagcgccatgagcagcgccaccgataatgctgttgagctcaagaagacgctttccattgtctacaaccgccagcgtcaagccaagatcaccggcgagattcttgaaatcgtcgccggagcaaatgccttgatttgatttatatgtatatacacacacatatatacatgtatgtgtgtgtatgtatatctctcttcatgatcccgactcgacgtcgttttgtgggtataaaactaaaaaggtggaatttttatgagtctctttgctcatttcgtttgtataataatgattcacacgttattgaattgtaataatcatctcttgcatatcaattttggcctattttacatgtaattacttatttaaag

SEQ ID NO: 963 - DNA, 1551 bp, Citrullus lanatus
aactgtcgaaatcgttatccttaagcctcatcctctctcagtgttgtactccactcatttctcactcctttcttgcgaaccagaaccaccattgccaatgaatgaagataagactttaccccaagaataacctgaaccccttctttgcagcttctcttcgccgccaatctagagctcacctccctcctcggctgctaaaccatgtcttgttcaaatctgactatgtgggtgtcttcaaaacccaccgtttctgatgcatcctccctttctttccgctcatttttgagcccttttcagcttccttcccagaattcgagctcaacttaccctggccgatcatgctcagtttctccaatccactgtggtcttcgggagcttcgagaccgtatcgattcggtgaagaacacccagaagatcactgaagctatgaagcttgttgctgctgccaaagtccgcagagctcaagaagctgttgtaaatggaagacccttctcagaagctttggttgaggttctttacaacatcaatgagcaacttcaaacagaagatgtcgatgttcctttaaccaaagtaagacctgttaagaaagttgcattagttgttgtcactggtgaccgaggtctttgcggtggtttcaacaacagtatcattaagaaagctgaagctagaatatcggaattgaaggcacttggtcttgattacactgtcattagcgttggtaagaagggtaattcctatttccttcgccggccttacattccagttgataagttccttgaaggtggcactcttcccacagctaaagaagctcaagcaatagctgatgatgttttctcactctttgttagtgaggaagttgataaagtagagcttttgtacaccaaatttgtgtctttggtaaaatctgatcctgttattcacactcttcttcctctctcacccaagggtgagatctgtgatataaatggagtctgtgtagatgctgcagaagatgagtttttcaggttgacaacaaaggaagggaaattgacagttgaaagggattcagtgaggacaagcacatcagatttctccccaattttggagtttgagcaagacccagttcagatcttggatgctttattgcctctgtatttgaacagccagattttgagggcattgcaagagtcactggccagtgaacttgcagctagaatgagtgctatgagtaatgcaactgataatgcttctgagctgaagagaactctgtctattgtttacaatagacagcgccaagctaagattactggagaaatcttggagattgttgctggtgctaatgccttgacttaatttggtgtttgtgtatatctcccatgtttgcttgctttttccccttcttccctttacatacttcaacccatgtttctatattcaatgatatcattcaaattatgcaatttctatagaatatatgcaaactgtaagtctttcatattctgcttcttcacttcttgctaaatctatattcccttggaactgttaacttttgaatgaatccataatcatttg

SEQ ID NO: 964 - DNA, 1403 bp, Cucumis sativus
gctaaccagaaccaccatcgccattgaatgaagataagactttaccccaagaataacctgaaccccttctgtgcaggccctcttctccgccaatccacagctcacctccctccctcggctgctaaaccatgtcttgttcgaatctgactatgtgggtgtcttcaaaacccaccgtttctgatgcatcctccctgtctttccgctcttttttgagcccttttcaacttccttcccagaattcaacccctgctcgatcatggtcagttactccaatccattgcggtcttcgggaactccgagaccgtatcgattcggtgaagaacacccagaagatcactgaagctatgaagcttgttgctgctgccaaagtccgtagagctcaagaagctgttgttaatggaagacccttctctgaagccttagttgaagtcctttacaacatcaatgagcaacttcaaacagaagatgttgatgttcctttaaccaaagtaagacctgttaagaaagttgcattagttgttgtcaccggtgatagaggactttgtggtggtttcaacaatagcatcattaagaaagctgaagctagaataaaggaattgaaggcccttggtcttgattacactgtcattagtgttggaaagaagggtaattcttatttccttcgccgaccgtacattcctgtcgataagttccttgaaggtggtactcttcccacagctaaagaagctcaagcgatagctgatgatgttttttcactctttgttagtgaggaagttgataaagtagagcttttgtatacaaaattcgtgtcattggtaaaatctgatcctgtaattcatactcttcttcctctatcaccaaaaggtgagatctgtgatataaatggagtctgtgtagatgctgcagaagatgagtttttcaggttgacaacaaaggaagggaaattgacagtagaaagggattcagtgaggacaagcacatcagatttttcaccaattttggagttcgagcaagacccagttcagatcttggatgctttattgcctttgtatttgaacagccagattttgagggcattgcaagagtcattggccagtgaacttgctgctagaatgagtgctatgagtaatgcaaccgataatgcttctgagctgaagagaactctgtctattgtgtataatagacagcgccaagctaagattactggagaaatcttggagattgttgctggtgctaatgccttgacttaatttgatgtttgtgtatatctcctcccatgtttgcttggtttttcccccttccttccctttacatacttcaaccggccatgtctctatattcaatcatatcattcaaattatgccatttctatagaatatatgcaaattgtaagtcttctttca

SEQ ID NO: 965 - DNA, 1738 bp, Cleome gynandra
tcggggacctcatccgtttcctctctccctcgtcacttcctccactcaaaagttccctctaattatttttcactcatcttaggagagaagaaagataagggaagtgaagtcggaactactcagaacttgtgtctgcttttcgagcaagatcggtgtagtttctagaatctgtgaacacgacgatgtcttgctctaatctgacaatgtgggtttcaccaaagccttctctttccgattcctctgccttgtccttccgctcagttctcagcccacttcagctcttcaattacaattctgccaccggcgccaacagctcttccagatcgtcgtctgttacgccggtccaatgtggtctccgggagcttagagaccgtattgattcagtgaagaacacccagaagatcacagaggccatgaagctcgttgctgcagcaaaagtgaggagagctcaggaagctgttgttaatgcaaggcccttctctgaaaccctggttgaggttctttacaacatcaacgagcagcttcagacagatgacattgatgtccctctcaccaatatcagacccgtcaagaaagttgctttggttgtggtcactggagatcgagggctctgtggtggcttcaacaacgcaatcatcaaaaaagccgaagcgaggatcgcagagctcaaggaccttggtcttgagtacacagtcataagcgtaggcaaaaagggtaattcatatttcggccgcaggccatacattccagtggacaggtttatagaagccggtaatctcccgacagcaaaagaagcacaagcaatagctgacgatgtgttttccctgtttgtgagcgaagaagtggacaaagtcgagcttctctacacaaagtttgtctctttggtgaaatctaaccctgtgattcacactttgctcccactctcgcctaaaggagagatctgtgacataaatgggaactgcgttgatgctgcagaggatgaactcttcaggttaacgacgaaagaagggaaactaacggtggaaagagagaccattcggtcatcaactgcggatttctcacccatcttgcagtttgagcaagacccagttcagatcctcgatgctttgttgcctctttacctcaacagccaaatcttgagggctctgcaggaatcacttgccagtgagctagcagctcgaatgagtgcaatgagcagtgcaaccgacaatgccgtggagctcaagaagacgctttcaattgtctacaataggcaacgtcaagccaagatcactggcgagattctcgaaatcgtcgccggagcaaatgccttggtatgatggatcatatcatatatacatctctccatggactcggctcgtcttcattttgtaggtaagaaaaaaagtggaatttatatgagtctctttactcatttcgcttgtataatgaaattaacactcttattcatgaattgtaatcagtagacaccccataataatccatcgtttccatatgcgatagatgttttgcatttgaacagcagaagaactctccatgttgaacataagatcggttatgtgttcacatagttaaaaacgtacataaagaaatcatttggatttagtattttcggatttggattttgtataatcttcattaagtccatataactcgctagaatccttgcttgtataagaaataaagaaatatgaaggacatggattctgattgcggattctatatgcttaaattgtta

SEQ ID NO: 966 - DNA, 1356 bp, Castanea mollissima
ccatagttagtacctccatagctcaaaaacctccattaaaaccatgtcttgctcaaatttaacaatgtgggtgtcctcaaaaccttccctttctgatgcatctgcactttcctttcgttctttcctcaacccttttcaggttccttctcataactcaacctcttgcaatccttctcgatctgtgactccaatccattgtggcctccgtgagctcagagagcgtattgattctgtaaagaacacacagaagatcactgaggctatgaagcttgttgctgctgctaaagtcagaagagcacaagaagctgttgttaatggcagacctttctcagaaactcttgtagaagtactttacaacatcaatgagcagctacaaactgaggatgtagatgtccctcttacaaaggttaggcctgtcaagaaggtttgtctggttgttgtcactggtgataggggtctttgtggtaatttcaacaatcaactcatcaaaaaagctgaggcaaggatggctgaattgaggggccttggtcttgattatactgttattagtgttggtaaaaagggtaacacttacttccgtaggaggccttatattccggttgataagtttcttgagggtggttcactccctactgctaaagaagctcaggctattgctgatgatgttttctcattctttgttagtgaggaggttgataaagttgagcttttgtacaccaagtttgtgtctttagttaagtctgatccagttattcataccttgcttccactctcaccaaagggagagatttgtgatataaatggaacatgtgtggatgctgctgaggatgagtttttcaggctaacaactagggaggggaaattgacagtggagagagatgttgtgaggactcagacagtagatttctcaccaattttgcagtttgagcaggacccagttcagattcttgatgctttgttgcctctctatttgaacagtcagattttgagggcattgcaggaatcactagcgagtgagcttgctgctaggatgagtgccatgagcagtgcatccgataatgcatctgagctaaagaagtccttgtcattggtctacaataggcagcgccaggccaaaattacaggcgagatattggagattgttgctggtgccaatgctcaaatctagtgaaaccctgtttcttgtgtcccccacagtttgcttcttagtaggtacttttatgggggtttcttaattcattcaaatatgcttgtttaagaacagttattcagaatttacactttttcattgtaattctcatgcgtatgaactttgtgcacaatgagaactgcaatgtattttggaacataggagcc

SEQ ID NO: 967 - DNA, 1622 bp, Cucumis melo
gacccttttctctgaatcaaagccgataaggtctgccattaaaaatcatggcttgctcaaacttggcaatgtgggtatcctcaaaaccgtcttcatccgattcctctgctctttcttttcggccagtcaatcctcttcaagttccttcccaaggctccgcttcgcgatcctcatctgtctctcccattcagtgcggtctacgtgagcttcgagaacggatcgattcagtgaagaacacccagaaaattactgaggctatgaagcttgttgctgctgccaaagttcgtagagctcaagaagctgttgttaatggaagaccattctcggaatctctagttgaagtactttacaatatcaatgagcagctccaaaccgaggatatagatgttcctctgactaaagttcgaccagtcaagaaggttgctttgattgttgtaacaggggatcgaggcctctgcggcagtttcaataacatgatcataaaaaaggcagaatccagaatcgcggaattgaagacccttggccttgattatacagttattagcgtcggcaagaaggggaactcgtatttttctcgccggccttacatcccagtagatagatttctcgagggcggttcacttccaacagctaaagaagctcaagccattgcagacgatgttttttccctctttataagcgaagaggtcgacaaagtcgagcttctgtacaccaaattcgtgtcattagttaaatcagacccggtgatccacactttgcttccattgtcacctaaaggagagatctgtgatataaatggtgtttgtgttgatgccgcagaggatgagttcttcagattgacgacaaaagaaggaaaattgactgtagagagagatgccgtgaggacaaaaacctcagatttctccccaattttgcagtttgagcaagacccagttcagattcttgatgctttattacctctctatttgaacagtcaaattttgagatcattacaggaatcgttagctagtgagcttgctgctagaatgagtgccatgagcaatgcaactgataatgccagcgagttgaagaagacattgtctattgtttacaacagacagcggcaagccaaaatcactggcgagattttggagattgttgccggtgccaacgctttgacttgagtcagtttatgctacttttaggtactttcactgagaattcaataaaaataaactatgcacatttaagaattataacatattcaacaaattccttagacaagtgcaatgagacaatgaggcaaagtgtcttggaaaataagacaattctctactcggtgttccactttttagtctttttggtgctatgatgttaataattcttgtatttgcactttctggtgcagctccgccttcttaagcattgttggagtacacatatttataataatggtatctattcggccttttggcttttggagtaccaaagtttcgtccaaactctttattgcgtcccttttcatattagctttgtttttacatagaataattcatgtgcttctttaagccaacacattactgaacaatagttatttcaatgtcaaagattattggatcaatgattctaacaaaatagtagac

SEQ ID NO: 968 - DNA, 1866 bp, Phaseolus coccineus
ccacatcagaatttggacccacagtaattcccttaagtggctctctcctcattccaccacttcaaaatcgttatctccaaacctcatccacttcctatcaccacctccactcatttcccacttgtaacttccatggcaattgagaatcctaacccaacataacacaaaacaactcattaacacaaggagaggataagcccctctctctcactcaaagaaacaaaacacaagaaggaaaaaaaatctcaaaataaagcaaccaaacccacacacctaaacatcctcaatctcctcagagacgagatcaacaaacaatgtcttgctccaatctcacaatgcttgtgtcctccaaaccttccctctccgacccctccaacctctccttccgctccgtcctcaacccttttcagctcccttcacaaaacccaacttcatgcaccccttcacgctcttcctccacccaagttcagtgtggtctccgagagctcagaacccgaattgattccgtcaaaaacactcagaaaatcaccgaggcaatgaagcttgtggcagctgcaaaagtgagaagagctcaagaagctgtggtcaacgcaagacccttctcagagaccctcgttgaagtcctctacaacatcaacgagcagctacaaaccgaggacgtagacattcctctaacaaaggtgaggccagtgaagaaggttgcacttgtcgtgtgcaccggcgatcgcggcctctgcggtggattcaacaacgcaatcattaagaaagctgaggcaagaatcaaggagttgacggcacttggtttggaatacactgtcataagtgttggcaaaaagggtaactcttatttccttcgaaggccttatataccagttgacaggtttctagaaggtggttcacttccaactgctaaggaagctcaggctatagctgatgatgttttctcactgttcgtgagcgaagaggttgacaaagtggagcttctgtacactaagtttgtgtcattggtgaagtcagatccggtgattcacactttgcttccattgtcaccaaagggagagatttgcgatgtgaatggtgtgtgtattgatgcagctgaagatgagttcttcaggttgaccaccaaggagggaaagttgaccgtggagagagatgttgtgaggactaagactccggaattctcagcaattttgcagtttgagcaagacccggttcagatccttgatgctttgttgcctttgtatttgaacagccagatactgagggcgttgcaggagtcgctggccagtgaacttgctgcaagaatgagtgctatgagcaatgcatcggacaatgcttcagacttgaagaagaaattgtccactgtctacaatagggagcgccaggctaagatcactggcgaaattctggaaatcgtggctggtgccaatgccttgcaatagtgcgatttgtaggagataagcaccaaaagtataagagtgaagaaattgttctggcgctttccaaaggaggtcttgtcttctcttcaacttggttctgatttctaaagctgaaaagttttttgttcttcaattctatgatggagctgtagggaaaaggaatacgagtacagagaacaccaagtctgaacaaattacctgcaaaaaaacataacatgcacaatttgttatttgtataataaatcatgtgaaaagtaatatgaaccttttgtcatccatttgatgttcgaatttgtggtgacattatatacgcataaactttctcttaaacacactcaaaccaaattaatcacgctttgttgaatatcattggaatgaacacttctaaataccggaaatcaaagctttaattgccacagaaaaaaag

SEQ ID NO: 969 - DNA, 1521 bp, Phaseolus coccineus
cacaagaaggaaaaaaaatctcaaaataaagcaaccaaacccacacacctaaacatcctcaatctcctcagagacgagatcaacaaacaatgtcttgctccaatctcacaatgcttgtgtcctccaaaccttccctctccgacccctccaacctctccttccgctccgtcctcaacccttttcagctcccttcacaaaacccaacttcatgcaccccttcacgctcttcctccacccaagttcagtgtggtctccgagagctcagaacccgaattgattccgtcaaaaacactcagaaaatcaccgaggcaatgaagcttgtggcagctgcaaaagtgagaagagctcaagaagctgtggtcaacgcaagacccttctcagagaccctcgttgaagtcctctacaacatcaacgagcagctacaaaccgaggacgtagacattcctctaacaaaggtgaggccagtgaagaaggttgcacttgtcgtgtgcaccggcgatcgcggcctctgcggtggattcaacaacgcaatcattaagaaagctgaggcaagaatcaaggagttgacggcacttggtttggaatacactgtcataagtgttggcaaaaagggtaactcttatttccttcgaaggccttatataccagttgacaggtttctagaaggtggttcacttccaactgctaaggaagctcaggctatagctgatgatgttttctcactgttcgtgagcgaagaggttgacaaagtggagcttctgtacactaagtttgtgtcattggtgaagtcagatccggtgattcacactttgcttccattgtcaccaaagggagagatttgcgatgtgaatggtgtgtgtattgatgcagctgaagatgagttcttcaggttgaccaccaaggagggaaagttgaccgtggagagagatgttgtgaggactaagactccggaattctcagcaattttgcagtttgagcaagacccggttcagatccttgatgctttgttgcctttgtatttgaacagccagatactgagggcgttgcaggagtcgctggccagtgaacttgctgcaagaatgagtgctatgagcaatgcatcggacaatgcttcagacttgaagaagaaattgtccactgtctacaatagggagcgccaggctaagatcactggcgaaattctggaaatcgtggctggtgccaatgccttgcaatagtgcgatttgtaggagataagcaccaaaagcataagagtgaagaaattgttctggcgctttccaaaggaggtcttgtcttctcttcaacttggttctgatttctaaagctgaaaagttttttgttcttcaattctatgatggagctgtagggaaaaggaatacgagtacagagaacaccaagtctgaacaaattacctgcaaaaaaacataacatgcacaatttgttatttgtataataaatcatgtgaaaagtaatatgaaccttttgtcatccatttgatgttcgaatttgtggtgacattat

SEQ ID NO: 970 - DNA, 1638 bp, Vigna unguiculata
ctcattcacacaaggagaggataagaccactctctctcacactcacagaaacaaaaacaaggaggaaaaaaatctcaaaataaagcaaccaaacccacacaccaacaccctcctcaatctcctcaaacacaagatcaacgaacaataatgtcttgctccaatctcacaatgcttgtgtcctccaaaccttccctctccgacccctccaacctctccttccgctccgttctcaacccttttcagctcccttcacaaaacccaacttcatgcaccccttcacgctcttcctcaacccaagttcagtgtggtctccgagagctcagaacccgcattgattctgtcaaaaacacgcagaaaatcaccgaggctatgaagcttgtggcagctgcaaaagtcagaagagctcaagaagctgtggtcaacgcaagacccttctcagagaccctcgttgaagtcctctacaacatcaacgagcagctccaaaccgaggacgtagacattcccctaacaaaggtgaggccagtgaagaaggttgcacttgtcgtgtgcaccggcgatcgcggcctctgcggcggcttcaacaacgctatcataaagaaagctgagagtagaattaaggagttgaaggaacttggtttggaatacactgtcataagtgtcggcaaaaagggtaacacttatttcattcgaaggccttatataccggttgacaggtttctagaaggtggttcacttccaactgctaaggaagctcaggctatagctgatgatgttttctcactgttcgtgagtgaagaggttgacaaagtggagcttctgtacactaagtttgtgtcattggtgaagtcagatcctgtgattcacactttgcttccactgtcaccaaagggagagatttgtgatatcaacggtgtgtgtgttgatgctgctgaagatgagttcttcaggttgaccaccaaggagggaaagttgaccgtggagagagatgttgtgaggactaagactacggattactcaccaattttgcagtttgagcaagacccagttcagatccttgatgctttgttgcctttgtatttgaacagccagatactgagggccttgcaggagtctctggccagtgaactcgctgcaagaatgagtgctatgagcaatgcaacggacaatgcttctgatttgaagaagaagttgtccattgtctacaatagggagcgccaggctaagatcaccggcgaaattctggaaatcgtggctggtgccaatgccttgcaatagtgcaatttgttctggtttgatctcaggagataagcacctaatgcattagagtgaagaaattgttctggagcttctcaaaggaggtcaaagtacctttttatgtcttgtcttctcctcaacttggttctgatttcttctaaagcagaaaagttcattgttcttcaattctatgatggagctgtagggaaaaggaatatgagtacagagaacaccgagtctgaacaaattacttgcaaaaaaatgacatgcacaatttgtatttgtatactaaatcatgtgaaaagtaatataaaccctttgtcatccatctatttgacattcgaatttgtggtgccattatataagcagaaactttttcttaaa

SEQ ID NO: 971 - DNA, 1614 bp, Vigna unguiculata
aagaccactctctctcacactcacagaaacaaaaacaaggaggaaaaaaatctcaaaataaagcaaccaaacccacacaccaacaccctcctcaatctcctcaaacacaagatcaacgaacaataatgtcttgctccaatctcacaatgcttgtgtcctccaaaccttccctctccgacccctccaacctctccttccgctccgttctcaacccttttcagctcccttcacaaaacccaacttcatgcaccccttcacgctcttcctcaacccaagttcagtgtggtctccgagagctcagaacccgcattgattctgtcaaaaacacgcagaaaatcaccgaggctatgaagcttgtggcagctgcaaaagtcagaagagctcaagaagctgtggtcaacgcaagacccttctcagagaccctcgttgaagtcctctacaacatcaacgagcagctccaaaccgaggacgtagacattcccctaacaaaggtgaggccagtgaagaaggttgcacttgtcgtgtgcaccggcgatcgcggcctctgcggcggcttcaacaacgctatcataaagaaagctgagagtagaattaaggagttgaaggaacttggtttggaatacactgtcataagtgtcggcaaaaagggtaacacttatttcattcgaaggccttatataccggttgacaggtttctagaaggtggttcacttccaactgctaaggaagctcaggctatagctgatgatgttttctcactgttcgtgagtgaagaggttgacaaagtggagcttctgtacactaagtttgtgtcattggtgaagtcagatcctgtgattcacactttgcttccactgtcaccaaagggagagatttgtgatatcaacggtgtgtgtgttgatgctgctgaagatgagttcttcaggttgaccaccaaggagggaaagttgaccgtggagagagatgttgtgaggactaagactacggattactcaccaattttgcagtttgagcaagacccagttcagatccttgatgctttgttgcctttgtatttgaacagccagatactgagggccttgcaggagtctctggccagtgaactcgctgcaagaatgagtgctatgagcaatgcaacggacaatgcttctgatttgaagaagaagttgtccattgtctacaatagggagcgccaggctaagatcaccggcgaaattctggaaatcgtggctggtgccaatgccttgcaatagtgcaatttgttctggtttgatctcaggagataagcacctaatgcattagagtgaagaaattgttctggagcttctcaaaggaggtcaaagtacctttttatgtcttgtcttctcctcaacttggttctgatttcttctaaagcagaaaagttcattgttcttcaattctatgatggagctgtagggaaaaggaatatgagtacagagaacaccgagtctgaacaaattacttgcaaaaaaatgacatgcacaatttgtatttgtatactaaatcatgtgaaaagtaatataaaccctttgtcatccatctatttgacattcgaatttgtggtgccattatataagcagaaactttttctta

SEQ ID NO: 972 - DNA, 1650 bp, Glycine max
acctccactcatttcccacttgttacttccacggcaatagagaatcctaacccaacacaacacacacattaacacaaggagaggataagaccccccctctctctctctcacaaacaaaagaaagaagaaaaaaaatctcaaaataaaacaaccaaaccacacacttcacaccctcttcaacatcctcagcaagtacaagaacaagaagaaacaatgtcttgctccaatctcacaatgttggtgtcctcaaaaccttccctttccgatccctccaatctctccttccgctctgtcctcaacccttttcagctcccttcacaaaacccaacttcatgcactccttcacgctcctcaaccacccaaattcagtgtggtctgagagaactcagaacccgcattgattccgtgaagaacactcagaaaatcaccgaggctatgaagcttgtggctgcagccaaagtgagaagagctcaagaagctgttgtcaacggaagacccttctcagagaccctcgttgaagtcctctacaacatcaacgagcagctcctaactgaggacgtagacatccctctcacaaaggttaggcctgtcaagaaagttgcacttgttgtggtcaccggcgaccgtggtctctgcggcggtttcaacaacgcaatcataaagaaagctgaggctagaatcagggaattgaaggagcttggcttggaattcactgtcataagtgttggcaagaagggtaactcttatttcatcagaaggccttatattccggttgacaggtttctagaaggtggcacacttccaactgctaaggaagctcaggccattgctgatgatgttttctcactctttgtgagtgaagaggttgacaaggtggagcttctatacaccaagttcgtgtcgttggtgaaatcggatcccgtgattcataccttgcttcctctttcgccaaagggagagatttgtgatgtgaatggtgtgtgtgttgatgctgctgaggatgagttcttcaggttgactaccaaggaaggaaagttgactgtggagagagatgttgtgaggactaaaaccgcggatttttcgccaattttgcagtttgaacaagaccccgttcagatccttgatgcactgctgccactgtatttgaacagccaggttctgagggcattgcaggagtccttggcgagtgaactcgccgccagaatgagtgccatgagcaatgccacagataatgctattgagttgaagaagaacttgtccattgtgtacaatagggagcgccaggctaagatcactggtgaaattctggaaattgtggctggtgccaatgccttgcaatagtgcaatttgtaggtattgtttacttattataatgatgggtggtggttgcccttttcattttctaatgtggttatctaagacacttgtgcaatttttacgcttctgttgaaacttgaatgaaatgcgcaggctttgtgcaataggaaaaatgcgatcaaatctgaagcggacacttttttttttgttatgtttttttttttccttctgaattatgtatgtaatgaatcaataatagatctataatataaagattcagagagttatctctgttgatttgatgcaccatgggcatggctgtcatttcacatg

SEQ ID NO: 973 - DNA, 1791 bp, Eucalyptus grandis
ccactcaaagattcaactggaccccaccgggaattggcgataggagacgcatcaaagcttcactccccatgcaatctcccacggtgtcaaaaaccttatcccaaaacctcatccgctctctccctctccctccactcattctctcttcctccattaccagagacatcaaattggacacattgaagataagcctctgagcagaaagaaaaggatacatctgaaaagaactcatacccacataaccaaactcccttctcctgacctgcaaaaacttgtccaggaacatgtcttcctccaatctcacaatgtgggcgtcctccaagccttctatctccgatgcgtctccgctctccttccgggcctccgtcggctccattttccagctcccttcctctgggagcccgtctagagccaacccggtggccccgattcagtgcaacctccgggagctccgggaccgcatcgactcggtcaagaacacccagaagatcaccgaggccatgaagctcgtggcggctgccaaggtcaggagagcccaggaagctgttgtcaacggaagacccttctcggagacgctggtcgaagtcctctacaacatcaacgagcagctccagattgaggacatcgatgcgccgctcaccagcgtgaggcctgtcaagaaggtcgccctggtggttgtcactggcgaccggggcctctgtggcggtttcaacaacaacatcatcaagaaggccgaggcaaggatcgccgagctcaagggtctcggcctcaactacaccgtgatcagcgttggcaagaagggcaattcctatttcctgaggaggccttacatccctgtcgacaagttcctcgagggcggtacgctgccgactgcgaaggaagctcaggccatcgctgacgatgtgttctcgctattcgtcagcgaggaagtcgataaagtggagctcctctacaccaagttcgtgtccctggtgaaatccgacccggttatccacaccctcctgcctctctcgccgaagggtgagatctgcgacgtgaacgggaactgcgtggacgcggcggaggacgagttcttcaggctgactaccagggaaggcaagttgaccgtggagagagacgtggtcaggaccgaaaccatcgatttctcgccgatcctgcagttcgagcaagacccggttcagattctcgacgccttgttgcctctgtacctcaacagccagatcctgagggcgcttcaggagtctctggccagcgagctcgccgctaggatgagcgccatgagcaacgccaccgacaatgcttcggaactgaagaagtcactctccatggtgtacaacagacgacgccaagccaagatcactggtgaaatattggagatcgttgctggtgccaatgctctcacctaaaagcgatgatacaaaattcaaactgggtccttaagcgtcccaacttgtgctcaacttgtgctctcttatccgtgtaggtatgttaaagcatgttaagagaaagaccctcttcttcattcattcagatatggtctgatccagaacttgcagataaaaaaagatcgatttttgttgtaattctcgaattctcgtataaactctgtgcacaaatgaggatttggattctctctcttggaggagaagagcattgaaatagcatattacttactcgtatctcatcgagtcatcacatttgcttagagcaattttttagtcctcagtttctaatctagctacagactttgcatctgtggtgatactcaatatatgcctgatcaaatctagc

SEQ ID NO: 974 - DNA, 1509 bp, Cleome spinosa
tccgtttcctttctccctttcctcttcctccactcaatttcccctcttctttttctctcttatcagatgagaagaacgaagaggaaaacaaggtcatcgctgaaacggaactactgaaaactgctctcctctgttcgagcaagaccggtgattcatgtaggtccaagaatccgtggacacaggtgtcttgctctaatctgacaaatgtgggtttcaccgaaaccatctctttccgactcctctcccttgtccttccgatccattctcagcccacttcagctccctagttataactctgccaccggcgtcaacagcttgtccagatcctcgtctgtgacgccggtccagtgcggtctccgggagctaagagaccgtattgattcggtgaagaacacccagaagatcacagaggccatgaagctagttgcagcggcaaaagtcaggagagctcaagaagctgtggttaatggcaggccgttctccgaaaccctggttgaggttctttacaacatcaacgagcagcttcagacagatgacattgatatccctctcaccaaaatcagacccgtcaagaaggtcgccttggttgtcgtcacgggagatcgggggctctttggaggattcaacaacacaatcatcaagaaagctgaggcgagaattgcagagctcaagggccttggtcttgagtacaccgtcatcagtgttggcaaaaagggtaactcatatttcatccggaggccgtacattcccgtcgacaaattccttgaagcaggtaacctccccacagcaaaagaagcacaagccattgccgatgatgtattttccctgtttgtgagcgaggaagttgacaaagtggagcttctctacacaaagtttgtgtctttggtgaaatccgaccccgtgattcacacgttgctgccactctcgccgaaaggagagatctgtgacataaacgggaactgtgtggatgccgcagaggatgagctcttcaggttaacgacgaaagaggggaagttaactgtggagagagaaaccgttcggacagcaacagtggatttctcaccaatcttgcagtttgagcaagacccagttcagatcctggatgctctgttgccgctgtaccttaacagccaaatcctgagggctcttcaggaatcgttggccagcgagctcgcggccagaatgagcgccatgagcagtgccaccgataacgcgatggagctgaagaagacgctttcgatggtgtacaaccggcagcgtcaagccaagatcaccggcgagatccttgaaatcgtcgccggagctaatgccttggtttgatggacccacctgaaaaaaggaaaagagagaatttttacgatgaatgatctctctctcatcgtttcttgcatctactacttattccatgtgggttgtgcataggatttttcatgttatgtaattacttggttgaatttgaaagtatcgcttgcggctttagtttgggtactcatcttacaaagaatgctg

SEQ ID NO: 975 - DNA, 1557 bp, Solanum tuberosum
gatccttatcctaaaacctgatccgattgctccttccctgcacctctcattccctccttcttccttcaccccacaccaccaaacacccaagatttccaccattctgataagaatcaaaaacaccctcaaaacaaaacccaatctttatctctcccacttccatctttggctggcttctttgctcctccatagcagccacattcctgagctaaaaaaaaaacgcatgtcttgttcaaatttgacaatgttggtgtcctcaaaaccatctctttctgactcctctgcgctttccttccgctctgctgtcagctcttttcagcttcctaaccaaaactcatcaggcccttcaaacccctcaagatcatcatcagttatccctgttcaatgtggtctccgtgatctgcgtgatcgaattgactctgtcaagaacacacagaagattactgaggctatgaagcttgtggctgctgctaaagtcagaagagcacaagaagctgttgtgggtgctaggcctttctctgagactttggttgaggtactttacaacatcaatgagcagcttcagacagatgacattgatgtaccactcaccaaagtaagacctgtcaagaaagtggctttggttgttgtcaccggtgaccgtggtctttgtggtggttttaacaactatatcatcaaaaaagctgaggccaggattagagatttgaaagctcttggccttgattacactattatcagtgttgggaaaaagggtaattcttatttcctccgcaggccttacatccctgtagataaatttcttgaaggaagcagtctgcccactgctaaagatgctcaggccattgctgatgatgttttctcactttttgtgagtgaagaggttgacaaagttgagcttctctacacaaagtttgtgtctttagtgaaatctgagccagtcattcacaccctgcttccattgtcaccaaagggagagatttgtgacatcaatgggaactgtgttgatgcagctgaagatgagttctttaggttgacaacaaaggaagggaaattgacagtggaaagagatgtcatgaggactaagacaactgatttttcagcaatcttgcaattcgagcaggaccctgttcagattcttgatgccttgctgccactttacttgaacagtcaaatcctcagggcattgcaggagtcattagccagtgagcttgcttctaggatgagtgccatgagcagtgcatcagataatgcatctgaattgaagaagaatctatctagagtgtacaacagacagcgtcaggcaaagattacaggagaaatattggagattgttgctggagcagatgccttgatttaagcatatcccctgcaattgtgcttctctgtaggtacaataatgaagtctagacaatttttattttctgcttctcaacctcgtacagactttgtgcacaagacgagaaccacattatattttgtacacaaggccagaccaaacctatatttgtatgtcaatttttttctgctatatttgtaaaacatgaattattgaaagcc

SEQ ID NO: 976 - DNA, 1584 bp, Glycine max
acattaacacaaggagaggataagacccctctctctctctcacacacacaaacacacaaaaaacaaagcaaaaaaaaatctcaaaataaaacaaccaaaccacacacctcacaccctcttcaacatcctcagcaagaacaagaagaagaagaagaaacaatgtcttgctccaatctgacaatgttggtgtcctcaaaaccttccctttccgacccctcgaacctctccttccgctctgtcctgaacccttttcagctccctacacaaaacccagcttcatgcaccccttcacgctcctcaagcacccaaattcagtgtggtctgagagaactgagaacccgcattgagtctgtgaagaacacgcagaaaatcacggaggcaatgaagcttgttgctgcagccaaagtgagaagagctcaagaagctgttgtgaacggaagacccttctcagagaccctggttgaagtcctctacaacatcaacgagcagctccaaactgaggacgtagacatccctctcacaaaggttagacctgtcaagaaagttgcacttgttgtgatcaccggcgaccgcggcctctgcggcggtttcaacaacgcaatcataaagaaagccgaggctagaatcagggaattgaaggagcttggcttgcaatttactgtcataagtgttggcaagaagggtaactcttatttcatccgaaggccttatattcctgttgacaagttccttgaaggtggcactcttccaactgctaaggaggctcaggccattgctgatgatgttttctcactgtttgtcagtgaagaggttgacaaggtggagcttctctacaccaagttcgtgtcgcttgtcaaatcggatcccgtgattcacaccttgctcccgctttcgccaaagggagagatttgtgatatcaatggtgtgtgtgttgatgctgctgaggatgagttcttcaggttgactaccaaggaaggaaagttgactgtggagagggatgttgtgaggactaaaaccatcgatttttcgccaattttgcagttcgaacaagacccggttcagatccttgatgcactgttgccactgtatttgaacagccaggtcctgagggcattgcaggagtccttggcgagtgaacttgccgcgagaatgagtgccatgagcaatgccacggataatgctattgaattgaagaagaacttgtccattgtgtacaatagggagcgccaagctaaaatcactggtgaaattctggaaattgtggctggggccaatgccttgcaatagtgcagtttgtaggtattgtttacttattataatgatgatgggtggtggttgcccttttcatttactaatgtgtttgtctctaagatacttgttcaatttttacgcttctgttgaaacttgaatgaaatgcgcaggctttgtgcaatagggaaaactgtgatttatatctgaagcggacattttttttgtttatgtattttttttttttttttgccttctgaatgatgtatgtaacgaatcaataatagatctataatataaagattcagagagttctctctgttgatttgatgcacc

SEQ ID NO: 977 - DNA, 1472 bp, Citrullus lanatus
tcatggcttgctcaaacttcacaatgtgggtgtcctcaaaaccgtcttcatccgattcctccgctctttcttttgggccttttaatcctcttcaacttccttcgcaaggctctgcctcgcgatcctcatctgttactccgattcagtgtggcctccgtgagcttcgagaacggattgattcagtgaagaacacccagaaaattactgaagctatgaagcttgttgctgctgccaaagtgcgtagagcacaagaagctgttgttaatggaagaccattctcggagtctctagttgaagttctttacaatatcaacgagcagctccaaaccgaagatatagatgttcctctcacaaaagtccgaccagtcaagaaggttgctttgattgttgtaacaggggatcgaggcctttgcggcagttttaataacatgatcatcaaaaaggcagaatccagaatcgcagaattgaagacccttggccttgattatacagttattagcgtcggcaagaaggggaattcgtatttccttcgccggccttacatcccagtagatagatttcttgagggcggttcacttccaacagctaaagaagctcaagccattgcagacgatgttttttccctctttattagcgaggaggtcgacaaagtcgagcttctgtacaccaaattcgtgtcattagttaaatcagaccctgtgatccacactctgcttccattgtcacctaaaggagagatttgtgatattaatggtgtttgtgttgatgccgcagaggacgagttcttcagattgacgacaaaagaaggaaaattgaccgtagagagagatgcagtgaggacaaaaacctcagatttctccccaattttacagtttgagcaggacccagttcagattcttgatgctttattacctctgtatttgaacagtcaaattttgaggtcattgcaggaatcattagctagtgaacttgcggccagaatgagtgccatgagcaatgcaactgataatgcaagcgagttgaagaagacactctctattgtttacaacagacagcggcaagcaaaaatcaccggcgagattttggagattgttgctggtgccaacgctttaacttgagtcagttatgctaattttaggtactttccactgagaattcattataaataaactatgcccatttaagaactataacatatttaacaaatttcttgtaagtctcatcccatcataaaccagtggaatgagacaatggggcaatgtgtcttgtaaaataagacaagtctctactcggtgttattgaactctacccactttttagtctttttgacgctatgattgttaataattcttgtaatatttgcactttctggtgaagtgcagctctgccttcttaagcattgttcgagcatacatatttataataaacatatctattgggccttttagccttgtggagtataacagtccgtc

SEQ ID NO: 978 - DNA, 1670 bp, Citrullus lanatus
actgagaaacgcatctgaaagtaaatttgaactccacttaccagaccattttctctgaatcagacccgagaaggtcgtccattaaagatcatggcttgctcaaacttcacaatgtgggtgtcctcaaaaccgtcttcatccgattcctccgctctttcttttgggccttttaatcctcttcaacttccttcgcaaggctctgcctcgcgatcctcatctgttactccgattcagtgtggcctccgtgagcttcgagaacggattgattcagtgaagaacacccagaaaattactgaagctatgaagcttgttgctgctgccaaagtgcgtagagcacaagaagctgttgttaatggaagaccattctcggagtctctagttgaagttctttacaatatcaacgagcagctccaaaccgaagatatagatgttcctctcacaaaagtccgaccagtcaagaaggttgctttgattgttgtaacaggggatcgaggcctttgcggcagttttaataacatgatcatcaaaaaggcagaatccagaatcgcagaattgaagacccttggccttgattatacagttattagcgtcggcaagaaggggaattcgtatttccttcgccggccttacatcccagtagatagatttcttgagggcggttcacttccaacagctaaagaagctcaagccattgcagacgatgttttttccctctttattagcgaggaggtcgacaaagtcgagcttctgtacaccaaattcgtgtcattagttaaatcagaccctgtgatccacactctgcttccattgtcacctaaaggagagatttgtgatattaatggtgtttgtgttgatgccgcagaggacgagttcttcagattgacgacaaaagaaggaaaattgaccgtagagagagatgcagtgaggacaaaaacctcagatttctccccaattttacagtttgagcaggacccagttcagattcttgatgctttattacctctgtatttgaacagtcaaattttgaggtcattgcaggaatcattagctagtgaacttgcggccagaatgagtgccatgagcaatgcaactgataatgcaagcgagttgaagaagacactctctattgtttacaacagacagcggcaagcaaaaatcaccggcgagattttggagattgttgctggtgccaacgctttaacttgagtcagttatgctaattttaggtactttccactgagaattcattataaataaactatgcccatttaagaactataacatatttaacaaatttcagtggaatgagacaatggggcaatgtgtcttgtaaaataagacaagtctctactcggtgttattgaactctacccactttttagtctttttgacgctatgattgttaataattcttgtaatatttgcactttctggtgaagtgcagctctgccttcttaagcattgttcgagcatacatatttataataaacatatctattgggccttttagccttgtggagtataacagtccgtctgaactctgtattacatcccttttcatattagctttatttcaaataggataatttatgtgcttctttaagccaacacatacctgaaccatagatattttcaatgtcaaaaggttatcagatcaatggttctacaaa

SEQ ID NO: 979 - DNA, 1566 bp, Solanum phureja
atccttatcctaaaacctgatccgattgctccttccctccacctctcattccctccttctcccttcaccccacaccaccaaacacccaagatttccaccattctgataagaatcaaaaagaacctcaaacaaaaaaccaatctttatctctctcacttccctctttggagcagccacattcctgagctaaaaaaaaaaacatgtcttgttcaaatttgacaatgttggtgtcctcaaaaccatctctttctgactcctctgcgctttccttccgctctgctgtcagctcttttcagcttcctaaccacaactcatcaggcccttcaaacccctcaagatcatcatcagttatccctgttcaatgtggtctccgtgatctgcgtgatcgaattgactctgtcaagaacacacagaagattactgaggctatgaagcttgtggctgctgctaaagtcagaagagcacaagaagctgttgtgggtgctaggcctttctctgagactttggttgaggtactttacaacatcaatgagcagcttcagacagatgacattgatgtaccactcaccaaagtaagacctgtcaagaaagtggctttggttgttgtcaccggtgaccgtggtctttgtggtggttttaacaactatatcatcaaaaaagctgaggccaggattagagatttgaaagctcttggcattgattacactattatcagtgttgggaaaaagggtaattcttatttcctccgcaggccttacatccctgtagataaatttcttgaaggaagcagtctgcccactgctaaagatgctcaggccattgctgatgatgttttctcactttttgtgagtgaagaggttgacaaagttgagcttctctacacaaagtttgtgtctttagtgaaatctgagccagtcattcacaccctgcttccattgtcaccaaagggagagatttgtgacatcaatgggaactgtgttgatgcagctgaagatgagttctttaggttgacaacaaaggaagggaaattgacagtggaaagagatgtcatgaggactaagacaactgatttttcagcaatcttgcaattcgagcaggaccctgttcagattcttgatgccttgctgccactttacttgaacagtcaaatcctcagggcattgcaggagtcattagccagtgagcttgcttctaggatgagtgccatgagcagtgcaacagataatgcatctgaattgaagaagaatctatctagagtgtacaacagacagcgtcaggcaaagattacaggagaaatattggagattgttgctggagcagatgccttggtttaagcatatcccctgcaattgtgcttctctgtaggtacaataatgaagtctagacaatttttattttctgcttctcaacctcgtacagactttgtgcacaagacgagaaccacattatattttgtacacaaggccagaccaaacctatatttgtatgtcaatttttttctgctatatttgtaaaacatgaattattgaaagcctgaaatcttcaatccctcgtatagcttttcta

SEQ ID NO: 980 - DNA, 1675 bp, Vitis vinifera
caaaaatccttatcgccatccaaacctcatccactccctccccctccctccacctctcattcccctactctcccctccaccattagaattcacaacacagactaatccttcactcttcaaaaaaaccaaacccacaaacctcattcttccccccctctctttctctcctcttatctgcagttgagagaatcttcatcttcatcattaaatcatatcatcatgtcttgctccaatctaacaatgtgggtgtcctcaaaaccttctctttctgacagttctttgctctcttttcgctcttctctcaacccttttcagcttccttcccataattcccccactgccagcccctccaagtctgtgattcagtgtgggctccgggagctcagggagcgtatcgattctgtgaagaacacccagaagattactgaagctatgaagcttgttgctgcagctaaagtgaggagagctcaggaggccgtggttaatggcagacccttctctgagactctcgttgaagtgctttacaacatcaatgagcagctccagactgacgatatcgatgtacctctgaccaaagtcaggcctgtcaagaaggttgccttggtggttgtcaccggcgaccggggtctttgtgggggtttcaacaatgcgattatcaagaaggccgagtctaggattgcggaactgaaggatcttggtcttgattatactgttatcagtgtggggaagaagggtaattcatatttcctccgtaggccttacatcccagttgataagtttcttgaaggtggctcactccccactgctaaagaagctcagacaattgcagacgatgttttctcgctatttgtgagtgaagaggttgataaggtggagcttctgtacaccaaattcgtgtccttggtcaaggctgatccagtgattcacaccttgcttcctctctcccccaagggagagatctgtgatgtgaatggtaaatgtgtggatgctgcagaggatgagttcttcaggttgacaaccagggaggggaaactgactgtggagagagatgttataaggactcaaacagttgaattctcccccatcttgcaattcgaacaggacccagttcagattcttgatgccttgctccccctctacctcaacagccagattttgagggccctgcaagaatcactggcgagtgagcttgcagccaggatgagtgccatgagtaatgctaccgacaacgcggtcgaacttaagaagaacctctccatggtctacaataggcagcgccaagccaaaatcacaggggagattttggagattgttgctggagccgacgccttagtctagtgtgaaaacatggttcaattctcatcctcatcacacttgtgcttctctgtagatgttcttttggtgtttcattatttattcaaatatgaacgtttaagatcagctatgcagattagacactttttttaatactatcattctcaactgcatacaaacttcatgcacaatgagaatcacaatgtatttcggattcaaaccccacatctttatatgttcttgccgcccatatattcataatacttgtactatttggagcttccacctccatggctctcctctggttgttctatgttgaacagtttatagtttttttgattcattcccatgacaattcgat

SEQ ID NO: 981 - DNA, 1438 bp, Cucumis sativus
tcatggcttgctcaaaattggcaatgtgggtatcctcaaaaccgtcttcatccgattcctctgctctttctttccggccagtcaatccttttcgagttccttcccacggctccgcctcgcgatcctcatctgtcactcccattcagtgcggtctacgtgagcttcgagaacggatcgattcagtgaagaacacccagaaaattactgaggctatgaagcttgttgctgctgccaaagtccgtagagctcaagaagctgttgttaatggaagaccattctcggaatctctagttgaagtactttacaatatcaatgagcagctccaaaccgaggatatagatgttcctctgactaaagttcgaccagtcaagaaggttgctttgattgttgtaacaggggatcgaggcctctgcggcggtttcaataacatgatcataaaaaaggcagaatctagaatcgcagaattgaagacccttggccttgattatacaattattagcgtcggcaagaaggggaattcgtatttttttcgccggccttacatcccagtagatagatttcttgagggcggttcactcccaacagccaaagaagctcaagccattgcagatgatgttttttctctctttataagcgaagaggttgacaaagtcgagcttttgtacaccaaattcgtgtcattagttaaatcaaaccctgtgatccacactttgcttccattgtcacctaaaggagagatctgtgatataaatggtgtttgtgttgatgccgcagaggatgagttcttcagattgacgacaaaagaaggaaaattgaccgtagagagagatgccgtgaggacaaaaacttcagatttctccccaattttgcagtttgagcaagatccagttcagattcttgatgctttattacctctctatttgaacagtcaaattttgagatcattgcaggaatcgttagctagtgaacttgctgccagaatgagtgccatgagcaatgcaactgataatgccagcgagttgaagaagacattgtctattgtttacaacagacagcggcaagccaaaatcactggcgagattttggagattattgccggtgccaacgctttgacttgagtcagtttatgctacttttaggtactttccactgagaattcaataaaaataaactatgcccatttaagaactataacatgttcaacaaattccttaagcaagtgcaatgaaacaatgaggcagtgtgtcctggaaaataagacaattctctactcggtattccacttttttgttttttttggtgctattattgttaatcattcttgcaatatttgcactttctggtgcagctctgccttcttaagcattgttggagtacacatttataatgatggttcctattcggccttttggccttatggagtaccaaagttcgtcca

SEQ ID NO: 982 - DNA, 1599 bp, Manihot esculenta
atgtcccaagcaatctccaacggtcaaaatccttatcccaaaacctcatcctttccctcctcttctctccactcatttcccctctcttttcatccataccataaaccattaaccagaaaaaaagataaggcactcgcaagaacagcagccagatctctcttctctttgatctctggcttgagctacaggaaatttcattaccaccatgtcttgctcgaatctgacaatgtggatgtcctcaaaaccatctctttccgacacctcttcactatctttttgctcttctctcaacccttttcagcttcctactcacacttcatccagcagcaacaccccaagatcctcttctgtaaccccaattcactgtggtctccgtgagcttcgaagtcgtatagattcagtgaagaatacacagaagatcaccgaagccatgaagcttgtcgctgctgcaaaggtgaggagagcacaagaagctgttgttaatggtaggcctttctctgaaactcttgtagaagttctttacaacattaatgaacagctccaaactgaggacatagatgcgcctctcaccaaaattaggccagtcaagaaagtcgctctagttgtttgtactggtgatagaggtctttgtggaggtttcaacaacaatattataaaaaaagcagaagctagaattgcagaattgaaggggcttggacttgattacacagtcattagcgttggaaagaagggtaactcttattttgtaaggcggccttatattccagttgataggttccttgagggaaccactctgcctacagctaaagaggctcaagcaatagcagatgatgtattttcactctttgttagtgaagaagttgacaaggtggagcttttatacacgaaatttgtgtcactggttaagtctgatcccgttatacataccttgcttccactttcaccaaagggagagatttgtgacattaatgggaactgtgttgatgctgccgaagatgaattcttcaggttgacaacaagagaagggaaattaactgtagagagagatgttgttaggactcaaacggcagatttctctgcaattttgcagtttgagcaggacccagttcagattcttgatgccttattacctctatatttgaatagtcagattttgaaggcattgcaggaatcactagccagtgagcttgcagctaggatgagtgctatgagcaatgcaactgataatgcagtcgaattgaagaagaacctttccattgtttacaacaggcagcgccaggcaaaaattactggagagatattggagattgttgcaggtgctgatgcattagtctaggaatctgtggttgcacaattctgattctctctgggtaaattcatgggtatcctattattcattcaaatatgcttgtcttaataacggttatgagataggacatatttttttcttccattgtaattctcaaactgctcataaaacactcaaccctgagaactgcaatgtaaaattgagcattctccttatctttgtacctcagctttttcccctgatatataatactacttgtattgcctgattatatgtaagtgatctttgtc

SEQ ID NO: 983 - DNA, 1605 bp, Gossypium hirsutum
tccttccctccctctcacttccacacattccctctgatttcctccataccagaaactactctccaacacacaaaaggataagacttgataaaaatcaaaatacaaaagcaagccattgtaggaaaaagctctttctcttgctctctttagagtaaatttctcttgcaatcctttgtagagctccgggatccattgtcaccatgtcttgctcaaatctgacaatgtgggtgtcctcaaaaccctctctttctgacacttcttcactctctttccgttctttcatcagcccttttcagctcccatctcagagctcaacccccggtaacccttccaggtcctcatctgtaaccccagttcactgtggtcttcgtgagcttagagaccgtattgattcagtaaagaacacgcagaagatcactgaagccatgaaacttgtggctgctgctaaagttaggagagcacaagaagctgttgtcaatggcagacctttctctgagtccctggttgaagttctttacaacatcaatgaacagctccagactgaagacatagatgctcctctcacaaacgtcaggcctgtcaaaaaagttgctttggttgttgttactggtgatcgtggtctctgtggaggttttaacaatgctatcatcaagaaagctgaagctagaattgcagaattgaagcagcttggacttgattatacaataatcagtgtggggaaaaagggtaattcatatttcatccgcaggccttacatcccagtggacagattcctagatggtagctcactccctacagctaaagaagctcaggcaattgctgatgatgttttttcactctttgttagtgaagaagtcgataaagtggagcttttgtacaccaaattcgtatccttggttaagtctgatcctgtgattcatactttgcttccactgtcaccaaagggtgaaatctgtgatgtaaatggtgtttgtgttgatgctgctgaggatgagttcttcagattgacaaccagggaagggaaactgacggtggagagagaagttatgaggactcagacagctgatttctctcccattttgcagtttgagcaggacccagttcagattcttgatgctttgttgcctctttatctcaacagccaggttctgagggctttgcaggaatcactagccagtgagcttgcagctaggatgagtgccatgagcaatgctactgataatgcccaggaactgaaaaagaccttgtctatcgtctacaaccggcagcgtcaagcgaaaatcaccggagagatattggagattgttgctggtgccaatgctttggtctaatgaacttgaaacctgtttcaccatcaattatgttcccttgtaggtattaaaaagaattattaaattatgagtagtttccttattcattcctatatacttgtttaagaacagccatgctgatatgtttttttttttgcattgtaattctcgaatgcttatgaactctttgcacagtgggaaccgcaatgtcttttggagttgaaaaataagagcatttacccatctttgtatgttatttgccccttacatgtataatacttgtccggtcaccgtc

SEQ ID NO: 984 - DNA, 1730 bp, Arachis hypogaea
aaattgggcatctatgaacacagaaggagaggataacatcaatctcaacataaaccaaccaaaccaatacaccacaaccctctttctctccctttctttctgctgctgtaatctacttacattacagaagccccaaaagtactacttcatctgcaataatgtcttgctccaacctcactatgttggtatcttcaaaaccttccctttctgatgcctccaacctctccttccgttctgttcttaatccttttcagctcccttcacaaaactcaccctcatgcagcccctcacggtcttctgtcaccccaatacagtgtggtctcagagagctcagaacccgcattgaatctgttaagaacacacagaagatcacagaggcaatgaagcttgttgctgctgctaaagtcagaagggctcaagaagctgttgtcaatggaagacccttttcagagacccttgttgaggtcctctacaacatcaacgagcaactccaaactgaagacattgatgtccctctcacaaaagttaggccagtgaaaaaggtagcactggttgtgtgcactggtgatagaggtctctgtggtggtttcaacaataacatcattaagaaagccgagaaaagaattgctgaattgaaggatcttggtcttgactacactatcattagtgtcggcaagaagggtaactcttacttcctccgtagaccttacataccagttgatcggtttctagaaggaggaacactcccaactgctaaagaggctcaggcaattgctgatgatgccttctcattgttcatcagtgaagaggttgacaaagtagaactcttgtacacaaagtttgtgtcattggtgaaatcagatcctgtgattcacaccttacttccgctgtcaccaaagggagagatttgtgacatcaatggaaactgtgttgatgctgctgatgatgagttctttaggctaacaacaaaggaaggaaaactaactgtggagagggattctgtgaggacaaagacagaagactattcaccaatcttggaatttgagcaagatcctgttcagatccttgatgctctcttgccgctttatctcaacagccaagtcttaagagcacttcaagaatcacttgcaagtgagcttgctgctagaatgagtgcaatgagcagtgctactgataatgctgttgaattgaagaagaacttatccattatctacaatagggagcgtcaggctaagatcacaggtgaaattcttgagattgttgctggtgccaatgctcttcaataggttacttttggccacattgtcatcattatcatgatccatggttggatttatttgtaggtatccaatatcataaaagggtgttgttactccttttgttacattctaatgttcttatttatgacaattatgaaactgcaatttttgcacttctgaaatgcaaaaaaccttgtgcactaagagtctcgaccagaaaccttttggtttttttgtcaagtttttcccctccttttcatctcacaaattatgtatgtaataaaatagatctatatatcataaaattcccagagttctctgttgattttatttgcaaccaccatggacatgctatacttttatttttttgactagaattgcatgtgatcaagacgattcctttaaaaaatacaaggattttacatgacaaaaaagaaggttctgaataacacacgacttacatctgatcag

SEQ ID NO: 985 - DNA, 1691 bp, Cajanus cajan
acctccactcatttccacttgttcctcccatgccaatacagaatctcaacacatttacacgaggaaaggataagagttaagagttgagaccctcacaaaaaaataagcaaccaaacccacacacacacacaccatgtcttgctccaatctcacaatgttggtctcctcaaaaccctccctttccgacggctccagcctctccttccgctccgtcctcaacccttttcagctgccatcacaaaacccctccaccgcccctccccgctcctcctccgccgccccaatccagtgcggcctccgcgagctccgaacccgcatcgaatccgtcaagaacacgcagaagatcaccgaggccatgaagctggtggctgccgccaaagtccgaagagcccaagaagcggtggtgaacgcacgacccttctcggagaccctcgttgaagtcctctacaacatcaacgaacagctccaaaccgaagacatcgacattcccctcaccaaaatcaggcccgtcaaaaaggtcgctctcgtcgtctgcaccggcgaccgcggcctctgcggcggcttcaacaacaacatcatcaaaaaagccgaggcaagaatcgctgagttgaaaaagcttggccttgaatacaccgtcatcagcgtcggcaaaaagggtaactcttacttcattcgcaggccttatatccccgtcgataggttcctcgagggtggcactcttcccaccgccaaggaagctcaagccatcgccgatgatgttttctcactcttcgttagcgaggaggttgacaaagttgagcttttgtacactaagtttgtgtctttggtgaaatccgatcccgtgattcacacgttgctgccactctccccgaagggagagatttgtgacgtgaatggggtttgcattgatgccgctgaagatgagttttttaggttgactacaaaggagggaaagttgactgtggagagggatgttgtgaggactaaaaccgcagattttgaagccattttgcagtttgagcaggaccctgtgcagattcttgatgccttgttgcccttgtatttgaacagccagattcttagggcgttgcaggagtctttggccagtgagcttgcagccaggatgagtgctatgagcaatgcaacggataatgccactgagttgaagaagaacttgtccactgtttacaatagggagcgccaggccaagatcactggggaaattctcgagattgttgctggtgccaatgccttgcaatagttccctttatttcctctttcttcttatcatgggtgtcgacttccacttcgagtgcccctttttgttttctcatgtgttatttttaaggttatgttgtctcaaatctcaatgcaataggaaattgcagtttaatatggaccgcacaccttttttttaccttctaaataattgtgtatgtaatgtaatgaattaaatatagatctataatataaaaattcagggagtttttctctctgttgatttgatgtagtggctgcacttgtgaagcggtgtgtttcgcataatgcattttccactttaatgtggtttggtgatggtgtttaatgcatattttataacgggtttgtataaggtggcgtatagaccagggtggtcctcgattgatagctgttgaatgtgtttttaaaatattatatcattgtatcctgaa

SEQ ID NO: 986 - DNA, 1596 bp, Tabernaemontana elegans
gatatcaaaaccacagctaatatcctctcctcttcctttctgagcttctgtaatctgccattggcactttcgtttacagagctccgtgttgaaacttgaagccatgtcttgctccaatataacgatgtgggtttcgtcaaaaacttcactttctgactctgcggctctttcttttcgctcgacactcaatcctcttcagcttcccaccaataatcagacaactaccaacacttctagatcttcaccagtgactccaatctactgtgggcttcgtgagcttcgcgaacgtattggttctgtgaagaacacccagaaaatcactgaggctatgaaacttgtggctgctgcaaaagtgagaagagcccaagaagctgtggtcaattcaagacccttctcagaaactcttgttgaagttctctataacatcaatgaacaactccaaactgatgacgtagatgttcctctcaccaaggttaggcctgttaagaaagtagctcttgttgttgtcaccggcgaccgtgggctttgtggtgctttcaataataatataattaaaaaggcagagaggagaatcgcagaattgaaggatctgggccttgagtacactgtaatcagtgttggcaaaaagggtaacacgtactttattcgtaggccttatattccagtagataagtttcttgatggtagtagtcttcccactgctaaagaagctcaggcaatagcagacgatgttttttcacttttcgtaagtgaagaggtggataaggttgagcttttgtataccaagtttgtgtctttggttaagtctgatccagtgatccacactttgcttccattgtcacccaagggagaaatctgtgatataaatggggtatgtgttgatgcagctgaagatgaattcttcagattgacaactaaggaaggaaaattgacagtggagagagatgtgatgaggactaaaacagcagaattttcaccaattttgcaatttgagcaggaccctgttcagatccttgatgccttgcttcctctttacttgaacagtcaaattctgagggcattgcaggagtcactagctagtgaacttgctgctaggatgagtgccatgagcaatgcaacagacaatgccatggaattgaagaagacgctttctatagtctacaacagagaacgtcaggcaaagattaccggagagatactggagattgttgctggtgcaaatgccttggtttaatactcattgtctcctcgtaatggtgcttatctgtaggtatttctgtgggcagtttcatctcattgtattgtgtctgtgtctgaactacaatctagagtaggcaccttaagttgtgactcccaactgcatacgaacttcttttaagatggaaaccacaatgtattctcaacatgagagtcttccaccacatatttacatgtttattcttttggttcatctctgtaatatttcttgtactaaaagtctcaaagtttaagctcaacatatcctcttgttgctggggatcaataatgtttcacttaatatagagttttccgcttctcgtcggatctggttttgatttttattattcaaactgcttc

SEQ ID NO: 987 - DNA, 1730 bp, Solanum lycopersicum
ataggactgatatttgaatcataattttcacacacttcacttcattgggtgtatgtcataaatgaattaatatattttttaaaaaaatataagtaagaaaataaaaaaaatcttactctagggcaaatcaaaaatttttctttcattcacaaccgcaatctcaacggtctaaatccttatccttaaacctgatccgattggcccttccctccacctctcattccctccttctcccttcaccccacaccaccaaaacacccaagatttccaccattctgataagaatcctcaaaacaaaacccaatctttatccctcccacttcactctttggagcagccacattcctgagctaaaagaaaaaacatgtcttgttcaaatttgacaatgttggtgtcctcaaaaccatctctttctgaatcctctgccctttctttccgctctgctgtcagctcttttcagcttcctaaccacaacctatcaggcccttcaaacccctcaagatcatcatcagttatccctgtccgatgtggtctccgtgatctgcgtgatcgaattgactctgtcaagaacacacagaagattactgaggctatgaagcttgtggctgctgctaaagtcagaagagcacaagaagctgttgtgggtgcgaggcctttctctgagactttggttgaggtactttacaacatcaatgagcagctccagacagatgacattgatgtaccactcaccaaagtaagacctgtcaagaaagtggcgttggtggttgtcaccggtgaccggggtctttgtggtggttttaacaactatatcatcaaaaaagctgaggccaggattagagatttgaaagctcttggccttgattacactattatcagtgttggcaaaaagggtaattcttatttcctccgcaggccttacatccctgtagataaatttcttgaaggaagcaatctgcccactgctaaagatgctcaggccattgctgatgatgttttctcattttttgtgagtgaagaggttgacaaggttgagcttctctacacaaagtttgtgtctttagtgaaatctgagccagtcattcacaccctgcttccattgtcaccaaagggagagatttgtgacatcaacgggaactgtgttgatgcagctgaagatgagttctttaggttgacaacaaaggaagggaaattgacagtggaaagagatgtcatgaggactaagacaactgatttttcagcaatcttgcaattcgagcaggaccctgttcagattcttgatgccttgctgccactttacttgaacagtcaaatcctgagggcattgcaggagtcattagccagtgagcttgcttctaggatgagtgccatgagcagtgcaacagataatgcatctgaattgaagaagaatctatctagagtgtacaacagacagcgtcaggcaaagattaccggagaaatattggagattgttgctggagcagatgccttggtttaagcatatcccctgcaattgtgcttctctgtaggtacaataatgaagtctagacaatttttattttctgcttctcaacctcgtacagactttgtgcacaagaagagaaccacattatattttgtacacaaggccagaccaaacctatatttgtatgtcaatttttttctgctatatttgtaaaacatgaattattgaaagcctgaaatcttcaatccctcgtatagcttttcta

SEQ ID NO: 988 - DNA, 1735 bp, Theobroma cacao
agctaatatctaaaatacccccactcagaacttgccacatcagatggggctgtcccaccaggatgcaatggtggaaaaggcaatgaatcaaattcatgtcccgagcaatctccaacggtcaaaatccttatcccaaaacctcatccactccctgcctctccttccactcattccctccataggcagaaaccactctccaacacacgagaaaagataagacttgacaaaaacagtttggtcttgtacaaaactaaactacccacacaggaaaaagctcttcctcttgctctgttttagagtaattctcttttttgtagagctccagaatccactgtcaccatgtcttgctctaatctgacaatgtgggtatcctcaaaaccatctctttctgacacctcttcactctctttccgttctttcatcagcccttttcagcttccttctcaaagttcagctcctaacccttcaagatcctcatctgcaacccaaattcactgtggtctccgtgaacttagagaacgtattgattcagtaaagaacacacagaagatcactgaagccatgaagcttgttgctgccgctaaagtcaggagggcacaagaagctgttgtcaatggcagacctttctctgagtctctggtagaagttctctacaacattaatgaacaactccaaactgaagacatagatgttcctctcacaaaagttaggcctgtcaaaaaagttgccttggttgttgttactggtgatcgtggtctctgtggaggtttcaacaataatatcatcaagaaagctgaatcaagaattgcagaattgaaggagcttggacttgattatactgtcattagtgtggggaaaaagggtaatacatattttctacgtaggccttatattccggtggataggtttctagagggcacttcactccctacagctaaagaagctcaggcaattgcagacgatgttttttcactctttgttagtgaagaagttgataaagtcgagcttttgtataccaagttcgtatcgttggttaagtctgatcctgtgattcatactttgctcccactctcaccaaggggagagatctgtgatataaatggtgtctgtgttgatgctgctgaggatgagttcttcagattgacaaccaaggaagggaaactgacagttgagagagatgttgtgaggaccgagacagcggatttctctcccattttgcagtttgagcaggatccagttcagattcttgatgctttgttgcctctctatctcaacagccagattttgagggccttgcaggagtcgttagccagtgagcttgctgctaggatgagtgccatgagcaatgctactgataatgccgtggaattgagaaggaccttgtctattgtctacaatagggagcgtcaagcgaaaatcacaggagagatattggagattgttgctggtgccaatgctttagtctaatgaacttaacgcttccttctttcccaacaattgtgtttctttgtaggtataaaaattcatgagtacttccttattcattcctatatgcttgtgtaagaacaaatcacgcagataagatacttttttgcattgtaattctcaaatgcgtataaaactctttgcacaatgagaactgcaatgtgttttggaattgaaatagaagagcattctacccatctttctatgttaaatctccttaatttgcttccattaaaatattcttagtcct

SEQ ID NO: 989 - DNA, 1341 bp, Pteridium aquilinum
atgtcttgctctaatctgacaatgtgggtatcctcaaaaccatctctttctgacacctcttcactctctttccgttctttcatcagcccttttcagcttccttctcaaagttcagctcctaacccttcaagatcctcatctgcaacccaaattcactgtggtctccgtgaacttagagaacgtattgattcagtaaagaacacacagaagatcactgaagccatgaagcttgttgctgccgctaaagtcaggagggcacaagaagctgttgtcaatggcagacctttctctgagtctctggtagaagttctctacaacattaatgaacaactccaaactgaagacatagatgttcctctcacaaaagttaggcctgtcaaaaaagttgccttggttgttgttactggtgatcgtggtctctgtggaggtttcaacaataatatcatcaagaaagctgaatcaagaattgcagaattgaaggagcttggacttgattatactgtcattagtgtggggaaaaagggtaatacatattttctacgtaggccttatattccggtggataggtttctagagggcacttcactccctacagctaaagaagctcaggcaattgcagacgatgttttttcactctttgttagtgaagaagttgataaagtcgagcttttgtataccaagttcgtatcgttggttaagtctgatcctgtgattcatactttgctcccactctcaccaaggggagagatctgtgatataaatggtgtctgtgttgatgctgctgaggatgagttcttcagattgacaaccaaggaagggaaactgacagttgagagagatgttgtgaggaccgagacagcggatttctctcccattttgcagtttgagcaggatccagttcagattcttgatgctttgttgcctctctatctcaacagccagattttgagggccttgcaggagtcgttagccagtgagcttgctgctaggatgagtgccatgagcaatgctactgataatgccgtggaattgagaaggaccttgtctattgtctacaatagggagcgtcaagcgaaaatcacaggagagatattggagattgttgctggtgccaatgctttagtctaatgaacttaacgcttccttctttcccaacaattgtgtttctttgtaggtataaaaattcatgagtacttccttattcattcctatatgcttgtgtaagaacaaatcacgcagataagatacttttttgcattgtaattctcaaatgcgtataaaactctttgcacaatgagaactgcaatgtgttttggaattgaaatagaagagcattctacc

SEQ ID NO: 990 - DNA, 1456 bp, Catharanthus roseus
ctctctgagcttcttctgtaattaggcagccattgaagcttgaaaccaaccaaaccatgtcttgctccaacttaacaatgtgggtttcatcaaaaccttctctttccgactcttcttcccctctttcttttcgctcattaatcagtaatcctcttcaacttcctaccaataattcgacgactaccaatccctcttcttcaagatcttcatcatcagtagttcactgtgggcttcgtgagcttcgtgatcgtattggttcggtgaaaaacacccagaaaatcactgaggctatgaaacttgttgctgctgcaaaagtcagaagagcccaagaagctgttgtcaattcaagacccttttcagaaacacttgttgaagttctttacaacatcaatgaacaactccaaactgaagacatagatgttcctcttaccaaagttaggcctgttaagaaagtagcccttgttgttgtcactggtgaccgtggactttgtggtggtttcaataattccattattaaaaaggcagagagcagaatagcagaactcaaaggtcttggccttgattacactgtcatcagtgttggcaaaaagggtaactcttattttattcgtaggccttttattccagttgataagtatcttgaaggtagcagtcttccaaccgcaaaagaagctcaagcaatagcagatgatgttttttcactttttgtaagtgaagaagttgataaggttgagcttttgtataccaagtttgtgtctttggttaagtctgatccagttatccacactctgcttccattgtcacctaaaggagagatctgtgacataaatggcaactgtgttgatgcagcagaagatgaattcttcaggttgacaactaaggaaggaaaattgactgttgagagagatgttgtgaggactcaaacatctgatttttcaccaattctgcaatttgagcaggaccctgctcagattcttgatgccttactccctctttacttgaacagtcaaatcttgagggcattgcaggaatcattagctagtgaacttgctgcaaggatgagtgcaatgagcaatgcaacagataatgctagggaattgaagaagaatctatctagagtctacaacagagaacgccaagcaaagattactggcgagatattggagattgttgcaggagcaaattccttagcttaattaattaatactcctttattgttttgtttccctcatgattgtgcttctgaatccttctctaggtattttcattttgtctatgttatgtttgttccagaacggctatatagattaggcacttataaatttgttactcccaactcaatacaaacttcttttaagatgagaaccacaatgtattctccaatgagacgattacatgcttattcttttggttcatctctgtaatacctcttgtattatatatctcagaatttcag

SEQ ID NO: 991 - DNA, 1543 bp, Amsonia hubrichtii
ctctttctctctgagcttctgtaatctgccattggcaattttgtttacagagctccaaaagggtgttgaaacttgaagccatggcctgctccaatttaacaatgtgggtttcatcaaaaccttctctctctgactcttctgctctttcttttcgctctttactcaatcctcttcagcttcctgccaataattcgaccactaccaacccctctagatcttcatcggtaactccaattcactgtgggcttcgtgagcttcgtgaacgtattggttctgtgaagaacacccagaaaatcactgaggctatgaagcttgtggccgctgcaaaagtcagaagagcccaagaagctgttgtgaatgctagacccttctctgaaactcttgttgaagttctttacaatattaatgaacaactccaaactgaagacatagatgctcctcttaccaaagttaggcctgttaagaaagtaggtcttgttgttgtcactggcgatcgtggactttgcggtggtttcaataatgctattattaaaaaggccgagcgcagaatagcagaattgaagaatctgggccttcaatacactgtgatcagtgtcggcaaaaagggtaactcgtattttattcgtaggccttatattcccgtagacaaatttgttgaggggagttctcttcccactgctaaagaagctcaaacaatcgcagacgatgttttttcacttttcgtgagtgaagaggtcgacaaggttgagcttttgtacaccaagtttgtgtctttggttaagtctgatccagtgattcacactttgcttccattgtcacctaagggagagatctgtgacataaatgggaactgtgttgatgcagcagaagatgaattcttcaggctgacaactaaggaaggaaaattgacagtggagagagatgttgtgaggactaaaacagcagaattttcaccaattttgcaatttgagcaggaccctgttcagatccttgatgccttactccctctttacttgaacagtcaaattttgagggcattgcaggagtcactagctagtgaacttgctgctaggatgagtgcaatgagcaatgcaaccgacaatgctattgaattgaagaagaatctctctagagcctacaacagagaacgtcaggcaaagattactggagagatattggagattgttgctggagcagatgccttggtttaatatttctcctctcatcatcactgtgcttctatgtaggtattttcgtgggcaatttcatttgattgtgttatgtttgtttctgaactactacttagagtaggcacgttaaattgtaactcccaactgcatacagacttcttttaagatgagaaccacaatgtattttcaacatgagagtgttcctcacatgtttacacgtttattcttttggttcatctctgtaatacctcttgtattaaaagtctcaaagtttcagcttagcatatcctcttgttactggggatcaataatgttacacttaatatacaacttatgctcctcgttggagctag

SEQ ID NO: 992 - DNA, 1399 bp, Triphysaria pusilla
acaaaagcccacatcatagatattcatctcctcaacaaaactaaacctccatagttaccttctgcaaataacaaaaaagctgcagaagtgcagaaccacaaaagaagaagaggccatgtcttgctcaaacctgacaatgttttcatcaaaaccttccctctccgacccctcctcctccctctcttcccgctccttcatcgcccctttccacctccccaacaccaaatcaccctcatcaccaccaccatcaagctcaacccaaattcaatgcagtctccgcgatctccgtgaccgcattgaatccgtcaagaacacccaaaaaatcaccgaggccatgaagctcgtcgccgcagccaaggtccgtcgtgcccaggaggcagttgtcaacgcccgccccttctccgagaccctcgtcggtgttctctacaacatcaacgagcagctccagactgaggacatcgacatccctctcacccgcgtccgccccgtcaagaaggtcgcccttgtcgtcgtcactggcgatcgcggcctctgcggcggattcaacaacttcatcctcaaaaaggctgaggcccgcatccgcgagctcaaggccctcgggatctcctacactgtgatcagcgtcggcaagaagggcaactcctacttcctccgccggccccacatccccgtcgacaggtaccaagagggcagcaacctccccaccgccaaggaagctcaggcaattgccgacgacgtgttttccctgttcgtcagcgaagaagtcgataaagtcgagcttctgtacacgaaattcgtctcgttggtgaaatccgacccggtgatacacactttgctcccgctctcgcccaagggcgagatatgtgacattaacgggacatgtgttgatgcggctgaggacgagtttttcaggctgacaaccaagggtgggaagttgactgtggagagggatgtggtgagaacttcgacggcggatttctcgcccatactgcagttcgagcaggacccagctcagattctggacgcgctgttgccgctttacctgaacagtcagatattgaggtcattgcaggagtcgttggcgagtgagctggcggcgaggatgagtgcaatgagcagtgcatcggataatgctagtgagttgaagaagaatctttcgagagtgtataacaggaagcggcaggccaagattactggggagattttggagatcgttgctggggcgaacgccttgacctgagtgagagaaagaaggttttgttttgtgcttgtgatctatttgatttgtaacaaaagaggatcttactcaactcaaatatatttatatatatgtgtgaatttcgcatgattaatttcatgaagcagctgcagatgatcatgaatatatgcaatttcagtt

SEQ ID NO: 993 - DNA, 1601 bp, Capsicum annuum
ccgcaatctgcaacggtctaaatcccttatccaaaaacctcatcctattgctctttccctccacctctcattccctccttctcccttcaccccacaccaccaaacaccaagatttccaccattttgataagaatcaaaagtaccctcaaacaaaacccaatctttatctccctctttctcctcctctttgctcccccataggggccacgtctttactttgcattggatagcaaaaagaagaacatgtcttgctcgaatttgacaatgttggtgtcctcaaaaccatctctttctgactcctctgcgctttctttccgctctgctgtcagcccttttcagcttcctaaccataactcatcaggcgcttcaaacccctcaagatcatcatcagccgccacggttcgatgcggtctccgtgatctgcgtgatcgaattgattctgtcaagaacacacagaagattactgaggctatgaagcttgtggctgccgctaaagtcagaagagctcaagaagcggttgtgggtgctaggcctttctccgagactttggttgaggtcctttacaacatcaatgagcagcttcaaacagatgacattgacgttcccctcacgaaagtaagacctgtcaagaaagtggctttggtggttgtcaccggtgaccgtggtctttgtggcggttttaacaactacatcctcaaaaaagctgaggccaggattaaagatttgaaagctcttggccttgattacgttgttatcagtgttggcaaaaagggtaattcttatttcctccgcaggccttacattcctgtagataagtttcttgaaggaagcaacctgcccactgctaaagatgctcaggccattgctgatgatgtcttctcgcttttcgtgagtgaagaggtcgacaaagttgagcttctgtacacaaagtttgtgtctttagtgaaatctgagccaattattcacaccctgcttccattgtcaccgaagggagaaatttgtgacatcaacgggaactgtgtcgacgcagctgaagacgagttctttaggttgacaacaaaggaagggaaattgacagtggaaagagatatcatgaggaccaagacagctgagttttcagcaatcttgcaattcgagcaggaccctgttcagattcttgatgccttgctgccgctttacttgaacagtcaaatcttgagggcattgcaggagtcattagccagtgagctggcttctaggatgagtgccatgagcagtgcaacagataatgcatccgaattgaagaagaacctatctagagtatacaacagacagcgtcaggcaaagattacaggagaaatattggagattgttgctggagcagatgctttggcttaagcatacgaagattcccctgcaattgtgcttctctgtaggtacaataatgaagtccagacaatttttattttctgcttctcaacctggtacaaactttgtgcacaagaagagaaccacattatattttgtacacaaggccggaccaaacctatatttgtatttcaattttttctgatatatttgtaaaacatgaattattaaaagcctgaaattttcacttcccc

SEQ ID NO: 994 - DNA, 1599 bp, Capsicum annuum
gcaatctgcaacggtctaaatcccttatccaaaaacctcatcctattgctctttccctccacctctcattccctccttctcccttcaccccacaccaccaaacaccaagatttccaccattttgataagaatcaaaagtaccctcaaacaaaacccaatctttatctccctctttctcctcctctttgctcccccataggggccacgtctttactttgcattggatagcaaaaagaagaacatgtcttgctcgaatttgacaatgttggtgtcctcaaaaccatctctttctgactcctctgcgctttctttccgctctgctgtcagcccttttcagcttcctaaccataactcatcaggcgcttcaaacccctcaagatcatcatcagccgccacggttcgatgcggtctccgtgatctgcgtgatcgaattgattctgtcaagaacacacagaagattactgaggctatgaagcttgtggctgccgctaaagtcagaagagctcaagaagcggttgtgggtgctaggcctttctccgagactttggttgaggtcctttacaacatcaatgagcagcttcaaacagatgacattgacgttcccctcacgaaagtaagacctgtcaagaaagtggctttggtggttgtcaccggtgaccgtggtctttgtggcggttttaacaactacatcctcaaaaaagctgaggccaggattaaagatttgaaagctcttggccttgattacgttgttatcagtgttggcaaaaagggtaattcttatttcctccgcaggccttacattcctgtagataagtttcttgaaggaagcaatctgcccactgctaaagatgctcaggccattgctgatgatgtcttctcgcttttcgtgagtgaagaggtcgacaaagttgagcttctgtacacaaagtttgtgtctttagtgaaatctgagccaattattcacaccctgcttccattgtcaccgaagggagaaatttgtgacatcaacgggaactgtgtcgacgcagctgaagacgagttctttaggttgacaacaaaggaagggaaattgacagtggaaagagatatcatgaggaccaagacagctgagttttcagcaatcttgcaattcgagcaggaccctgttcagattcttgatgccttgctgccgctttacttgaacagtcaaatcttgagggcattgcaggagtcattagccagtgagctggcttctaggatgagtgccatgagcagtgcaacagataatgcatccgaattgaagaagaacctatctagagtatacaacagacagcgtcaggcaaagattacaggagaaatattggagattgttgctggagcagatgctttggcttaagcatacgaagattcccctgcaattgtgcttctctgtaggtacaataatgaagtccagacaatttttattttctgcttctcaacctggtacaaactttgtgcacaagaagagaaccacattatattttgtacacaaggccggaccaaacctatatttgtatttcaattttttctgatatatttgtaaaacatgaattattaaaagcctgaaattttcacttcccc

SEQ ID NO: 995 - DNA, 2530 bp, Gossypium raimondii
tacctttcagaatagggaacctatcaagttaagatccaagaagcaaccattcagaggttgccacttcaaaaaggccccatcaagatgtaatggtgaaatatcaatggaccaaaatttcaaaattcttatcccaaaacctcatccattccctccctctcacttccacacattccctctgatttcctccataccagaaactactctccaacacacaaaaggataagacttgataaaaatcaaaatacaaaagcaagccattgtaggaaaaagctctttctcttgctctctttagagtaaatttctcttgcaatcctttgtagagatccgggatccattgtcaccatgtcttgctcaaatctgacaatgtgggtgtcctcaaaaccctctctttctgacacttcttcactctctttccgttctttcatcagcccttttcagctcccgtctcagagctcaacccccggtaacccttccaggtcctcatctgtaaccccagttcactgtggtcttcgtgagcttagagaccgtattgattcagtaaagaacacgcagaagatcactgaagctatgaaacttgtggctgctgctaaagttaggagagcacaagaagctgttgtcaatggcagacctttctctgagtccctggttgaagttctttacaacatcaatgaacagctccagactgaagacatagatgctcctctcacaaacgtcaggcctgtcaaaaaagttgctttggttgttgttactggtgatcgtggtctctgtggaggtttcaacaatgctatcctcaagaaagctgaagctagaattgcagaattgaagcagcttggacttgattatacaataatcagtgtggggaaaaagggtaattcatatttcatccgcaggccttacatcccagtggacagattcctagatggtagctcactccctacagctaaagaagctcaggcaattgctgatgatgttttttcactctttgttagtgaagaagtcgataaagtggagcttttgtacaccaaattcgtatccttggttaagtctgatcctgtgattcatactttgcttccactttcaccaaagggtgaaatctgtgatgtaaatggtgtttgtgttgatgctgctgaggatgagttcttcagattgacaaccagggaagggaaactgacggtggagagagaagttatgaggactgagacagctgatttctctcccattttgcagtttgagcaggacccagttcagattcttgatgctttgttgcctctttatctcaacagccaggttctgagggctttgcaggaatcactagccagtgagcttgcagctaggatgagtgccatgagcaatgctactgataatgcccaggaactgaaaaagaccttgtctattgtctacaaccggcagcgtcaagcgaaaatcaccggagagatattggagattgttgctggtgccaatgctttggcttaatgaacttgaaacctgtttcaccgtcaattatgttcccttgtaggtattaaaaagaattattaaattatgagtagtttccttattcattcctatatacttgtttaagaacagccatgctgatatgttttttttgcattgtaattctcgaatgcttatgaactctttgcaagtgagagctgcaatgtcttttggagttgaaaaataagagcatttacccatctttgtatgttatttgccccttacatgtataatacttgtccggtcaccgtcgaagatcgagtttcgcatgctccagttgcctttgatatattgcaagcaagaataattttctttcttgaatttaaaccgtgagagattcaataggcttcattcattagagctgctcaagaggggccttctttcatgcaggttcatttgattccctgcagcttttggttacttaatcttatcatctgtttctttggacaattaaaagggtttagatgaaaccaagatatcaatttgcttcattacatttacaccattgtttatattagattcttggctttataagttagtctttacggagtcttttaaggccggattcgtgaattggcggccgagtacggaccacatccgaagtttcggttacaaaatatggtgaatctaagttaatttactggcaatttagctgcctaataaaatcgaaatgatatgcagatttatatatcagacaaaaggaacaaaataccaaacacagaatcctgcataaagcatatatgccaactagttggaaagctaaccatatgaatgtgtttgagcatcactcctatttagattaattgttactaagtgtgattagtggtcaagcccaagttcattcctagtcaaagttgatgttggatttttaaaggtccaaaagattcaaactccacctgagttcaagtcttacgcgcaaagaggccttcactactcccatatgagttttgaaaatgatcataaaaaaaaaaattggagaacttgagtttttcgactatggacacctactgatacagtaaatgaagaaagtgtaggggag

SEQ ID NO: 996 - DNA, 1438 bp, Gossypium hirsutum
agagtaaatttctcttgcaatcctttgtagagatccgggatccattgtcaccatgtcttgctcaaatctgacaatgtgggtgtcctcaaaaccctctctttctgacacttcttcactctctttccgttctttcatcagcccttttcagctcccgtctcagagctcaacctccggtaacccttccaggtcctcatctgtaaccccagttcactgtggtcttcgtgagcttagagaccgtattgattcagtaaagaacacgcagaagatcactgaagctatgaaacttgtggctgctgctaaagttaggagagcacaagaagctgttgtcaatggcagacctttctctgagtccctggttgaagttctttacaacatcaatgaacagctccagactgaagacatagatgctcctctcacaaacgtcaggcctgtcaaaaaagttgctttggttgttgttactggtgatcgtggtctctgtggaggtttcaacaatgctatcctcaagaaagctgaagctagaattgcagaattgaagcagcttggacttgattatacaataatcagtgtggggaaaaagggtaattcatatttcatccgcaggccttacatcccagtggacagattcctagatggtagctcactccctacagctaaagaagctcaggcaattgctgatgatgttttttcactctttgttagtgaagaagtcgataaagtggagcttttgtacaccaaattcgtatccttggttaagtctgatcctgtgattcatactttgcttccactttcaccaaagggtgaaatctgtgatgtaaatggtgtttgtgttgatgctgctgaggatgagttcttcagattgacaaccagggaagggaaactgacggtggagagagaagttatgaggactgagacagctgatttctctcccattttgcagtttgagcaggacccagttcagattcttgatgctttgttgcctctttatctcaacagccaggttctgagggctttgcaggaatcactagccagtgagcttgcagctaggatgagtgccatgagcaatgctactgataatgcccaggaactgaaaaagaccttgtctattgtctacaaccggcagcgtcaagcgaaaatcaccggagagatattggagattgttgctggtgccaatgctttggcttaatgaacttgaaacctgtttcaccgtcaattatgttcccttgtaggtattaaaaagaaattattaaattatgagtagtttccttattcattcctatatacttgtttaagaacagccatgctgatatgttttttttgcattgtaattctcgaatgcttatgaactctttgcacagtgagagctgcaatgtcttttggagttgaaaaataagagcatttacccatctttgtatgttatttgctccttacatgtatgata

SEQ ID NO: 997 - DNA, 1742 bp, Populus trichocarpa
gcattaacaagaaaaagataagccaatcacacaaaacagctcctcaccatagcctaaaattcctctttcccttctcttctcctctcgtggttacctagctagagccccaacaagttcatcaccacaatgtcttgctcaaatctgacaatgttggtgtcctcaaaaccttctctttctgacaccacttcactttcctttcgctcttctctcaacccttttcagcttccaagctcacctgctgcaaacaacccttcaagatccacttctgtgaccccaattcactgtggtcttcgtgagcttaggactcgtattcaatcagtgaagaacacgcagaagatcactgaggctatgaagcttgttgctgctgctaaagtgaggagagcacaagaagctgttgttaatggtaggcctttctctgaaactcttgttgaagttctttataacatcaatgaacagcttcagactgatgatgttgatgccccattaacaaaagttaggcctgttaagaaagtcgctctagttgttgttactggtgatagaggactttgtgggggttttaataattatttaatcaagaaagcagaagcaagaattgcagacttgaagcagcttggaattgactatactattattagtgttggaaagaagggcaacacttattttcttcgtaggccttatattccagttgataggtttcttgaaaaaggtggtctccctacagctaaagaagctcaagcaatagcagatgatgtcttttcactgtttgtaagtgaggaggttgataaagtggaacttttgtacacaaaatttgtgtcacttgttaagtctgaacctgttatacacaccttgcttccattatcaccaaagggagagatttgtgatgtgaatggggtgtgcgttgatgcagccgaggatgagttcttcaggttgacaacaagagaagggaaattgactgtagagagaggtgttagtaggactgcaacaacagatttctcaccaattttacagtttgagcaggatccagttcagattcttgatgccttgttgcctttatatttgaacagccagattttgaaggcattgcaagaatcactagctagtgagcttgctgctaggatgagtgctatgagcaatgctactgataatgcatcagaattgaagaagtccctttccatggtttacaataggcagcgtcaggccaagattactggagaaatattggagattgttgctggtgccgatgctttaacctaatcatgttagcccgctccacaattctgcatctttgtaggtaaaattcaaggatgattgcttattcattcaaatatgcctgttttaagacagttatgagatacaatgctttttccccctccctttgtaattctcaaatcgcctataaaaattctgtgcacaatgagatatgcaatgtatcttgcaacaggagcattctgcttgttgatctttgtgcatcagcttcttttcctctgatatctatactacttgtcctttttagaggtttcattacagggatgtcctatgtgtgttccactatatatgtatagaatgttgctgcagatcttcgtcctcgttgtaatttgatttaatcacaagggttctcgcttctttaattcccattttcctcaggtttcataactctaaatgactgtaagatccattgagctcaaacaagctgctaaattttttagttcaagctgtaaattccaaaaagctgctgttgctca

SEQ ID NO: 998 - DNA, 1347 bp, Euphorbia peplus
cttctccacttgaacaatgtcttgctctaatctgacaatgtgggtatcttcaaaatcacctctttctgatgcttcttcactctctttctgctcttctctcagcccttttcagcttccttctggctcaccctccacaaacccttcaagatcttcttctgtgaccccaattcatagcagtctccgtgagcttcgaaaccgaatagcatcagtgaagaacacacagaagatcacagaagccatgaaacttgttgctgctgctaaagtgagaagagcacaagaagctgttgttaacggtaggcctttctctgaaactcttgtggaagttctttacaacatcaatgaacagcttcaagttgaggatgtagatgctcctctcaccaaagttagacctgtcaagaaagtagctttagttgtcattaccggggatagaggtctttgtggaggttataacaactatataatcaagaaagcagaagcgagaatcaaagaattgaaaggtcttggagttgcctacactatcatcagtgtcggaaagaaggggaattcgtattttaacaggcgaccttatatcccggtggataggtttattgaaggaactaatcttccaacagctaaagaagctcaggcaattgcagatgatgttttttccctgtttgttagtgaagaggtagacaaagttgagcttctgtacacaaagtttgtatctttagtcaaatctagccctgtaatccacactttgcttccactttcaccaaagggtgaaatctgtgacatcaatggaaactgtgtggatgctgcagaagacgagttcttcaggctacacaacaaaagaaggtaaattgactgtggaaagaggtagtacgaggacgaaaacagcagatttctcagcaattttgcagtttgagcaggacccggttcagattctcgatgctcttttgccattgtatttgaacagtcagatcttgaaagcattgcaggaatctttggcgagtgagcttgctgctcggatgagtgctatgagcaatgcaacggataatgcgagtgagttgcagaaagaactttctcgggtttataacagaaaacgtcaggcgaagattactggagaaattttggagattgttgcaggtgccgacgctcttgtttagtctagtttattatatgtatattagtaactgtatctccacgatttctacttctataattcattcagtatatgatgtttgttttgataataggtatgatgagatagaaccaataatttttttcaaactttacttacattgtaattctcaaatgcttgtaatttgtaaacctcttgagaactgcactttatttgataaataagat

SEQ ID NO: 999 - DNA, 1510 bp, Lippia dulcis
tcgtcccacaaaaaccacacataatcgaaagatcaaaaaaccaaaccttgagccccaagagaaggtgcagagaaggaaaaaaacatcatgtcaagctccaatctcacaatgtgggtgtcctcgaaaccttctctctccgatcggtctttcatcgccccatttcagcttccaagttccagctcttcaaccgcgtccagatcatcatcgtcgtcatctcctactcaaattcagtgcagtcttcgtgacctgcgtgagcgcattgactcagttaagaacacccagaaaatcactgaggctatgaagctcgtggctgccgccaaggtgagaagagcgcaagaagctgtggtaaacgcgagacccttttcagaaaccctggttgaagttctttacaacatcaacgagcagctccaaacagatgatatcgatattcctctaaccaaggttagaccagtcaagaaggtggctcttgtcgtagtcaccggcgatcgtggcctctgtggtggattcaataatcagatcatcaagaaggccgaggcccgaatgcgagaactcaaggaactcggccttacctacactgtgatcagtgtgggcagaaagggaaactcgtatttccaacgaaggccatatattcctgttgataagtttctagaaggcagcagtcttccaactgctaaagaagctcaggccattgctgatgatgtcttctctctatttgtgagtgaggaggttgacaaggttgagcttctttacaccaagtttgtgtcgttggtcaaatctgatcctttaattcacactctgctcccgttgtcgcccaagggggaaatatgcgacattaatggtgtgtgtgttgatgcggctgaggatgagttctttaggctgacaacaaaggaagggaaattgacagtcgagagagatactatgaggactgcgacggttgatttttcgccaatcttgcaatttgagcaggacccagttcagattcttgatgctttgcttcctctttatttgaacagtcagattttaagggcgttgcaggaatcactagctagtgagcttgctgctaggatgagtgccatgagcaccgcctctgataatgctgacgagttgaagaaaactttgtctataatttacaacagacagcgtcaagcaaagattaccggagagattctggagattgttgccggagccaacgctatgtcttgagtacaattatgggcttcttgttttcccataattgtgcttacatgtaggtacttttgtgggcaatctctcgttttaatttttgcattatgtcaagaacagtaattcagcatagatactttgattgagatcctcatcagagtacaaatttcatcaaagatgaggaccgccattctgtttgttgtaacataagggcacttaccttttatatatatgtccattttttccgatcatttttctaatgattaattttggaaatttcatagctgagtagcctgcatcaccttgtgttccttctcggaaatcaaat

SEQ ID NO: 1000 - DNA, 1468 bp, Vinca minor
tcttgaacaccatagcatagagataagatatcaaaaaaaacatctaatatcctctgccattgatacgtttacagagagctccctaaaccccaagaagatcttgaaacttgaagaaaaaaaccatgtcttgctccaatttaacaatgtgggtttcatcaaaatcttctctttctgattcttcacctctttcttttcgctcttcgctcaatccacttcagcttcctactactactaataataataataattccacgaacccttcaagatcttcttcatcagtgagcccaattcattgtgggctacgcgagctccgcgaacgaattggatcagtgaagaatacccagaaaattacagaagctatgaagcttgtgtctgctgcaaaagtgagaagagcccaagaagctgttgttaatgctagacccttttcggaaactcttgttgaagttctttacaacatcaatgaacaagtccaagctgaagacattgatgttcctcttactaaggttaggcctgttaagaaagtagcccttgttgttgtcactggtgataggggactttgtggtggtttcaataattatattattaagaaagcagagagaagaatcaaagaattgaagactcttggacttgaatacactgttattagtgttgggaaaaagggtaatagttactttaaacgtaggccttatattccggtagataaatttcttgagggtactagtcttcccactgctaaagaagctcaagcaattgcagatgatgttttctcactttttgtaagtgaagaagtggataaagttgagcttttgtatacaaagtttgtgtctttggttaaatccgatcccgtgatccacactttgcttccattgtcacctaagggagagatttgtgatataaatggaatctgtgttgatgcagcggaagatgaattctttcggttgacaactaaggaaggaaaattgacagttgagagagatgtcatgaggactaaaacagccgatttttcgccaatcttgcaatttgagcaggaccctgctcagattcttgatgctttactccctctttacttgaacagtcaaatcttgagggcgttgcaggaatcgctagctagtgaactcgctgcaaggatgaccgctatgagcaacgcaacagataatgccattgaattgaagaagaatctatctatggcctacaacagacaacgtcaggcaaagattacaggagagattttggagattattgctggagcagatgctttggtttaatcttccctataattgtgctttgtgtttgtaactcccaactgcatacaaacttctttttaagatgagaaccaaaatgtaatttcaacgcgtattcctcgcatgatctacatgcttattcttttggttcatctttgtaataatatctcttgtattataaatctatcagatttcaattcaacctaccctcttgttaatgggaggat

SEQ ID NO: 1001 - DNA, 4986 bp, Ricinus communis
taacaaataggctcttaacttctatttaaaaatcaaatagatctagatcttaaaaaaaagttatgaacatgtttattatatttattatttaaattagttaaataaaataaaatctaaataaatattaatttaaatattcaaactaaaatttaaatttaaaattttcagattttatatattaaatttttttatattttgtcgaaaaaattaaaattaataattattgtctctattttactattatagtcaattttataaaattattattaacattattattattaattttaaataaaatctgaatttctttaatatttaaataaaaattatgaatctatttattaaaataattaaatttaaatttatttgaattggagtattttatcctttgtcctattatttttctagtatttccgactcttgctaatgaaattgattccatgagactccggcgttttctaagctttagcattttcacaaaacgaagcgttttgagaagtacaaataagactacgtctcgatacacggtgtcgcttcagatagaaacagattggcagaacattgcctgccctaaagaaagtggtacgactttacctcatttcaattgttattgcagttctaagatcatttgatgattgggttttccttattattctatgtttttaagctactccttgtctaagagaagtgtctgtaaccgttgttttcacgtgggtcgtaatttctcaaaacctaaaactgaagatattattcttaattcaatttgtgttaatttaaaacaaaggaaatggagtttcttggagaagatgttacccaatatgacttgttctttggtgggtcgtgtaatttgcaagtttcagaactcacctcagttagctttagaatttcacgattgggttttagagaaaaagagtgttttgcactcaatagagtcttgttgcgttgtaattcatgtgctggtcaattcgaagagatacgatgatgcgttgttcattatggggaatttgatgaatgtaaatggtatctcccccttggaagttttagatgcattgattagtagttatgacatatgcaagtcaagtccggctgtatttgatgctttggtccgtacttgtactcaaattggggctactgagggtgcttatgaagtgattacgaagttgcagttagatggtttttgggttacagttcatgcttggaacaacttcttgagtcatcttttgaagttgaatgatgttaataggttttggaagatgtataaggaaatggtttcttatggatatattgaaaatgttaatacttttaatttgattatttatgctcttggtaaggaaggtagattagtagaagcagtgtcggtaatctatcgaagcttgaagactggtatatggcctaatgttgttacttttaacatgattatagatggtgccatcaagatgggtgccatggatcttgctttgaagcttgtcaggaagatggaagtcatgtcaggatgctctgttaagcctgactctgtaacttataatagttttgtcaatgggttttgcaaaattgggaatctggctgtggcagaagaatttaaaaaggaaatgttggggaaagaaattgaacctaatgtgaggacctatgcaactttggtagatggttacacacgagtggggagtttggagaatgcctttaggttatgcgatgaattggtggaaaagggattgttaccaaattctgtcatatataattcaatcatccattggctttccatggaaggagatatggaaggagcttctttgctgttatcggacatgattgataagcggatataccctgatcaatttacatattctatagtcatagagggtctttgcagaaatggatatctaaatgaagcttttaaatttcttcagatgattcttgagatgagccttgttagagatgcattttcacacaatgttgttataaattacttgtgtagaagcaataatctagcaggagctaagcaactgctggctaatatgtatgttcgtggcttggttcctgatgttgttacatttggtactttgattgacaggcactgcaaggatggcaaagtcgaaaatgctattcaggtctacgagaaaatgataaagacaggggaaaagcccaacttgttaatctacaattctgttataaatggctttgccaaggaaggatcatttgatcctgcaattcttttgatagatacattaaggaggatgggtttatttgatgtcgtaacttataacaccttgatacatgggtattgcaactgtgggaagattgatcaggcatttgctttgttttcagaaatgagaaacagtggaattttggcaagccatgtcacttacaacacattgataaactctttgtgcaaggctggtcatgttctacaagcaaaggaactgatgaagatgatggttcttcgcggtttgattcctgattatgtaacatacacaattcttatcaccagtttcagcaagaagtgtagtcccgaagaagtgattgaattgcatgactatatggtcctcaagggagtagtacctgatagacagacataccagaccatggttattccacttctgcaagaagaaagtgtggaattcgactatggatagtatataaacagactcctgtagagtttgatgtctaagctgggtgttttcagtttctcgtggaaaatctgttcatgcaccctagttcatatcttaacatgctgacctttcccaaggaagcttgggttgcatattatagtattcttaaaaaagaatgtgcttatgcctataaaaaacccaattgggtatgtatttttgctgcccatagaatatataagcgcctctttgttctaccctgagggagtgatggagaacagtctaaatgaggcttcacttttttttttgttttcatatgaaaactgtatggatttgctttctgtttttatggtcgatgattggtattattgcattcatgtcagccttcccaagtcaataacaataaaaattgctcttatgatttaatgcctctaaattatctgcttagaggggtagcagagtgcaaatttcacaagtatgaaaatgagcttgtttatctattatgcagaaaagaaagaattcctggtataattttaacattcactgccattaaactcttaataattttgcccccgaagaaagcatcctagttgtacagccgcatatacctctgaaagtgtgaaaaatatcaagcgatcaaaatatacaattctcccactcagatcttgccacatcagatcgtatgcctttggttttgaatcaaattcatgtctcaagcaatctctaacagtcaaaatccttatcccaaaacctcatccactccctccctctccctccactcatttccgctctcttttcctccataccataagccactaagcaagaaaaagataagacattcacaaaaatagctacagaaaccaaaaacaagatagccagaattctcttttctcttctcttttgatctctggctagagctgcgggaaattcgctgccaacatgtcttgctcaaatttgacaatgtgggtgtcctcaaagccatccctttctgacacttcttcactctctttttgctcttctctcaacccttttcagcttcctactcacagctcaggcagcaacagcccttcaagatcctcttctgccaccccaattcactgcaatctccgcgatcttcgaactcgtatagattctgtgaagaacacacagaagatcaccgaggccatgaagttggttgctgcagctaaagttaggagagcacaggaagctgttgtcaatggtaggcctttctctgaaactctagtagaagttctttataacataaatgaacagctgcaaaccgaggacatagatgttcctctcactaaaaataggcctgtcaagaaagttgctttagttgttgttactggcgatagaggtctttgtggaggttttaacaataatattatcaagaaagctgaatcaagaattgcagaattgaaagatcttggagttgattatactatcattagcgttgggaaaaagggcaactcttatttcataaggcggccttacattccagttgatagatttcttgaaggaactaatcttcctacagctaaagaggctcaagcaattgcagatgatgtattttcactctttgtcagtgaagaagttgacaaggttgagcttctatatacaaaatttgtgtcactagttaagtccgatccggtcattcacaccttgcttccactctcaccagagggagagatttgtgatattaatggaaactgtgtagatgctgctgaggatgagttcttcaggttgacaacaaaagaagggaagttaaccgtagaaagagatgtggttaggactcaaaccgtagatttctcaccaattttgcagtttgagcaggacccagttcagatacttgatgccttgctacctctatacttgaacagtcagattttgaaggcattgcaggaatcactagccagtgagcttgctgctaggatgagtgctatgagcaatgcaagtgataatgcagcagaattgaagaagactctttcgattgtttacaatagggcgcgccaggcaaagattacaggagagatactggagattgttgcaggtgctaatgctttaggctaagtcatttctgcttctacatgggcgtcctcttattcattcaaaatatgcttatttaataacaattatgagataggaaatttttatttttttttccccttcatccattcgaattctgggattgcttataagactgtgtgcacattaagcagtgtattttggaacaagccaccattctgcttatctttgtatctcgaccttttttttcttgtatccatactactacttatattgcctgaagttttcactttcagggtgtttaaatgttactgctctatgttgaactaaatgtatagatttcttagagcagagaaatcct

SEQ ID NO: 1002 - DNA, 1391 bp, Platanus occidentalis
atctaacaatgtgggtctcctccaaaccttctctctgcgactcctctactctctccttccggtcttccctcagcccatttcgcctcccttcccatacttcaacaaccatcatcccctctcgctcgacgaacccaattcactgcagtcttcgcgatcttcgagaccgaattgattctgtaaaaaacacccagaagatcaccgaagcaatgaagcttgtggcagccgccaaggtccgaagagcccaagaagccgtcgtcaatggccggcccttctccgagaccctagtcgaggttctttacaacatcaacgaacagctccaaaccgaagacgtcgatgtccctctcaccagcgtccggacagtcaaaaaggttgccttggttgttgtcaccggcgatcggggtctctgtggtggcttcaacaacgcaatcatcaaaaaagcagaagcccggattgccgaattgaaggatctcggcgtggagttcactgttattagtgttggaaaaaagggtaattcgtatttcctacggcggccttatattccggtagataggtttcttgaaggggggagccttcccacagccaaagaagctcaggccatcgccgacgatgtgttctcgctcttcatcagtgaagaggtcgacaaggtggagcttttgtacaccaaatttgtgtcactggttaaatcggatcccgtgattcacactctgcttccgctctcaccaaagggggagatctgtgatgtgaacggaaactgtgtggatgctgcagaagacgagttgttcagattgacgaccaaggaagggaaattgacagtggagagggacactgtgcggaccgagacaatcgatttctcacccatcttgcaattcgagcaggacccagttcagatccttgatgcccttttgcctctgtatctgaacagccagattttgagggcgttgcaggaatcactggctagtgagcttgctgcgaggatgagtgccatgagcaatgccacagataatgcgaatgagttgaaaaaaaccctttccatggcctataatcggcaacgccaagctaagatcactggtgagatattggagatcgttgccggtgccgatgctcttgtctagtttgattttggggtcagttctcactttcccttctgttcttcttctttaatcctttttttttcttgggtattttctatttcattccaaaatgcttgtataagaacagatatttagaacagacagtttcttaattgtaattggctgctgcatgcgagcttcctgtataatgagaatctgcgttatgggtttggaccagcaaggatgttccatttcatcttattataattatatttaattaataatacctatatcaatttggagttatttgctccatgaatt

SEQ ID NO: 1003 - DNA, 1560 bp, Prunus persica
actatttgcctccatacaccagaagtactcacatgaagataaaacttgacaaacccaaaaaacaacctaaaagaaaccaaacctcacatatcagaccctcttctctgttcctcctcagcagcgtttcttccctccatttcagagattcagaagccccattaaaaccatgtcttgttcaaatttgacaatgtgggtgtcttcaaaacctgccctttctgacacctcctcgctctcctgccgttcttttatcagcccttttcagcttccttcacaaaactctctccctgccagcccctcaagatcgtcttctgtgtccccgattcactgcggtctccgtgagcttcgagaacgtattgattctgtaaagaacacccagaagatcactgaggctatgaagcttgtggcagctgccaaagtccgcagagctcaagaagctgtcgttaatggaagacccttctcggaaactcttgtggaagttctttacaacatcaatgagcagctccaagtggaagacatagatgctcctctgaccaatgttaggcctgtcaagaaagttgctcttgttgtcataaccggcgatcgtggtctttgtggaggtttcaacaattcaattatcaagaaagctgagagaagaatatctgaattgaaggctcttggtctcgaatacacgatcatcagcgttggcaaaaagggtaactcttattttctaaggcggccttacattccagttgataagtttcttgagggaaccaacctcccaactgccaaagaagcacaggccattgcagatgatgtgttctccctctttgtgagtgaagaagttgacaaagttgagcttttgtacaccaaattcgtgtcgttggttaagtctgaccctgtgattcataccttgcttccactctcaccaaaaggagagatttgtgatattaatggtgtgtgtgtggatgctgccgacgatgagttcttcaggttgacaacaaaggaagggaagttgactgtagagagagatgtggtgaggacaacaaccgtggatttcacaccggttttgcaattcgagcaggatccagttcagattcttgatgctttgctgcctttgtacctcaacagtcagattttgagggcattgcaagagtcactagccagtgagcttgctgctagaatgagtgctatgagcaatgcaactgataatgcagtggagttgaagaagaacttgtccagggtctacaacaggcagcgccaggccaaaatcacaggagagatattggagattgtttctggtgccaatgccttagtttgatcgctggataatgggggtgattcttttctcctccacatgagtttgtgcatcttaatttgttggtatgcatgttccattattcgtcgaaatataatgaagatcggtacttatgcagatttcacacttgattgtaattctcaactgcgcataaactttgtgcacactattttggaacaacagagcattccacatatattgtatgtccttttttctccatcatagccaacaatactgttaatctaattaaagatcccttcttttca

SEQ ID NO: 1004 - DNA, 1438 bp, Nicotiana tabacum
gcggcacgagatcagcctctcttttttttgcattgcagagctaagaaaaaaagtgccccttaaccatgtcttgctcaaatttgacaatgttggtatcctcaaaaccatctctttctgactcctctgcactttctttccgctcttctgtcagcccttttcagcttcctaaccacaacacatcaggcccttcaaacccctcaagatcatcatcagtcacccctgttcactgtggtcttcgtgatctacgtgatcggattgaatcagtcaagaacacccagaaaattactgaggctatgaagcttgttgctgctgctaaagtcagaagagctcaagaagctgttgtgggtgctaggcctttctctgagactttggttgaggtcctttacaacattaatgagcagcttcaaactgatgacattgatgttcccctcaccaaagtaagacctgtgaaaaaagtggctttggttgttgtcactggtgaccgtggtctttgtggtggttttaacaactacctcatcaaaaaagctgaggctaggattagagatttgaaagctcttggcattgattacactattatcagtgttggcaaaaagggtaactcttatttcatccgcaggccttacattcctgtagataagttccttgaaggaagcaatttgcccactgctaaagatgctcaggccattgctgatgatgttttttcgcttttcgtgagtgaagaggttgacaaagttgagcttttgtacacaaagtttgtgtctttagtgaaatctgaaccagtgattcacacccttcttccattgtcaccaaagggagagatttgtgacatcaatgggaactgtgttgatgcagcagatgatgagttctttaggttgacaacaaaggaagggaaactgacagtggaaagagatattatgaggactaagacaactgatttttcgccaatcttgcaatttgagcaggaccctgttcagattcttgatgccttgcttccactttacttgaacagtcaaatcttgagggcattgcaggagtcattagccagtgagcttgctgctaggatgagtgccatgagcgctgcaacagataatgcaactgagttgaagaagaacctttctagagcgtacaacagacagcgtcaggcaaagattacaggagaaatattggagattgttgctggagcagatgccttggtttaagcatacttcttcttgttcccctgcaattgtgcttctctgtaggtacaataatgaagtctagacaattcttattttctgcttctcagcctcgtacagactttgtgcacaagatgagaaccacattatattttgtacacaaggccggatcaaacgtatatttgtatttcaatttttcctgctatatttgtaaaacatgaattattgaaagcccgaagattcacttcctcgtaaaaaactcg

SEQ ID NO: 1005 - DNA, 1998 bp, Tripterygium wilfordii
aatgaaattcagacaatggagttgctgtaggtaatactcgtggccctttaaacgactttcggtaactccctcctctattggctcatcagtactcccaaagcagctgactgcgacacatttctaggattggtctgaatgttagatgctgtaaaattctgtgccagggatttggaattgagactccaatgttcagttgaaagtgatgtgtgaatgagagtaagacatttactgcatcaaatttttggttttgtaatattagatatttctattgctggtcagcctagtaaatttgcaatgcaaagcagttaatccatagcttagcttctgggcatgtgaagtatcaagctccataaaatccagtaaccccactgagatcacgcgacatcagattggaccccaccttaatcaaaattgctgtcccaaagcaatctccaacggtcaaaatccttatcccaaaacctcatccactccctcctcctccctccactcattcttctcttttccttccaatttaccaaaaccactcaacgcatgaaaaagataagcctctgacagaaagacatccttcttctcttctcgtagtctctgtagcaattcagacactgaaaaccatgtcttgctcaaatctaacaatgtggatttcctcaaaaccctccctttctgacccctcctccctctccttccgttcctctatcagccagtttcaatttcctaaccagaatttattccccagcagcccctccagaccctcctctgtgactcggattcagtgcggtcttcgagagcttcgtgttcgtattgattcagttaagaatacgcagaagatcactgaggccatgaagcttgttgctgcagccaaagtgaggagagcacaagaagctgttgtcaatggaagacccttctcagagacccttgtagaggttctttacaacatcaatgagcagctccagactgaggacgttgatactcccctcaccaaaattaggcctgtcaagaaagttgctttggtggttgtcactggtgaccgtggtctttgtggtggtttcaacaattatatcatcaagaaagcagaagctaggattgcacaattgaaagatcttggtgttgattatacagtaataagtgtgggaaagaagggtaattcttattttataaggagaccttatattcctgttgataagtttatcgagggagggtcattgccaacagctaaagaagctcaggcaattgcagatgatgtgttttcactctttgttagtgaagaggttgataaggttgaactcctgtataccaagtttgtgtcattggttaagtctaatcctgtaatccatactttgctaccactatcaccaaagggagagatatgtgatttgaatggaaactgtgttgatgcagctgatgatgagttctttagactgacaacaaaagaagggaaattgactgtggagagggaagcagtgaggactcagacagataatttctctccaattctgcagtttgagcaggacccagttcagattcttgatgccttgttgcctctgtacctaaacagccagattttgagagcattgcaggaatcattagctagtgaacttgctgccaggatgactgcaatgagcaatgctactgataatgcaatggaactgaagaagaacctctcactcgtatacaatcggcagcgccaggccaagattactggggagatattggagattgttgctggtgccaatgctttaagctagtgaattctggatctccactgtcaggacaccaggcctcacaagttactctgcttctttagtaggtggactttgttgtgaatgcttccttatttattcaaaatatgctttatctaagaacaatagtaatgagataaatataatttttgcattgtaatttctcaattgcgtataaactttggggagaaatgaaatgtattttgtaacagagatgttgtgagcttttgacatttcacaagaaagttgcctacttagcagc

SEQ ID NO: 1006 - DNA, 1535 bp, Arachis hypogaea
tctttctgctgttgtaatctacttacactgcagaagccccaaaaggtactccatctgcaataatgtcttgttccaatctcactatgttggtgtcctcaaaaccttctctttctgatgcctccaacctctccttccattctgttatcaacccttttcagctcccttcacaaaactcaccctcatgcagcctctcacgttcttctgtcacccagtacagtgtggtctcagagagctcagaacccgcattgaatctgtcaagaacacacagaagatcacagaagcaatgaagcttgttgcagccgctaaagtcagaagggctcaagaagctgttgttaatggaagacccttctcagagactcttgttgaggtcctctacaacatcaacgagcagctccaaactgaggacattgatgtccctctcacaaaagttaggccagtgaagaaggtagcactggttgtgtgcactggtgatagaggtctctgtggtggtttcaacaataacatcatcaagaaagccgaggcaagaattgctcaattgaaggatcttggtcttgactacactatcattagtgttggcaagaagggtaactcttacttcctccgtagaccttacataccagttgatcggtttctagaaggaggatcgctcccaactgcgaaagaagctcaggcaattgctgatgatgccttctcgctgtttatcagtgaagaggttgacaaagtagaactcttgtacacaaagtttgtgtcattggtgaaatcagatcctgtgattcataccttacttccactgtcgccaaagggagagatttgtgacatcaatggaaactgtgttgatgctgctgatgatgagttcttcaggctaacaacaaaggaaggaaagctaactgtagagagggatgctgtgaggacaaagacagaagactattcaccaattttggagtttgagcaagatcctgttcagatccttgatgctctcttgccgctttatctcaacagccaagtcttgagagcacttcaagaatcacttgcaagtgagcttgctgctagaatgagtgcaatgagtagtgcaactgataatgctgttgagttgaagaagaacttatccattgtctacaatagggaacgtcaggctaagatcacaggtgaaattcttgagattgttgctggtgccaatgctcttcaataggttacttttggcatcatcatcatcattatccatggttggatttatttgtaggtgtccaatatcataaaagggtgttgtcgctcccctttattacattctaatgttcttatttatgaccgttatgaaactatgcgatttttacacttctgaaatataaaaaactaggagtctcaaagggaaacctttattttttttgtcaagttttttccctccttttcatctcacaaatgatgtatgtaataatagatctatatatcatgtcactgttttggaagttgtatctaaaaatttatcatttatatactttattgtggctttcacaatgactaattactgatttaggtat

SEQ ID NO: 1007 - DNA, 1491 bp, Coffea canephora
cacacaaactcttaaaacaaaccaaccccacacctcatatcttcttctcttcccctccctctgatcctcctcttctcctccattgccaccggtttttgtagagctccaaagaggggctgaagcctgaaaccatgtcttgctcaaatttaaccatgtgggtttcctcaaaaacttctctttctgattcaactgcgctttcttttcgctcttcaatcacccctgttcagctccctagcaacaactcaaccactgccaacccctcaaggccatcatcagtaactccaattcattgtggacttcgcgagcttcgtgatcgtattggtactgtgaagaacacacagaaaatcacggaggccatgaagcttgtggctgctgctaaagtgagaagagctcaagaagctgtggtcaatgccaggccattttcagaatctctagtcgaagttctttacaacattaatgagcagctccaaactgacgacattgatgttcctctcaccaaagttaggcctgttaagaaggttggtcttgtagtcgttaccggtgatcgtggactttgtggtggttttaacaatgcaattattaaaaaggcggaggctaggatagcagaattgaagggacttggccttgattacactataatcagtgtggggaaaaagggtaactcatattttatccgcaggccttatattccggtagacagatttcttgatggtacttctcttcccactgctaaagaagctcaagcaattgcagatgatgtcttctcgcttttcataagtgaagaggtggataaggtagagcttttgtacactaagttcgtttcattagtgaaggccgaaccagtgattcacactctgcttccgttgtccccaaaaggagagatctgtgacataaatgggaactgtgttgatgcagccgaggatgagttcttcagattgacaaccaaggaaggcaaattgacagtggaaagagacattatgaggactaaaacaacagagttttcggcgatcttgcaatttgagcaggaccctgttcagatccttgatgccttactccctctttacttaaatagtcaaattttgaggtcattgcaggagtcactggctagtgagcttgctgctaggatgactgcaatgagcaatgcgacagacaatgctattgaattgaagaaatccctgtctatagtctacaacagagagcgtcaggccaagattacaggagagatattggaaattattgctggagccaatgctttgacttaagcattttaattgtctcccatgattgtgcttcactataggtatttttgttgaaaattccattttcatcaaactatgcttatttaagaactgtaaagtagagtagacagtttcgtgttgtaacttccaaccacatacaaacttcatgcaatatgagaaccacaatgtattttggagacatgagagtgtttctgcatctttgaaacttttatttttgagtcatcttgtgtaa

SEQ ID NO: 1008 - DNA, 1577 bp, Papaver somniferum
cccccctctacctctcattcctccaagcacagcccaaatcccaaacaactctcatctcccctttctccttcctcttctctctgtgaatctgtggagagcaaaaaaacccagcaaaaatcatgtcttgctcaaatctaaccatgttggtctcttcaaaatcaagtctctctgatccatctgcactctcatttagatctgccctaaacccattttgtctcccaacttacaattcaacaaccccgtcatctcgatcttcatctcaaattagttgcaatcttcgtgaactccgtgaccgtattggttctgtaaccaatacccagaagattactgaagcaatgaagcttgtggctgctgcgaaagttagaagagctcaggaagcagtggtaagtggtagacccttttctgaaaccctagttgaagtactttacagtcttaatgaacaacttcagaatgaagatgttgatattcctttaacaactgttcgtcctgttaagaaagttgcattagttgttgttactggtgatcgaggtctttgtggtggtttcaataatcagctcttgaaaaaagctgaagctagaattgcagaattgaagagtcttggtttgcaatacactattattagtgtcgggaaaaagggaaatacttatttctctcgtagaccttatattcctgttgataaataccttgatggtggaaatcttcctactactaaagaagctcaagctattgcagatgatgtgttttcgttgtttattagtgaagaagtcgataaagtcgaacttttatacactaagtttgtttctctagtgaaatcagatccagtcattcatacactgcttccactttcgcctaaaggagaaatttgtgatatcaatggaacatgtgttgatgcagcagacgatgagcttttccgcttgactaccaaagaaggaaaattgactgtcgaaagggatgtagtgcgaactaaaacaattgatttttcacctatcattcaatttgagcaagacccagttcagattcttgatgcacttctgcctttgtatttaaacagtcaaattttgagggcattacaggaatctttagctagtgagcttgcagccaggatgagtgccatgagcagtgcatctgataatgcaagtgatttgaagaaagctctttcaacacagtttaaccgaaggcgtcaagctaagattactggtgagatattggagattgttgctggtgctgatgcgttagtatgaattctgcttataactcttcagtttcgcttatatgttattgttccttctcttctttttgatgttccgcttcctaattcattaaagtatgcctgtataagaaattagttatttaagaatcgacaacttcataaatgtaagtttcggctgcgttcgagctttctgtacaatgagtaaaaccaacaatgtcgattcggaacaaatgtgttccttgtcattatgttcatctccttcttcatatatacctgtataattttagagttcttctctagttcaatctgtctcatggttgtttggataaccggagtataatagtataatttggagttcttctttgtt

SEQ ID NO: 1009 - DNA, 1382 bp, Petunia hybrida
gaccgtttgccaaaaccatgtcttgttcaaatttaacaatgtggtgtcttcaaaaccagctctttctgatccctcttcactttctttctgctcttctatcaacccttttcagctctttaaccataactcatcaggcccttcaaatccttcaagatcatcatcagttgttcactgtagtcttcgtgatctacgtgatcgtattgattcagtcaagaacactcagaaaattactgaggctatgaaacttgtggctgctgctaaagtcagaagagctcaagaagctgtggtgggtgccaggcctttttcagaaacacttgttgaggtgctttacaatatcaatgaacaacttcaaacagatgacattgatgttcctttaactaaagttagacctgtcaagaaagtggctttagttgttgtcaccggtgaccgtggtctttgcggtggttttaacaacaatatcttgaaaaaagctgaggctaggattagagatttgaaagctcttggccttgattacactcttataagtgttggcaaaaagggtaatacttacttcagccgaaggccttatattcctgttgataagtttattgaaggtagtaatttgcctactgctaaagaagctcaggctattgctgatgatgttttctcactctttgtgagtgaagaggttgacaaagttgagcttttgtacacaagtttgtgtctctagtgaaatctgatccagtgattcacaccttgcttccattgtcaccaaagggagaaatctgtgacatcaatggaaactgtgttgatgctgctgaagacgagttctttaggttgactacaaaagaagggaaattgacagtggaaagagatgttatgaggactaaaacaagtgatttctcaccaatcttgcaatttgaacaggaccctgttcagattcttgatgccttgttgccactttacttaaacagtcaagtcttgagggcattgcaggagtcattagccagtgagcttgctgctaggatgagtgccatgagcagtgcaacagacaatgcaattgaattgaagaagaatctgtctagagtgtataacagacagcgtcaggcgaagattactggagaaatcctggagattgttgcaggagcagatgccttggtttaatcaagtaaagttcttgatcttcttgtttccctgcaattgtgcttctccattggtacaataatgaagtgtagacaatttttattttgtatttctctacctcgtacaaactttgtgcacaagatgagaaccatattgtatgttgtacacaaggccggaccaaacttatatttgtaattcaatttttcctgctatatttgtaaaacatgaattattgaaagcctgaagattcactttatcat

SEQ ID NO: 1010 - DNA, 1880 bp, Arnica chamissonis
aaagccgccacattgctagaataacacccctaatcaataatcatgtcttgctcaaatctaacaatgtgggtctcttcaaaaccatcacttgattcatcatcacccctttcttccagatctttcatcaccacagttccaattcccacttcaaacccatcaaactccaactatgcgatttcaaaatcttcttcttcaattcattgcagcctccgggatcttcgcactcgtatcgattcagtgaagaacacacagaaaatcactgaagcaatgaagcttgtggcagctgcaaaagttagaagagcccaagaagctgttgtgaatgcaaggcctttttctgaaactttagttgaggttctttacagcatcaacgagcagctgcaaacagaggatgttgatgtcccgttaacgaatgtccgaccggtgaagaaggtggcgctcgtggtggtcaccggagaccgtggtctttgcggtggtttcaataactttatcttgaaaaaagccgaagcgagaattaaggaactcaagactcttggcattgattacgttgtgatcagtgtcgggaaaaagggtaattcatatttcctgcggcgaccatacattccggtggacaagttttttgacggaagcaatctcccgactgcgaaagaagctcaggcgattgcagacgatgtgttttcactgtttgtaagtgaagaggtggataaggtggaacttttgtacacaaagtttgtgtctttggtaaaatctaatcctgtgattcatactttacttccattatcacctaaaggagagatttgtgacatcaatggagtgtgtgttgatgctgctgaagatgagttctttaggttgaccactaaagagggaaagttgaccgtcgaaagagacgtggttaggaccgaaaccgtggatttttcaccaatcttgcaattcgaacaagacccggttcagattcttgatgccttgctgccactgtatttgaacagtcagatattgagggctttacaggagtcattagcaagtgagcttgctgcaagaatgactgcaatggggaatgcaactgataatgcttcagagttgaagaagagcttgtctcaggtttacaatcgacagcgccaggccaagattacaggagagattttggaaattgttgcgggtgctgatgcgttagtttgatgatcatgtttctgggatcagtatatgtgttttgggtgttgaattcgatcataatatgtgtttatttttttacaggaaaaatgtgtggaggatgtcataatttttcagaattaattaaattgtaatctgtatccccctccaaacaaatgaattttgtgtttttgaatatgaaaaactacataaaaatgttgaataaaatatgcaaaacagatatgaaatttgccacaaacttgggttatcaaatatcacaattcttttccaaacacaataatggcttcaagaacttaacacaatctggtttttattcttgtaaaagcaatctgagaccacctggtttttggtttcagaataccagaaataagtttattttgggtctgcaaagaaggaattgatgtttggcattatttccggactcttgttgcgaacaaacttcctcaaccgatgctccgtgtacttttcaccttcagcgaagttatccagcacacccgcagctctattttccttggtcactctgacttcagggttgccgctgatgttgcggaccaattgcatcccgcagattccgacggcgacgccaagagcagcaaacagagggtatacctcaggcctcaaccaacgcttgagtgtcgaagaagacattttgagcaacgccggcagacgtaaaccggagatgcaggtcgtcgcaatgaatgaaaatgaggacgaat

SEQ ID NO: 1011 - DNA, 1474 bp, Lactuca sativa
gcgggggacatctccctcactcaaagcctcatccacattctaaaattcccacacatacacaatccaccatacaagcaaaagataagatttttatcaagaaacaaaaactctttacgcatccccaacctccattgttgaattctggaagaaaaccctaatcggacatcatgtcttgctcgaatctaacaatgtgggtatcttcaaaaccctcatcactcgattcatctgccctctccttcagatcgttcatcagcccagttcaaatcccaaattccaatccatcaatttcgaattccagaccttcttcttcctcgatcaattgcagtctgaaggagcttcgtggtcgtatagaatcagtgaagaacacccagaaaatcactgaagcaatgaagcttgttgcagctgcgaaagtgagaagagctcaagaagctgtcgtgaatgcgagaccattttcagaaactttagttgaagttctttacagcatcaacgaacagctccaagtagaagacgttgatgtcccacttaccagtgtccgaccggtgaagaaggtggcgcttgtggtggtcaccggagaccgtggtctctgcggtggtttcaacaacatgatccttaaaaaagcagaagcaagaattcgtgaactcaaaactcttggacttgaatacgtagtcatcagtgttggcaaaaaaggtaactcttatttttcccggcgaccatacattccggtggataagtttcttgacggaagcaacctccccactgcaaaagaagctcaggcgattgcagatgatgttttctcactttttgtaagtgaagaagtcgataaagtcgaactgttgtacacaaaattcgtctctttggtcaaatccgaccctgtgattcatacattacttccattatcgcccaaaggtgagatctgtgacatcaatggagtctgtgttgacgcagctgaagacgagtttttccggttgaccacaaaagaaggaaagttgaccgttgaacgagacgtcgtgagggctgaaaccattgatttctcaccgatcttgcaattcgaacaggacccagttcagattcttgatgctttgctaccattgtatctaaacagtcagatcttgagggctttacaggagtctttagcgagtgagcttgctgctagaatgactgctatggggaacgcgactgataatgctgtggagttgaagaagaacttgtcgcaggtttacaatcggcgacgtcaggccaagatcaccggagagattttggagattgttgctggtgctgatgcgttggtttgattgggttttggaatcggtatacttcttgatcttataatgtttatctgtttttttcggaattaattgcgatatgtaatcatgatactcccactaagcaaatgaaatttgtgtatttgaatatatatatgtatatgaagaagtttatcatctcctgtatcgaggttgtgctttaataagttttg

SEQ ID NO: 1012 - DNA, 1552 bp, Lactuca sativa
catctccctccactcaaaagcctcatccacattctaaaattcccacacatacacaatccaccatacaagcaaaagataagatttttatcaagaaacaaaaactctttacgcatccccaacctccattgttgaattctggaagaaaaccctaatcggacattatgtcttgctcgaatctaacaatgtgggtatcttcaaaaccctcatcactcgattcatctgccctctccttcagatcgttcatcagcccagttcaaatcccaaattccaatccatcaatttcgaattccagaccttcttcttcctcgatcaattgcagtctgaaggagcttcgtggtcgtatagaatcagtgaagaacacccagaaaatcactgaagcaatgaagcttgttgcagctgcgaaagtgagaagagctcaagaagctgtcgtgaatgcgagaccattttcagaaactttagttgaagttctttacagcatcaacgaacagctccaagtagaagacgttgatgtcccacttaccagtgtccgaccggtgaagaaggtggcgcttgtggtggtcaccggagaccgtggtctctgcggtggtttcaacaacatgatccttaaaaaagcagaagcaagaattcgtgaactcaaaactcttggacttgaatacgtagtcatcagtgttggcaaaaaaggtaactcttatttttcccggcgaccatacattccggtggacaagtttcttgacggaagcaacctccccactgcaaaagaagcccaggcgattgcagatgatgttttctcactttttgtaagtgaagaagtcgataaagtcgaactgttgtacacaaaattcgtctctttggtcaaatccgaccctgtgattcatacattacttccattatcgcccaaaggtgagatctgtgacatcaatggagtctgtgttgacgcagctgaagacgagtttttccggttgaccacaaaagaaggaaagttgaccgttgaacgagacgtcgtgagggctgaaaccattgatttctcaccgatcttgcaattcgaacaggacccagttcagattcttgatgctttgctaccattgtatctaaacagtcagatcttgagggctttacaggagtctttagcgagtgagcttgctgctagaatgactgctatggggaacgcgactgataatgctgtggagttgaagaagaacttgtcgcaggtttacaatcggcgacgtcaggccaagatcaccggagagattttggagattgttgctggtgctgatgcgttggtttgattgggttttggaatcggtatacttcttgatcttataatgtttatctgtctttttcggaattaattgcgatatgtaatcatgatactcccactaagcaaatgaaatttgtgtatttgaatatatatatatatatatatgtatatgaagaagtttatcatctcctgtatcgaggttgtgctttaataagttttgcatctaataaattctttagaatattgataaaacttcatcgttgccaataaataaatgatttcggagcttttcag

SEQ ID NO: 1013 - DNA, 1582 bp, Papaver somniferum
aggaagcagaacatcaaaaagagaaagaacaataacatataagcgaaactgaagagttatgagcagaattcatacaaacccaaaatccccaaaacaactctcatctcacctttctccttcctcttctccctgtcaatctgtggagagcaaaaaaaacacagcaaaaatcatgtcttgctcaaatctaactatgttggtctcttcaaaatcgagtctctctgatccatctgcactctcatttagatctgccctaaacccattttgtctcccaacttacaattcaacaaccccatcatctcgatcttcatctcaaattagttgcaatcttcgcgaactccgtgaccgtattggttctgtaaccaatacccagaagattactgaagcaatgaagcttgtggctgctgcgaaagttagaagagctcaggaagcagtggtaagtggtagacccttttctgaaaccctagttgaagtactttacagtcttaatgaacaacttcagaatgaagatgttgatattcctttaacaactgttcgtcctgtcaagaaagttgcattagttgttgttactggtgatcgaggtctttgtggtggtttcaataatcagctcttgaaaaaagctgaagctagaattgcagaattgaagagtcttggtttgcaatacactattattagtgttgggaaaaagggaaatacttatttctctaggagaccttacattcctgttgataaataccttgatggtggaaatcttcctactactaaagaagctcaagctattgcagatgatgtgttttcgttgtttattagtgaagaagtcgataaagtcgaacttttatacaccaagtttgtttctctagtgaaatcggatcctgtcattcatacactgcttccactttcgcctaaaggagaaatttgtgatgtcaatggaacatgcgttgatgcagcagacgatgagcttttccgcttgactaccaaagaaggaaaattgactgtcgaaagggatgtagtgcgaactaaaacaattgatttttcacctatcattcaatttgagcaagacccagttcagattcttgatgcacttctgcctttgtatttaaacagtcaaattttgagggcattacaggagtctttagctagtgaacttgcagccaggatgagtgccatgagcagtgcatctgataatgcaagtgatttgaagaaagctctttccacacagtttaaccgaaggcgtcaagctaagattactggtgagatattggagattgttgctggtgctgatgcgttagtatgaattctgctcataactcttcagtttcgcttatatgttattgttctttctctttttgatgttctgcttcctgattcattaaagtatgcctgtataagaaattagttatttcagaatcgacaacttcataaatgtaagtttcggctgcgtttgagctttctgtacaatgagaaaaaccaacaatgtcgattcggaacaaatgtgttccttgtcattatgttcgtctccttcttcatatatacctgtataattttagagttcttctctagttcaatctgtctcatggttgtttgg

SEQ ID NO: 1014 - DNA, 1464 bp, Papaver somniferum
atctctcctttctcttctctctgtgaatctgtggagagcaaaaaaaaaacacagcaaaatcatgtcttgctcaaatctaaccatgttggtctcttcaaaatcaagtctctctgatccttctgcactctcatttagatctgccctaaacccattttgtatcccaacttacaattcaacaactccatcatctcgatcttcatctcaaattagttgcaatcttcgcgaactccgtgaccgtattggttctgtaaccaatacccagaagattactgaagcaatgaagcttgtggctgctgcaaaagttagaagagctcaggaagcagtggtaagtggtagacccttttctgaaaccctagttgaagtactttacagtctcaatgaacaacttcagaatgaagatgttgatattcctttaacaactgttcgtcctgttaaaaaagttgcattagttgttgttactggtgatcgaggtctttgtggtggtttcaataatcagctcttgaaaaaagctgaagctagaattgcagaattgaagagtcttggtttgcaatacactattatcagtgttgggaaaaaggggaatacttatttctctcgtagaccttatattcctgttgataaataccttgatggtggaaatcttcctactactaaagaagctcaagctattgcagatgatgtgttttcgttgtttattagtgaagaagtcgataaagtcgaacttctatacactaagtttgtttctctagtgaaatcggatccagtcattcatacactgcttccactttcgcctaaaggagaaatttgtgatgtcaatggaacatgtgttgatgcagcagacgatgagcttttccgcttgactaccaaagaaggaaaattgactgtcgaaagagatgttgtgcgaactaaaacagttgatttttcacctatcattcaatttgagcaagacccagttcagattcttgatgcacttctgcctttgtatttaaacagtcaaattttgagggcattacaggaatctttagctagtgaacttgcagccaggatgagtgcgatgagcagtgcatctgacaatgcaagtgatttgaagaaagctctttccacacagtttaaccgacggcgtcaagctaagattactggtgagatattggagattgttgctggagctgatgcgttagtatgaattctgctcataactcctcagtttcgcttatatgttattgctctttttcttctttctttttttgatgttctgcttcctaattcattaaagtatgcctgtataagaaattagctatttcagaatcgacaacttcataaatgtaagtttcggctgcgttcgagctttctgtacaatgagaaaaaccaacaatgtcgatttggtaacaaatagtgttccttgtcattatgtcaatctccttcttctatatatacatgtataatctctctagttcgatctggctc

SEQ ID NO: 1015 - DNA, 1085 bp, Brassica juncea
aaccaaaactctgtccgaacaaaaacaaaaccttctcttctctctcagaacatatcaagaacactggcttgcactaacctaacaacaatgtgtctttcatcaaaaccatctctttctgattcttcttccttgtccttccgatctgttctcaacccacttcctctcccaaaccacaactcctctccttcaagatcctcctccgtttcaccaatccaatcctcccttcgtgagctcagagaccgtatcgattccgtcaaaaacacccataagatcaccgaagccatgaagcttgtcgctgccgcaaaagtcaggagagctcaagaagccgtcgtcaacggccgaccgttctcagaaaccctagtcgaggttctttacaacatcaacgaacagcttcaaaccgatgacatcgacgtgcccttaaccaagatcagaccggttaagaaagttgcactcgtggtcgtgaccggagatcgtgggttatgcggtgggttcaataacttcatcatcaagaaagcagaggcgaggatcaaggagcttcaaggtctaggtcttgactacacagtcattagcgtggggaagaagggaaactcttacttcctccgtcgtccgtacatccccgtcgacaagtacctcgaagccgggaccttaccgaccgcgaaagaagctcaagctgttgctgatgatgtcttctctctgtttataagcgaggaagtcgacaaagtcgagctcttgtacacaaagttcgtgtctctggtcaagtcagaacccgtgatccacacgctactgcctctatcgcccaaaggagagatctgcgacatcaacgggaactgtgttgacgctgccgaagacgagctcttcaggttaacgaccaaagaagggaagcttacggtcgaaagagagacttttaggacaccaactgctgatttctcaccgatcttgcagttcgagcaagaccctgttcagattcttgatgctctgttgcctctgtatctcaacagtcagattcttatggctttacaggagtctttggcgagtgagcttgcagctagaatgagtgcaatgagtagtgcttctgataatgcatc

SEQ ID NO: 1016 - DNA, 1475 bp, Actinidia deliciosa
  misc_feature (740)..(740): n is a, c, g, or t
aaacactccctcccgtcctccctccctccctcccctcccttcacctcacatttcactcctttgctccacacaaatagaacccacttcacattaccctctcctcttcacttctccaccatagctgatgctttgcagagcccaacacacaaaccatgtcgtgctcaaatctatcaatgtgggtctcttcaaagccctctctctcggacccgtcttctcgctcttacagctctttccaccgccactctagatcttcgtcagtcagaccgattcagtgcggcagccttcgcgagcttcgcaaccgaatagattcagtgaaaagtacccagaaaatcactgaagcaatgaagcttgtggctgctgctaaagtgagaagagcacaagaagctgtggtcaatggaaggcctttttcacaaacacttgttgaagttctttacagcatcaatgaacaagtccagacagaggacatagacattcctctgactaaagttaggcctgtgaaaaaagtggctttggtggttgtcaccggtgaccgtggcctttgtggcggtttcaacagcgcgattatcaagaaagccgaagcaagaatcgcggaattgaaagatctcggccttgaatacactttgatcagtgtggggagaaagggaaacacgtattttctccggaggccttatattccggtggagaagtttcttgagggagggaggctgccgactgctaaagaagcccaggcgatcgcaganaatgttttctctctctttatcagcgaagaggtcgacaaagttgagctcttgtacactaaatttgtgtcgttggttaagtccgacccggtgattcacacactgcttcctctgtccccaaagggggagatttgtgacatcaatgggaagtgtgttgatgcagccgaagacgagttctttaggctgacaacaaaagaagggaaattgacagtggagagagatgttgtgaggactcaaaccgtcgatttctcacccatcttgcaattcgaacaagacccggttcagattctcgatgccttgttgcctctatacttgaacagccagatcttgagggccttgcaggagtcacttgccagtgagcttgctgctaggatgactgccatgagcaatgccaccgacaacgcagtggagctgaggaagaccctctcgatggtgtacaataggcagcgccaggcaaagattaccggagaaatattggagattgttgccggagccgatgctttatcctgaggggtgatatatatttgtggttatgcttctccgatggtattttttttgtgggtaattccttgttcctgcagttatgcttgctcatgaacaactatggaaactagatactttttgattgtaattctctaattctcaactgtgtacaatctcttttggaacacggctttttgttcatcttttgtatgctactttccctcatatataaatacttgtatcatttggagttct

SEQ ID NO: 1017 - DNA, 1555 bp, Aristolochia fimbriata
agcctcgcatttccctccactcatttcttccaaatcactctccaacacaaaaatcagcccaatacccattactctctctcctctgccttcccactccttcccttccctctgctcttgctgcagccgagggaccgagcgagagtgatcggaatttggtatcgtttgttcttgccaattcctggctaggatgtcttgcgccaatctcacaatgtgggtttcctcatcgaaaccatctctttccgacccaaatcccctttcatcccgatctgccatcacccccttccgtctcccttctcccccttcttccgtccccaaccgcgcgtctccgacccaaattcagtgcggtctccgggagctccgggttcgtatcgattcggtcaagaacacccagaagattacggaggcgatgaagctcgtggctgcggctaaagtccggcgtgcgcaggaagccgtggtcaatgcccggcccttctccgaaaccctcgtcgaagtcctttacaacatcaacgagcagctccagacggatgatatcgatgttcctctgacaaaggtgcgcccggttaagaaggtcgcccttgtcgtcgtcaccggggaccgtggtctctgcggtggattcaacaacgccattttgaagaaggcggaatcgcggattgcagagctcaaacaacttgggctggagtacaccatcatcagcgtcggcaaaaagggtaacacttatttcttgcgtcgaccttatattcccgtcgataggttcttggaaggtgggactttgcccaccacgaaggaagcgcaggccatagccgacgatgtcttttccctattcgtgagcgaggaagtcgataaggtggagcttctgtacaccaagttcgtttccttggtgaaatccgatcctgtgatccacactctgctacctctgtctccgaagggggaggtttgcgatataaatggggtctgcgtcgacgcggctgaggatgagctcttcagactgactaccaaggaagggaaattgactgttgagagagatactgtccggaccccgacgcctcaattctctgccatcctgcaattcgagcaagacccagttcagattctcgatgccctcttgccgctttacttgaacagtcagcttttgagggctttacaggaatctctggctagcgagctcgcagcacgaatgagtgcgatgagtaatgccacagataacgccatggagttgaagaagaatctctctattgcttacaataggcagcggcaggcaaagatcaccggggagatcttggagattgtcgctggagccgaggctctcacctaatttggttccgtccagttcttctctgtctacaattgatttttgtgtctatttcattcaaatatgaaaccttcctctcttttttttgtgttatataaaacatattaataactataattcaagactgcagaagtcctacttgaattctcttcatgccctctgtgaagttcttttaggaagtttttatggtcatcgatcttgcttatgatctgttggcagcttcaaataaaatagctcaaagttgtt

SEQ ID NO: 1018 - DNA, 1680 bp, Cicer arietinum
ctcattacttccatattccaatacagatcacagaacacaaaacacattaacattactacaagataagacatcacaaaactaaaaaccacacactgacaccctctctttctctgctataatctctctgcagagactcaacaatgtcttgctccaatgtcaccatgttggtctcctccaaaccttctttatcagatgcctctaacctctccttccgttcagctttcaacccttttcagcttccttcacaaaactcatctacttgcaccccttcaaaaacctctcacaccccctcaattcagtgtggtctaagagaactcagaaaccgcattgactctgtcaaaaacactcagaaaatcacagaagcaatgaaacttgtcgcggccgcaaaagtcagaagagctcaagaagctgttgttaatggaagaccgttctcagagacacttgttgaagttctctacagcatcaatgaacagcttcaaactgaagatgttgattctcctctaactaagcttaggcctgtgaaaaaagttgcacttgttgtttgcacaggtgacagaggtctctgtggtggtttcaacaataatatattgaagaaagctgaaagaagaattgctgagttgaaaactcttggtcttgattacactgttatcagtgttggtaaaaagggtaactcttatttcattcgtagaccttatatacctgttgataggtttctcgaaggtggaacacttcctactgctaaagaagcacaagctatagcagatgatgttttttcactttttgttagtgaagaagttgataaagttgaacttttgtatactaagtttgtttcattggtgaaatcagatcctattattcatactttgcttcctttatcacctaaaggtgaaatctgtgatataaatggaatctgtgttgatgctgctgaagatgaacttttcaggttaacaacaaaagaaggaaagttaactgttgaaagagatactgttaggactaagacgattgatttttcgcctattttgcagtttgagcaggatcctgttcaaattcttgatgcacttttgccactttatttgaacagtcaaatcttgagggcgttgcaggaatcacttgctagtgaattagctgctaggatgagtgctatgagtaatgctactgataatgctgttgagttgaagaagaacttgtcgagggtgtataatcgggaacgtcaggcaaagatcactggtgaaattcttgaaattgttgctggagctgatgccttacaatagattgtgtattatattatataagggctgttctatttctctcatccatggttggaacttggaagttggatttctttgtaggtaatttttataatgaacattgcccttttcattctctctatataaatatgcttgtataagactgttatgctatgcatgcaaattttacaaatttattgtcttttcctaatgtgcaaactttttgtcctaggaaaactgcaatttattctgatgaagcagactcattttttgttcagttttttgttcacttctaagttatataatatatgtatgtaataacagatctgtataaataatattcagagagttctctgtgttgattattataccataagcatggctgtaatctgatattctaaagtgaaatttcaattactactttttatgagtc

SEQ ID NO: 1019 - DNA, 1603 bp, Cicer arietinum
cttcttctcattccctccactcattcccacttctcattacttccatattccaatacagatcacagaacacaaaacacattaacattactacaagataagacatcacaaaactaaaaaaccacacactgacaccctctctttctctgctataatctctctgcagagactcaacaatgtcttgctccaatgtcaccatgttggtctcctccaaaccttctttatcagatgcctctaacctctccttccgttcagctttcaacccttttcagcttccttcacaaaactcatctacttgcaccccttcaaaaacctctcacaccccctcaattcagtgtggtctaagagaactcagaaaccgcattgactctgtcaaaaacactcagaaaatcacagaagcaatgaaacttgtcgcggccgcaaaagtcagaagagctcaagaagctgttgttaatggaagaccgttctcagagacacttgttgaagttctctacagcatcaatgaacagcttcaaactgaagatgttgattctcctctaactaagcttaggcctgtgaaaaaagttgcacttgttgtttgcacaggtgacagaggtctctgtggtggtttcaacaataatatattgaagaaagctgaaagaagaattgctgagttgaaaactcttggtcttgattacactgttatcagtgttggtaaaaagggtaactcttatttcattcgtagaccttatatacctgttgataggtttctcgaaggtggaacacttcctactgctaaagaagcacaagctatagcagatgatgttttttcactttttgttagtgaagaagttgataaagttgaacttttgtatactaagtttgtttcattggtgaaatcagatcctattattcatactttgcttcctttatcacctaaaggtgaaatctgtgatataaatggaatctgtgttgatgctgctgaagatgaacttttcaggttaacaacaaaagaaggaaagttaactgttgaaagagatactgttaggactaagacgattgatttttcgcctattttgcagtttgagcaggatcctgttcaaattcttgatgcacttttgccactttatttgaacagtcaaatcttgagggcgttgcaggaatcacttgctagtgaattagctgctaggatgagtgctatgagtaatgctactgataatgctgttgagttgaagaagaacttgtcgagggtgtataatcgggaacgtcaggcaaagatcactggtgaaattcttgaaattgttgctggagctgatgccttacaatagattgtgtattatattatataagggctgttctatttctctcatccatggttggaacttggaagttggatttctttgtaggtaatttttataatgaacattgcccttttcattctctctatataaatatgcttgtataagactgttatgctatgcatgcaaattttacaaatttattgtcttttcctaatgtgcaaactttttgtcctaggaaaactgcaatttattctgatgaagcagactctatttttgttcagttttttgtcacttctaagttatataatatatgtatgtaataacag

SEQ ID NO: 1020 - DNA, 1439 bp, Gossypium hirsutum
taggaaaaagctctttctcttgctctttttagagtaaatttcttttgcaatcctttgtagagctccgggatccattgtcaccatgtcttgctcaaatctgacaatgtgggtgtcctcaaaaccctctctttctgacacttcttcactctctttccgttctttcatcagcccttttcagctcccatctcagagctcaacccccggtaacccttccaggtcctcatctgtaaccccagttcactgtggtcttcgtgagcttagagaccgtattgattcagtaaagaacacgcagaagatcactgaagccatgaaacttgtggctgctgctaaagttaggagagcacaagaagctgttgtcaatggcagacctttctctgagtccctggttgaagttctttacaacatcaatgaacagctccagactgaagacatagatgctcctctcacaaacgtcaggcctgtcaaaaaagttgctttggttgttgttactggtgatcgtggtctctgtggaggttttaacaatgctatcatcaagaaagctgaagctagaattgcagaattgaagcagcttggacttgattatacaataatcagtgtggggaaaaagggtaattcatatttcatccgcaggccctacatcccagtggacaaattcctagatggtagctcactccctacagctaaagaagctcaggcaattgctgatgatgttttttcactctttgttagtgaagaagtcgataaagtggagcttttgtacaccaaattcgtatccttggttaagtctgatcctgtgattcatactttgcttccactgtcaccaaagggtgaaatctgtgatgtaaatggtgtttgtgttgatgctgctgaggatgagtttttcagattgacaaccagggaagggaaactgacggtggagagagaagttatgaggactcagacagctgatttttttcccattttgcagtttgagcaggacccagttcagatttttgatgctttgttgcctctttatctcaacagccaggttttgagggctttgcaggaatcactagccagtgagcttgcagttaggatgagtgccatgagcaatgttactgataatgcccaggaactgaaaaagaccttgttttttgtttacaaccggcagggtcaagggaaaatccccggagagatattggagattgttgctggggccaatgctttggtttaatgaacttgaaacctgtttccccatcaattatgttcccttgtaggtattaaaaagaattattaaattatgagtagtttccctattcaatcctatatacttgtttaagaacagccatgctgatatgtttttttttttttttgcattgtaattctcgaatgcttatgaactctttgcacagtgggaaccgcaatgtcttttggagttgaaaaataagagcatttaccca

SEQ ID NO: 1021 - DNA, 1648 bp, Mimulus guttatus
gcagataagactcaaccagagaaaaatctctcttacacaaaccaaaaaccaccaccacttgtcctcttcttctcttcctccatagccaccaccaccaccaccacctttctgcacagacaacaaatcttgcagaaagaaaaacaatgtcttgctccaatctcactatgctagtctcctcaaagccatccctctccgacccatccaccctctcctcccgctccttcctcagccccttccacctccctaactccgccacctcctcccccaccccttcccgcccctcctccacccaaatcaactgtggcctccgtgagctccgcgagcgcatcgtctccgtaaccaacaccaagaagatcaccgaggccatgaaactcgtcgccgccgccaaagtcaggcgcgcccaggaagccgtcgtcaacgcccgccccttctccgaaacccttgtcgaggtcctctacaacatcaacgagcagctccagatcgaagacgtcgacatccctctcaccaagatccgacccgtcaagaaagtcgccctggttgtcatcaccggcgaccgtggtctctgcggcggctacaacaactacatcatcaaaaaagccgaagcccgcatcaaggagctcaagcagctcggcctcgagtacacagtcatcagcgtcggcaaaaagggtaacacctacttcacgcgccgcccgtacatacccgtcgacaagtttatagaaggcagcaacctccccactgccaaagaagctcaggcaatcgccgacgatgtcttctccctcttcgtcagtgaggagtgcgacaaagtcgagcttctctacacaaagttcgtatctttggtgaaatcgaaccccgttattcacactctgctcccgttatctcccaggggagaaatatgtgatatcaacggtatctgtgttgacgctgcggatgatgagttcttcaggctgaccacaaaggaagggaagttgactgtggagagagatgttgttagaaccaagactaccgatttttcgccaatcctgcagttcgaacaggaccctgtccaaattctcgatgcccttttgccgctttacttgaacagtcaaatcttgagagctctacaggaatctcttgccagtgagcttgccgctaggatgagtgctatgagcaatgccactgataatgctgacgagctgaagaagaatctgtcgagagtttacaacagacagcgtcaggcgaagatcaccggagagattttggagattgtcgccggagccaatgctttggtttagaccggagcttcgtttcctttgtgcgcttgtgttttgtggggctgtctctgtttttttcgtttcgattgtgcctgtcaagaaaatagtgatttcagcatagacacttatttaaatttgtgattctcgaatgcgtacaaaatttctcgaaaagatgaggagtcaccaccatatttattttgtaaacataagaacatcttttactcaccttcaatatatatatgtgattattatcctttgcttctgcaacggatacttgattttatctatcttacactgcgctaactgcagaatgataatgatttttttttcccagcatgcagcaattatctgtaccttataaacacttcaggcaaacactgaaacacagcagcttagta

SEQ ID NO: 1022 - DNA, 1438 bp, Antirrhinum majus
  misc_feature (143)..(143): n is a, c, g, or t
tttgcagacctcaaaaaggtgtaggacataaaaaccatgtcttgctccatatcacaatgtgggtgtcctcaaaaccttccctatccgacccttctcccctctcgtctcgatcgttcatcgctccgtttcacctcccgaattcnggttcctcaacaccttcaagatcatctacttccactcaaattcaatgcagtcttcgtgatcttcgtgatcgtatcgattctgtgaagaacacgcagaaaatcactgaggccatgaagcttgtggcagctgctaaggtgagaagagcacaagaagccgtggttaacgccagacccttctcggaaactctggttggagtcctttacaacatcaatgagcagctccaaaccgaagatgtcgacattcctttaactaaggttaggcctgtcaagaaagtggcactcgtcgttgtcacaggtgatcgtggtctctgcggtggattcaacaacgcaatcttgaaaaaagcggaggcccgaatcaaggaattgaaggcacttggccttgattacactgttgttagtgttggcaaaaagggtaacacgtattttacccgcaggccttatattcctctcgataagattttcgaaggcaccaatcttcccactgcgaaagaagcgcaggcgattgcggacgatgtcttttcgctgtttgtgagtgaggaagttgataaggtggagctcttatacacgaaattcgtgtctttggttaagtcagatcctgtgattcacaccttgcttccattgtcgcctaaaggagaaatttgtgatattaatggaacatgtgttgatgcagctgaagatgaatttttcaggttgactacaaaagaagggaaacttaccctggaaagagatagcgtgaggactgagacctcggacttttcgccaattttgcaattcgagcaggaccctgttcagattttggatgctttgcttccactttacttgaacagccaaatcttgaggtcgttgcaggagtcattggcgagtgagcttgccgcgaggatgagtgctatgagcaatgcttctgataatgcggtggaactgaagaagaatttgtcgagagtctacaacagacagcgtcaggcaaagattactggagagattttggagattgttgctggagccaatgctatggtttaattacaattgttgtttccgtgttccttgataaatgtgcttcactctagttatctctgggctctctctttttcccttttaatttctgttattattactgtttatgctgttaaagaacaattgcgattctcaatcgcgtacaaatttatgaggaccgccatttgtaatttgtaacagaaaggtattaaggtaccatactcacctttagtatatatatgtgaatttcaattttgtctgtactacttgtactgagagattgatatagcacgtttaagcatttt

SEQ ID NO: 1023 - DNA, 1579 bp, Malus domestica
atgtctgccccaaatgatcaccaacggtcaaaatccttatcccaaaacctgatccaaaagctccctctccctctccctccactcattcccccgctctttgccaccattcacctgaagtcgtacacacatgaagataaagacttcttcacaaaccaagcctcacattgcagaccctctttcttcttccctgttcctccatttcgagcttcgaaaactccgttacaacttggaaccaccatgtcttgctcgaatttgacaatgtgggcgtcctcaaaaccctccctttccgacgcctccgccctctcctgccgctccttcatcgcccctcttcagcttccctcccaaaactcccttcccgcctcgcgatcgtcatctgtgacaccggttcaatgcggtcttcgcgagcttcgcgagcgtatttcatcagtgaagaacacgcagaagatcaccgaggctatgaagcttgtggcagccgccaaagtccgccgcgctcaagaggctgtcgttaatggcagacccttttcggaaaccctagttgaagttctttacaacatcaatgagcagctccaagtggaagacattgatgctcctctgaccaaagttaggcccgtcaagaaagttgctctcgttgtcataactggggatcgcggtctttgcggagggttcaacaatatgatcataaaaaaagccgagagaagaatctcggaattgaaggctcttggtctcgaattcaccatcatcagcgtcggtaaaaagggtaactcgtatttcctccgccggccttacattccggttgataagtttctcgagggaaccaacctcccaaccgccaaagaagcgcaggccatcgcggacgatgttttctcccttttcgtgagcgaagaggtcgacaaagtcgagcttttgtacacgaaattcgtgtcgctggttaaatccgaccctgtgattcacaccctgcttccactctcgccaaaaggagagatttgcgacatcaatggcgtttgtgtggacgccgtggatgatgagttcttcaggctgacaacaaaggaagggaaattgacagtggagagagatgtcatcaagacgcagaccgtggatttcacaccggttttgcagtttgagcaggatccggttcagattctcgacgctttgctgcccttgtacctcaacagtcagattttgagggcattgcaggagtctctagccagtgagctcgctgctaggatgaccgctatgagcaatgcaaccgataacgctgtggagctgaagaaaaccttgtcgcagacctacaatcggcagcgccaggcaaaaatcaccggagagattttggagattgtttcgggtgccaacgctttagtctagacgattcaaagaacaacatggtacttgttttctcctccactttgagttgtgccaattgtcttaaatttgcagacttaacacttccattgtaattctcagctgccaataaactttgtgtgcacaaatgagaacaaaagagagcattccacatatatatatattgtatgtcatttttttccatcatagttaataatactgctaatcatgtaattaagga

SEQ ID NO: 1024 - DNA, 1287 bp, Utricularia gibba
ctggttcttgctctcttctccttcaccgatggctgcttccaatctgacaatgtgggtatcctccaagcctgaagcatcttccctgtcctcgcgctccttcctcgcccctcttcctcttcatatcactggcgccggcgtcgctgcatcgccttccaggtcgaccctaatccagtgtggcctccgtgagctccgtgatcggattgattccgttaaaaatacccagaaaattacagaggcgatgaagctcgtcgccgcggctaaggtccggagagcccaggaagcagtcgttaacgctaggccgttctcggaaacgctcgtcgaagttttgtataacataaatgagcagctgggtacagaggatatcgatgttccgttgacaaaagttcgccctgtcaaaaaggttgcgttggttgtcgtcaccggagatcgtggtctctgcggcggattcaataactcgattatcaagaaggcggaggcgcggatcagggatttgaaagctctcggcctggaatacaccgttatcagcgtcggcaaaaaggggaattcttatttcatccgtcgcccacatattccggtggatagatttctcgaaggaagcaaccttccaacggcgaaggaggctcaagcgatcgccgacgacgtgttttcccttttcgtgagtgaagaagtggataaagttgagcttctctacaccaaattcgtgtctttagtgaaatccgatccagttatccacaccttactaccgttatcgcccagaggagaaatctgcgacataaacggcatctgcgtcgacgcggcggaggacgagtttttccgattaactacaagagaagggaagctgacagtagaaagagacgtgatgcgcacaaagacagccgacttttcaccaatcttgcaatttgagcaggaccctgttcagatcctggatgctttgctaccactttacctcaacagtcagattctgagatctttgcaagagtctcttgcgagcgaacttgcagcgaggatgagtgctatgagtaatgctactgataatgcagttgagctgaggaagaacttgtccagggtttataacagggcaagacaagctaagatcacaggtgagattctggagatcgttgcaggagctaatgctttgacatgaggtgagaagaacccacaatctgtgtaagctctattctggttgtaacgtttctgcaactgtttttttctgctttcatatggacgttggaacatgtcttgttcaaatatacacatatttgtagttaacaagatgagcagttcaag

SEQ ID NO: 1025 - DNA, 1333 bp, Helianthus annuus
acatacagaaaaagatagattttcttcagaaacaaaacactctccacccacacacacatcacctcctccattgttgaacaaccatgtcttgctccaatctaacaatgtgggtgtcttcttcaaaaccctcacttgattcatcatcacccctttctttcagatcattcatcaccccatctccaattcccacttcaaactccaactatgggacttcttcaaaatcttcttcttcttcttcttcaatccagtgtagcctccgggatcttcgaacccgtatcgattcagttaagaacacacagaagatcacagaagcaatgaagcttgtggcagctgcaaaagtcagaagagctcaagaagctgttgtcaatgcaaggcccttttccgaaactttggttgaagttctttacagcatcaatgagcagcttcaaacagaagatgttgatgtcccgttgaccaatattcgaccggtgaagaaggtggcgcttgtggtggtcaccggagaccgtggactctgcggtgggtttaataactttatcttgaaaaaagccgaagcaagaatcaaggaactcaagactcttggtcttgattatgttgtcatcagtgtgggtaaaaagggtaattcgtatttcgtccggcgaccgtacattccggtggataagtttcttgacggaagtaatcttccgactgcgaaagaagctcaggcgattgcagacgacgtgttttcgctgtttgtaagtgaagaagtggataaagtggaacttttgtacacaaagtttgtgtctttagtgaaatctgatcctgtgattcatactttacttccattgtcaccaaaaggggagatttgtgacatcaatggagtctgtgttgatgctgctgaagacgagttctttaggttgactactaaagaggggaagttgaccgtggaacgagatgtggttagggccgatacaatggacttttcaccgatcttgcagttcgaacaagacccggttcagattcttgatgctttgttgccgttgtatctgaacagtcagatattgagggctttgcaggagtcattggcaagtgagcttgctgcaagaatgactgcaatggggaatgcaacggataacgcttcagagttgaagaagaacttgtctcgggtttacaatcgacagcgccaggccaagattaccggagagattttggaaattgttgctggtgctgatgcgttagcttgatcatcgtgggtatagctcctgcaactgattgattaatcgaatgtgtttttcgtgttgaataataatatgtatttttaacaggaaaaacaggtggaggatgtcatatttttttg

SEQ ID NO: 1026 - DNA, 1327 bp, Helianthus annuus
aaaaaaaaaacatgtcttgctcaaatttaacaatgttggtgtcatcaaaaccatcacttgattcatcatcaccactttcttttagatcattcattgcaccagttcaaattcccagttcaaatgccaacaattcgatatcgaaaccgtcttcttcttcgatccattgcagcctccgtgatcttcgaacccgtatcgattcggttaagaacacacagaagatcactgaagctatgaagcttgtggcagctgctaaagttagaagagctcaagaagctgtggtgaatgcaagaccattttcggagactttggttgaagtgctttatagcatcaatgaacaacttcaaacagaagatgttgatgtcccgttgacgaatgttcgacccgtcaagaaggtggcgttggtggtggtcaccggagaccgtggtctctgcggcggtttcaacaacttcatcttgaaaaaagccgaagcaagaatccgggagctcaagacgcttggtcttgattatgttgtgatcagtgtaggcaaaaagggtaattcttacttccttcggcgaccccaaattccagtggacaagtttctcgacggaagcaatctcccaaccgcgaaagaagctcaggcgatcgcagacgatgtgttttcgctatttgtaagcgaagaagtcgacaaagttgaacttttgtacacaaagtttgtgtcattagtgaaatctgatcctgtgattcatacactacttccattatcacccaaaggagaaatttgtgacataaatggaatatgtgttgatgctgctgaagatgagttctttaggctgaccacaaaagagggaaagttgaccgtcgaacgagacgttattagggccgaaacaatggacttttcgccaatcttgcaattcgaacaggacccggttcagattcttgatgcattgttgccattgtatttgaacagtcaaatcttgagggctttgcaggagtcgttagcaagcgagcttgccgcaagaatgactgctatggggaatgcgacagataacgcgtccgagttgaagaagaacttgtcgcgggtttacaatcgccagcgccaagccaagattacaggcgagattttggagatcgttgcgggtgctgatgcattggcttgatcatcatgggaaaagttgtggaggatgtcaatttttttgtggaattattttgtaatctgtaatgctaatacttcctccaaacaaatgaaatttgtgtatttgaatatatatgaataagttttcatactcaagttcaagacaggtccatataaaatatagataaatcaaacaaatgtacataaaacaatcct

SEQ ID NO: 1027 - DNA, 1484 bp, Helianthus annuus
tccatattccaaactcttaatttcttcacacataccatccaaccatacaacaaaaagataagatttttatcaacaaacaaaaactcttcacacacccttcattgttgaattcttgaacaaccataattaaacaaaacaaaacaaaaaaaaaacatgtcttgctcaaatttaacaatgttggtgtcatcaaaaccatcacttgattcatcatcaccactttcttttagatcattcattgcaccagttcaaattcccagttcaaatgccaacaattcgatatcgaaaccgtcttcttcttcgatccattgcagcctccgtgatcttcgaacccgtatcgattcggttaagaacacacagaagatcactgaagctatgaagcttgtggcagctgctaaagttagaagagctcaagaagctgtggtgaatgcaagaccattttcggagactttggttgaagtgctttatagcatcaatgaacaacttcaaacggaagatgttgatgtccccttgaccaatgttcgacccgtcaagaaggtggcgttggtggtggtcaccggagaccgtggtctctgcggcggtttcaacaacttcatcttgaaaaaagccgaagcaagaatccgggagctcaagacgcttggtcttgattatgttgtgatcagtgtaggcaaaaagggtaattcgtacttccttcggcgaccccaaattccggtggacaagtttctcgacggaagcaatctcccaaccgcgaaagaagctcaggcgatcgcagacgatgtgttttcgctatttgtaagcgaagaagtcgacaaagttgaacttttgtacacaaagtttgtgtcattagtgaaatctgatcctgtgattcatacactacttccattatcacccaaaggagaaatttgtgacataaatggaatatgtgttgatgctgctgaagatgagttctttcggctgaccacaaaagagggaaaattgaccgtcgaacgagacgttattagggccgaaacaatggacttttcgccaatcttgcaattcgaacaggacccggttcagattcttgatgcattgttgccattatatttgaacagtcaaatcttgagggctttgcaggagtcgttagcaagcgagcttgccgcaagaatgactgctatggggaatgcgacagataacgcgtccgagttgaagaagaacttgtcgcgggtttacaatcgccagcgccaagccaagattacaggcgagattttggagatcgttgcgggtgctgatgcattggcttgatcatcatggttggtatagtttttgattaatgaagtcatgtgtgtttaatgtgttgaattggatcataatatgtgtttttgtttacagggaaaagttgtggaggatgtcaattttttgtgtggaattaattgtattctgtaatgctaatacttcctccaaacaaatgaaatttgtgtatttgaatatatatgaataagttttcatgg

SEQ ID NO: 1028 - DNA, 1329 bp, Cynara scolymus
  misc_feature (77)..(77): n is a, c, g, or t
  misc_feature (83)..(84): n is a, c, g, or t
  misc_feature (139)..(139): n is a, c, g, or t
  misc_feature (163)..(163): n is a, c, g, or t
  misc_feature (411)..(411): n is a, c, g, or t
  misc_feature (430)..(430): n is a, c, g, or t
  misc_feature (529)..(529): n is a, c, g, or t
  misc_feature (1189)..(1189): n is a, c, g, or t
  misc_feature (1281)..(1281): n is a, c, g, or t
acttgactaaactctcccttcacctccattgttgaactccactgttaagttcctcagaaccctaatcatcatcatgncttgcnncaatctaacaacaatgtgggtgtcttcaaaaccctccactctcgattcatcatcnctttctttccgatcatctttcatnaacccacttcaaatcccatcttcgaatccctcgaattcttcgaaatcttcatcgtcttcaatccattgcagtctccgggagcttcgcaaccgtatagattccgtcaccaacaccaagaagatcacggaagcaatgaagcttgtcgccgccgcaaaggtccggcgagctcaagaagccgtggtgaatgcaagacccttctcggaaaccctagttgaagttctttacagcatcaatgaacaacttcaaanggaagacgtcgacgtcccnctcaccagtgtccggccggtgaagaaggtggcgctggtggtgatcaccggcgaccgtggtctctgcggtgggttcaacaatgcgatcttgaagaaagcngaagcaaggattcgagaacttaaaactcttggacttgagttcaccgtcattagcgtcggcaaaaagggtaacacttatttcctccggcgaccctacattccgttggataagtctctcgacggcagcaacttaccgacggcgaaagaagctcaggccatcgccgacgatgtgttttcactctttgtgagtgaagaagtcgataaagtcgaacttctgtacacaaagtttgtatctttagtgaaatccgatcccgtgattcatactttgctgccattatcgccgaaaggagagatctgtgacatcaacggaatctgcgttgatgcggcggaggatgagtttttccggctgaccaccaaagaaggaaaactgaccgtcgaacgcgacgttgtacgcaccgaaacgatggatttttcacctattttgcaattcgagcaagacccagttcagattcttgatgctttgcttccgttgtatttaaacagtcagattttgagggcattgcaggaatcgttggcgagtgagctagcggcgaggatgacggcgatggggaacgcgacggataacgcggtggagttgaagaagaatttgtctagggtgtataaccggcagcgtcaggcgaagattaccggcgagatattggagattgtcgccggagctgangcgttagtttgatcggaatcggtatagttcttgatcctatgtttatctgtgttgttattcgacgatcatacatacatatatatgcataggantatatctccatttttttggaataattgcatgtatgataatactgcttc

SEQ ID NO: 1029 - DNA, 1431 bp, Helianthus annuus
gatttttatcaacaaacaaaaactcttcacacacccttcattgttgaattcttgaacaaccataattaaacaaaacaaaacaaaaaaaaaacatgtcttgctcaaatttaacaatgttggtgtcatcaaaaccatcacttgattcatcatcaccactttcttttagatcattcattgcaccagttcaaattcccagttcaaatgccaacaattcgatatcgaaaccgtcttcttcttcgatccattgcagcctccgtgatcttcgaacccgtatcgattcggttaagaacacacagaagatcactgaagctatgaagcttgtggcagctgctaaagttagaagagctcaagaagctgtggtgaatgcaagaccattttcggagactttggttgaagtgctttatagcatcaatgaacaacttcaaacggaagatgttgatgtccccttgaccaatgttcgacccgtcaagaaggtggcgttggtggtggtcaccggagaccgtggtctctgtggcggtttcaacaacttcatcttgaaaaaagccgaagcaagaatccgggagctcaagacgctaggtcttgattatgttgtgatcagtgtaggcaaaaagggtaattcttacttccttcggcgaccccaaattccagtggacaagtttctcgacggaagcaatctcccaaccgcgaaagaagctcaggcgatcgcagacgatgtgttttcgctatttgtaagcgaagaagtcgacaaagttgaacttttgtacacaaagtttgtgtcattagtgaaatccgatcctgtgattcatacactacttccattatcacccaaaggagaaatttgtgacataaatggaatatgtgttgatgctgctgaagatgagttctttaggctgaccacaaaagagggaaagttgaccgtcgaacgagacgttattagggccgaaacaatggacttttcgccaatcttgcaattcgaacaggacccggtccagattcttgatgcattgttgccattatatttgaacagtcaaatcttgagggctttgcaggagtcgttagcaagcgagcttgcggcaagaatgactgctatggggaatgcgacagataacgcgtccgagttgaagaagaacttgtcgcgggtttacaatcgccagcgccaagccaagattacaggcgagattttggagatcgttgcgggtgctgatgcattggcttgatcatcatgggaaaagttgtggaggatgtcaatttttttgtggaattattttgtaatctgtaatgctaatacttcctccaaacaaatgaaatttgtgtatttgaatatatatgaataagttttcatggtaaaatcaactcaaggaaccatcatcggaccccttctagtcatcattagtgctctcactttggcaatatggttcattatccaagcaa

SEQ ID NO: 1030 - DNA, 1444 bp, Tragopogon dubius
aaaaataaaatcaaccatacaagcaaaaagataagatctttatcaagaaacaaaaactcttcacgcacccctaacctccattgttgaattcttgaagaaccctaatcggaaatcatgtcttcctcgaacttaacaatgtgggtgtcttcaaaaccatctcttgattcatcatctctttctttcagatctttcatcagtccagttcaaatccccagtacgaacccatcaaattcgaattcaaattcaagaccttcttcttcaatcaattgcagcctccgggagcttcgtgggcgtatagattcagtgacgaacaccaagaagatcactgaagcaatgaagctcgtggcagctgcgaaagtgagaagagctcaagaagctgtcgtgaatgcaagacccttctcggaaactttggttgaagtactttacagcatcaatgaacagctccaaaatgaagatgttgatgtcccacttacgagtgtccgaccggtgaagaaggtggcgcttgtggtggtcaccggagaccgtggtctctgtggtggtttcaacaacgcaatcttgaaaaaagcagaatcaagaatccgagaactcaagactcttggacttgagttcgttgtcatcagtgtaggcaaaaaaggtaactcttatttcctccggcgaccatacattccggtggataagtttgttgacggcagcaacctccccactgcaaaagaagctcaggcgatcgcagatgatgtgttttcactttttgtaagtgaagaagttgataaagtcgaactcttgtacacaaagtttgtctctttagtgaaatccaaccctgtgattcatactttactgccattatcgcccaaaggagagatctgtgacatcaatggaatctgtgtggatgcagcagaagacgagttcttcaggctgacgaccaaagagggaaagttaacagtcgagagagacgtagtgaggaccgtaaccgccgatttttcaccgatcttgcaattcgaacaggacccggttcagattcttgacgctttgctgccattatacttaaacagccagatcttgagggctttgcaggagtctttagccagtgagcttgctgctcggatgactgccatggggaatgctactgataatgctatcgagttgaagaagaacttgtctcgagtttacaatcgacgtcgtcaggccaagattacaggagagattttggagattgttgctggtgctgatgcattagtttgatcaagtttctgaatcggaaaaagttgcgaaaggatatcgaattttttttcggaattatgtaatgctaatactccctctaagcaaatgaaatttgtgtatttgaatatatatgtatatgaataagtttatatcatctcctgtatcgagcttgtgattcggccatggcgggtttctcatacacttttagatttagttgtatttatac

SEQ ID NO: 1031 - DNA, 1401 bp, Helianthus annuus
cttaaaatctcatcatccaccatacaagaaaaagataagatttccttcaagaaacaaaacactctccacccacacacacatccattgtcgaacaaccaaccaaccatgtcttgctccattctaacaatgtgggtgtcttcttcaaaaccctcacttgattcatcatcacccctttctttcagatcattcatcaccccatctccatttcccacttcaaactccaactatgggacttcttcaaaatcttcttcttcttcttcttcaatccagtgtagcctccgggatcttcgaacccgtatcgattcagttaagaacacacagaagatcacagaagcaatgaagcttgtggcagctgcaaaagtcagaagagctcaagaagctgttgtcaatgcaaggcccttttccgaaactttggttgaagttctttacagcatcaatgagcagcttcaaacagaagatgttgatgtccccttgaccaatattcgaccggtgaagaaggtggcgcttgtggtggtcaccggagaccgtggtctctgcggtgggttcaataactttatcttgaaaaaagccgaagcaagaatcaaggaactcaagactcttggtcttgattatgttgtcatcagtgtgggtaaaaagggtaattcgtatttcctccggcgaccgtacattccggtggataagtttcttgacggaagcaatcttccgactgcgaaagaagctcaggcgattgcagacgacgtgttttcgctgtttgtaagtgaagaagtggataaagtggaacttctgtacacaaagtttgtgtctttagtgaaatctgatcctgtgattcatactttacttccattgtcaccaaaaggggagatttgtgacatcaatggagtctgtgttgatgctgctgaagacgagttctttaggttgactactaaagaggggaagttgaccgtggaacgagatgtggttagggccgatacaatggacttttcaccgatcttgcagttcgaacaagacccggttcagattcttgatgctttgttgccgttgtatctgaacagtcagatattgagggctttgcaggagtcattggcaagtgagcttgctgcaagaatgactgcaatggggaacgcaacggataacgcttcagagttgaagaagaacttgtctcgggtttacaatcgacagcgccaggccaagattacaggagagattttggaaattgttgctggtgctgatgcgttagcttgatcatcatgggtatagctcctgcaactgattgattattaatcgaatgtgtttttcgtgttgaataataatatgtatttttaacaggaaaaacaggtggaggatgtcatatttttttggaattagttgttccctccaaataaatcgaattggtgtacttga

SEQ ID NO: 1032 - DNA, 2664 bp, Malus domestica
tcccgttgaactgcagcaacagcaattctagtcctttcagttttctttcagcaaatcagcctcagctacatttaagccttttttcataatcctcaacaaggaagccatgttgatggttttgacaaatcactgaagtcacccaactcaacatctcgtgccattgatttccatccactgatgcaaagaactgattatgtaagtagtgccaaagtaacaacatgctcaactgcacccctttctgctggttcagggggaaaccgttctcaagaccaatatccttgtgatactggttcaactcagttgtcggtcaatgctgatccacaggctatgggcactaatgagagagctaatgaactggacttggagatccacctaagttctacatctaaaaaggaaaaagcttcaaaaaggagagatgtcactgttaataattcagttaaatcaagaataatggctccagaaaagacaactcaatgtcctaatggttcattgcttcggcaggctgaaagttcttcagctcgtggtagcgagcttgttgtaccaagtaataatattagcaggtacaaagtagatgatacaggtgaccagtcccaacctgatattcagatggaacaggaagagttgagcgactctgatgaagaaaatgaagaaaatgttgagtttgagtgtgaggagatgactgattctgaaggagaggggggatcggcgtgtgaagaaatatttgagatgcagaataaggatgttccatcgtttgcaatgaaaagacctgcaacagcagatcttgatggcaaggagtatcaccctttgcgcattatgtccaagtatgacgaaagtacaatggacagcagttttgctgccaaagacttgcagtcatcttggcctgctcggtcttgtaagaaggcaaaactgagcacaaggggaggtgcaacgcagaaacaagcggtggacatgacgcaccaactgagcctgggtcctccatcaaatccgacggtgagcaaacccaggaagcgtgtatcgggatcgaacactcgtatcattgggttgattgatattttgtctcttatagtgatgacattgcggcggtttttcaagaagtcctacacccaggaagataagacttcttcacaaaccaagcctcacatttcagaacctctttcttcttccctgttcctccatttccgagctccaaaaactccgttagaacctagaaccaccatgtcttgctcaaatttgacaatgtgggcgtcctcaacgccctcactttctgacacctccgccctctcctgccgctccttcatcgcccctcttcagcttccttcccaaaactctctccccgcctcgcgatcatcctccgtgacaccggttcaatgcggtcttcgcgagcttcgtgagcgtatttcatcagtgaagaacacgcagaagatcactgaggctatgaagcttgtggcagccgccaaagtccgccgagctcaagaggctgtcgttaatggcagacccttttcggaaaccctagtcgaagttctttacaacatcaatgagcagctccaagtggaagatattgatgctcctctgaccaaagttaggcctgtcaagaaagttgctctcgttgtcataaccggggatcgcggtctttgcggaggtttcaacaatatgatcatcaaaaaagccgagagaagaattgccgaattgaaggctcttggtctcgaattcacgatcatcagtgtcggtaaaaagggtaactcgtatttcctccgccggccatacattccggttgataagttcctcgagggaaccaacctcccaactgccaaagaagcacaggccatcgcggacgatgttttctcccttttcgtaagtgaagaggtcgacaaagtcgagcttttgtacacgaaatttgtgtcgttggttaaatccgaccctgtgattcacaccctgcttccactctcgccgaaaggagagatttgtgacatcaatggcgtttgtgtggacgccgcggatgatgagttcttcaggctgacaacaaaagaagggaaattgacagtggagagagatatcatcaagacacagaccgtggatttcacgccggttttgcagtttgagcaggatccggttcagattctcgacgctttgctgccgttatacctcaacagtcagcttttgagggcattgcaggagtctctagccagtgagcttgctgctaggatgactgctatgagcaatgcaactgataacgcggtggagttgaagaagaccttgtcgcagacctacaaccggcagcgccaggcaaaaatcactggagagattttggagattgtttcgggtgccaacgctttagtctagacgattaaaagaacaacatgggactcgttttctcctccacattgagttgggctgttttctcctgcacattgacttgcgctgttataaatttgcagattcgacacttccgttgtaattctcagctgcatataaactttgtgtgcacaaatgagagggcaatttattttggaacaaaagagagcattccacacatatctatatattgtatgtcatttttcctccatcatagttaataacactgctaatcatgtaattaaggatctgaattctcgttattcatatttcgtcgagtgttcttgtattatatatttgtgatttgctagc

SEQ ID NO: 1033 - DNA, 1434 bp, Cichorium intybus
aggccggggttgattctcgagaaaccctaatcggtaatcatgtcttgctcgaatttaacaatgtgggtatcttcaaaaccatcgatcgattcatcacctctctccttcagatccttcatcagtccaaatcaaatccctaactccaatccgtcgaattccaattccagaccttcttcttcgatcaattgcagtttgaaggagcttcgtggtcgtatagattcagtgaagaacacccagaaaatcactgaagcaatgaagcttgttgcagctgcaaaagtgcgaagagctcaagaagctgtcgtgaatgcaagacctttctctgaaacattagttgaagttctttacagcatcaacgaacagctccaatcagaagacgttgacgtcccacttaccagtgtccgaccggtgaagaaggtcgccctcgtggtggtcaccggagaccgtggtctctgtggtggtttcaacaacgcaatcttgaagaaagccgagtcaagaatccgggaactcaaaactctcggacttgaatacacaatcatcagtgtaggcaaaaagggtaacacttatttcctccgacgaccattgattccggtggataagtatctcgacggcagcaacctccccaccgcaaaagaagctcaggcgattgctgatgacgtgttttcacttttcgtaagcgaggaagtcgataaagttgaacttttgtacacaaaattcgtctctttggtcaaatccgaccccgtgattcatactttacttccattatcgcccaaaggagagatctgcgacatcaatggagtctgtgtcgatgcagctgaagacgagtttttccgattgaccacaaaagaaggaaaattgaccgttgaacgagacgtcgtgaggacggaaaccatcgatttttcaccgatcttgcaatttgaacaggacccggttcagattcttgatgctttgctgccattgtatttgaacagtcagatcttgagggctttacaggagtctttagctagcgagcttgctgctagaatgactgccatggggaacgcgactgataatgctgtggagttgaagaagaacttgtctcagatttacaatcggcaacgtcaggccaagattaccggagagattttggagattgttgctggtgctgatgcgttagtttgattgtgattctaaatcggtatagttcttgatcttataatgtttatgtgtttttcgtattgaatttgatgatatatatatgtggttgttacagggaaagttgcgaaaggataatgattttttttttttcggaattaattgcgaaatgtaatgatgatactccctctaaacaaatgaaatttgtgtatttgaatatatatgtatatgaataagtttatcgtctcatcaatcgagcttgtacgataatgaataagtttatcatctcatgaatcgagcttg

SEQ ID NO: 1034 - DNA, 1420 bp, Flaveria ramosissima
atctccatccactcaaaaacctcatccacattccaaaatctaatttcacacgtaccatccaccatacaggaaaagataagatttttatcaagaaaccataacctctcttcacacacccttcacctccattgttgaatcttgaagaaccctgaactaaaaatcatgtcttgctccaatctaacaatgtgggtgtcttcaaaaccatctcttgattcatcatcacccctctctttcagatctttcatcacccctgttcaaatccccacttcaaacccatcaaactccaactatctcatctccaaatcatccacttcaatctactgcaacctccgtgagcttcgcactcgtatcgattcagtgaagaacacacagaagatcactgaggcaatgaagcttgttgcagctgcaaaagtcagaagagctcaagaagctgttgtgaacgcaagacccttttctgaaaccttagtcgaagtgctttacagcatcaatgaacagcttcaaacagaagatgttgatgtccctttgaccaatgttcgtccggtgaagaaggtggcgcttgtggtggtcaccggagaccgtggtctctgcggtggtttcaacaacttcatcttgaagaaagctgaagcaagaattaaagagctcaagactttgggtcttgattatgttgtgatcagtgtgggcaaaaagggtaattcatacttccaacggcgaccgtacattccggtggataagtttcttgacggaagcaatcttccaactgcaaaagaagctcaggcgattgcagatgatgtgttctcactgtttgtaagtgaagaagttgataaagtggagcttttgtacacaaagtttgtgtctttagtgaaatctgaccctgtgattcataccttacttccattgtcacctaaaggagagatttgtgatattaatggagtgtgtgttgatgctgctgaagatgagttcttcaggctgacaactaaagaggggaaattgacagttgaaagggatgttgttcgggccgaaacgatggatttttcaccaatcttgcagtttgaacaggaccctgttcagattcttgatgctttgttgccattgtatttgaacagtcagatcttgaggtctttacaggagtcattagcaagtgagcttgctgcaagaatgactgccatggggaatgcaaccgataacgcttcggagttgaagaagagcttgtctcgggtttacaatcgacagcgtcaagccaagattactggagagattttggagattgttgctggtgctgatgcattagcttgatcatctatcttcatcatgtttggcgaaattgtggaggatgttgtaattttttctaggtattaattgtaatctgtaatgctaatactcctccaaacattgaatttgtgtatttagaatatatcatata

SEQ ID NO: 1035 - DNA, 1375 bp, Ambrosia trifida
gggttactactacataccatcatcatagacaaaagaataagatattatcacagaccttactcatgttgatacttgagacaagaaccatataataacataatataataataatataatcatgtcttgctcaatttaacaatgttggtgtcatcaaaaccatcactcgactcatcctcaccactttctttctagatcattcattgcaccagttcaaattcccagctctaacccatcaaatgccaaccattcgatatcgaaaccgtcttcttcgatccattgcagcctccgtgatcttcgaacccgtatagattcggttaagaacacgcaaaagatcactgaggcaatgaagcttgtggctgctgcaaaagttagaagagctcaagaagctgttgtgaatgcaagaccattttctgaaactttggttgaagtactttatagcatcaatgaacaacttcaaaccgaagatgttgatgtcccgttgacgaatgttcgacccgtgaaaaaggtggcgttggtggtggtcacaggagaccgtggtctatgcggtggtttcaacaactttatcttgaaaaaagccgaagcaagaatccgagaactcaagactcttggtcttgattatgttgtgatcagtgtgggcaaaaagggtaattcgtatttcctccggagaccgtacattccggttgacaagtttctcgatggaagcaatctcccaactgcgaaagaagctcaggcgatagcagacgatgtgttttcgctgtttgtaagtgaagaagtggataaagtagaacttttgtacacaaagtttgtgtctttagttaaatctgatcctgtgattcatacattgcttccattatcacccaaaggtgagatttgtgatatcaatggaatctgtgttgatgctgctgaagatgagttctttaggctgactactaaagagggaaagttgactgtcgaacgagatgttgttagggccgaaaccatggatttttcgccaatcttgcaatttgaacaagacccagttcagattcttgatgcattgttgccattgtatttgaacagtcagatattgagggcgttgcaggagtcattagcaagtgagcttgctgcaagaatgactgctatggggaatgcgacagataatgcgtccgagctgaagaagaacttgtcgcgggtttacaatcgccagcgccaagccaagattacaggagagattttggagattgttgctggtgctgatgcattggcttgatcataaagtttgggaaaagttgtggaggatgtcaatttttttggaattaatttgtaatctgtaatgataagttttacctccaaacaaatgaaatttgtgtatttgaatatatatgaataagtttta

SEQ ID NO: 1036 - DNA, 1350 bp, Helianthus annuus
atacaacaaaaagataagatttttatcaagaaaccaaacctcttcacacacccttgattgttgaaatcttgaacaaccataatcaaacaaaacaaaaaacatggcttgctcaaatttaacaatgttggtgtcatcaaaaccatcacttgattcctcatcaccactttcttttagatcattcattgcaccagttcaaattcccagttcaaatgccaacaattcgataccgttactgtcttcgtcttcgatccattgcagcctccgtgatcttcgaacccgtatcgattcggttaagaacacacagaagatcactgaagctatgaagcttgtggcagctgctaaagttagaagagctcaagaagctgttgtgaatgcaagaccattttctgaaaccttggttgaagtgctttatagcatcaatgaacaacttcaaacagaagatgttgatgtccccttgaccaatgttcgacccgtcaagaaggtggccttggtggtggtcaccggagaccgtggtctctgcggcggtttcaacaacttcatcttgaaaaaagccgaagcaagaatccgggagctcaagacgcttggtcttgattatgttgtgatcagtgtaggcaaaaagggtaattcgtacttccttcggcgaccccaaattccagtggacaagtttctcgacggaagcaatctcccaaccgcgaaagaagctcaggcgatcgcagacgatgtgttttcgctatttgtaagcgaagaagtcgacaaagtcgaacttttgtacacaaagtttgtgtcattagtgaaatctgatcctgtgattcatacactacttccattatcacccaaaggagaaatttgtgacataaatggaatatgtgttgatgctgctgaagatgagttctttaggctgaccacaaaagagggaaagttgaccgtcgaacgagacgttattagggctgacacaatggacttttcgccaatcttgcaattcgaacaggacccggttcagattcttgatgcattgttgccattatatttgaacagtcaaatcttgagggctttacaggagtcgttagcaagcgagcttgccgcaagaatgactgctatggggaatgcgacggataacgcgtccgagttgaagaagaacttgtcgcgggtttacaatcgccagcgccaagccaagattacaggcgagattttggagatcgttgcgggtgctgatgcattggcttgatcatcatgggaaaagttgtggaggatgtcaattttttgtgtggaattaattgtattctgtaatgctaatacttcctccaaacaaatgaaatttgtgtatttgaatatatatgaataagttttcat

SEQ ID NO: 1037 - DNA, 1339 bp, Ambrosia trifida
ctcttcacacaccctttacctcattgttgaattcttgaacaacaaaccatactaacaaccataataatattaataataatcatgtcttgttcaaacttaacaatgttggtgtcatcaaaaccatcacttaaagactcatcctcaccactttcttttagatcattcattgcaccagttcaaattcccagctcaaatgcctgcaacaattcgatatcatcgaaaccgtcttcttcgatccattgcagcctccgtgatcttcgaacccgtatagattcggttaagaacacgcaaaagatcactgaggcaatgaagcttgttgctgctgcaaaagttagaagagctcaagaagctgttgtgaatgcaagaccattttctgaaactttggttgaagtactttatagcatcaatgaacaacttcaaaccgaagatgttgatgtcccgttgactaatgttcgacccgttaagaaggtagcgctggtagtggtcacaggagaccgtggtctatgtggtggtttcaacaactttatcttgaaaaaagccgaagcaagaattcgagaactcaagactcttggtcttgattatgttgtgatcagtgtgggcaaaaagggtaattcgtatttccttcggagaccgtacattccggttgacaagtttctcgatggaagcaatctcccaactgcgaaagaagctcaggcgatagcagacgatgtgttttcgctgtttgtaagtgaagaagtggataaagttgaacttttgtacacaaagtttgtgtctttagttaaatctgatcctgtgattcatacattgcttccattatcacccaaaggtgagatttgtgatatcaatggaatctgtgttgatgctgctgaagatgagttctttaggctgactactaaagagggaaagttgactgtcgaacgagatgttgttagggcggaaaccatggatttttcgccaatcttgcaatttgaacaagacccagttcagattcttgatgcattgttgccattgtatttgaacagtcagatcttgagggctttgcaggagtcattagcaagtgagcttgctgcaagaatgactgctatggggaatgcgacagataatgcgtccgagttgaagaagaacttgtcgcgggtttacaatcgccagcgccaagccaagattacaggagagattttggagattgttgctggtgctgatgcattggcttgatcataaagtttgggaaaagttgtggaggatgtcaattttttttggaattaatttgtaatctgtaaggctaatactccctccaaacaaatgaaatttgtgtatttgaatatatatgaataagttttac

SEQ ID NO: 1038 - DNA, 1426 bp, Ambrosia trifida
tttttatcaacaaacaaacactcttcacacaccctttacctcattgttgaattcttgaacaacaaaccatactaacaacaacaacaataataataatcatgtcttgttcaaacttaacaatgttggtgtcatcaaaaccatcacttaaagactcatcatcaccactttcttttagatcattcattgcaccagttcaaattcccagctcaaatgccaacaataattcgatatcgaaaccgtcttcttcgatccattgcagcctccgtgatcttcgaacccgtatagattcggttaagaacacacaaaagatcactgaggcaatgaagcttgtggctgctgcaaaagttagaagagctcaagaagctgttgtcaatgcaagaccattttctgaaactttggttgaagtactttatagcatcaatgaacaacttcaaaccgaagatgttgatgtcccgttgacgaatgttcgacccgtgaaaaaggtggcgttggtggtggtcacaggagaccgtggtctatgcggtggtttcaacaactttatcttgaaaaaagccgaagcaagaatccgagaactcaagactcttggtcttgattatgttgtgatcagtgtgggcaaaaagggtaattcgtatttcctccggagaccatacattccggttgacaagtttctcgatggaagcaatctcccaactgcgaaagaagcgcaggcgatagcagacgatgtgttttcgctgtttgtaagtgaagaagtggataaagtagaacttttgtacacaaagtttgtgtctttagtcaaatctgatcctgtgattcatacattgcttccattatcacccaaaggtgagatttgtgatatcaatggtatatgtgttgatgctgctgaagatgagttctttaggctgactactaaagagggaaagttgactgtcgaacgagatgttgttagggccgaaaccatggatttttcgccaatcttgcagtttgaacaggacccagttcagattcttgatgcattgttgccgttgtatttgaacagtcagatcttgagggctttgcaggagtcattagcaagtgagcttgctgcaagaatgactgctatggggaatgcgacagataacgcgtccgagctgaagaagaacttgtcgcgggtttacaatcgccagcgccaagccaagattacaggagagattttggagattgttgctggtgctgatgcattggcttgatcataaagtttgggaaaagttgtggaggatgtcaatttttttggaattaatttgtaatctgtaatgataagttttacctccaaacaaatgaaatttgtgtatttgaatatatatgaataagttttacctcttgtggttgacccattgagctaggttaagatttatagtaatagtacattttcatggtgaaaaaagaaaag

SEQ ID NO: 1039 - DNA, 1447 bp, Ambrosia trifida
aagatgatcgtctcaaaaatctcatccaccatacatacattcaacaaaaagataagattttcttcttcttcttcaacaaacataaactcattcattacctgcctcctccattggcattggcattggcattatcattattgctgaacaacacagcaaccatgtcttcttgctccaatctaacaatgtggctctcttcaaaaccatctcttgattcatcatcacccctttctttcacatctttcatcaccccatctccatttcccacttcaatttccaaccatgggctttcaaaatcctcttcttctatccagtgcagcctccgggacctccgaacccgtatcgattctgtcaagaatacacagaagatcactgaagcaatgaagcttgtcgcagctgcaaaagttagaagagctcaagaagctgttgtcaacgcaaggccctttctgaaactttggttgaggttctttacagcatcaacgagcagcttcaaactgaagatgttgatgtccccttaaccaatgttcgccccgtgaagaaggtggcacttgtggtcgtcactggagatcgtggtctgtgcggtggtttcaataacttcatcttgaaaaaagccgaagcaagaatcagggaactcaagactcttggtcttgattacgttgtgatcagcgtgggcaaaaagggtaattcgtatttccttcggagacccaacattcctgtggataagtttcttgacggaagcaatcttccgactgcaaaagaagctcaggcgattgcagacgacgtgttttcactgtttgtaagtgaggaagtggataaggtggaacttctgtacacaaagtttgtgtctttagtaaaatctgaccctgtgattcatactttacttccattgtcacctaaaggggagatttgtgacatcaatggagtctgtgttgatgctgctgaagacgagttctttaggttgaccactaaagaagggaagttgaccgtggaacgagatgtgattagggccgaaaccatggatttttcaccgatcttgcagttcgaacaagacccggttcagattcttgatgctttgttgccgctgtatctaaacagtcagatcttgagggctttacaggagtcgttagcaagtgagcttgctgccagaatgactgcaatggggaatgcaacggataacgcttcagagttgaagaagaacctgtctcgggtttacaatcgacagcgccaggccaagattacaggagagattttagaaattgttgctggtgctgatgcgttagcttgatcatcggtcggtatgctgcaactgattgacatatatgatggatgatatgtaagaagatgtttttttttcttggatcatgacccatttcacttgggtcttatctaacaaccaagtgagtgttgtttgttcatacggtttcatacataaatttagtttcaacttaaa

SEQ ID NO: 1040 - DNA, 1503 bp, Tropaeolum majus
cggccgggggtcctccactcattctccactcttttttcctccataaccaacatgaagataaggtcttcttacacagaaactaaaaaccaccatacagcaaaacatcttccccatctccccatttcccctttttgaacgatttccattatgtcttgttcgaatgtaacaatgtgtgtttccgacgcctctgcactctccttccgttcattcgtcgccccttttccgctttcttcaacaaatacagccacctcctgtaaccccaccagatccaattccgcaactccgattcaatgcggtctccgtgaactaaggggtcgtatcgattctgttaaaaacacccagaagattaccgaagccatgaagctcgtcgccgcagctaaagttagaagagcacaagaagctgtcgtcaatggcagacctttctccgaaaccctagtggaagttctttacaacatcaatgaacaactacaaaccgaggatgtcgaatcccctctcaccaacgttagacccgtgaaaaaagtcgctttggtcgtcgtcaccggtgatcgtggtctctgcggtggtttcaacaacaatattattaaaaaagcagaagcgagaatcaaggaattgaaaacacttgggttggagtatgttgttataagcgtagggaaaaagggtaattcctattttcttcgccggccttatattccggtggataaatttctcgagggaggtggtcttcctacagctaaagaagctcaagcgattgcagatgatgttttctcgcttttcgttagtgaagaagtcgataaagtcgagcttctgtacacaaagttcgtctctctagttaaatcagaccctgtaatccacacactgcttcctctttcaccaaaaggtgaaatctgtgatataaatggagtatgtgtcgatgctgcagaggatgagttcttcagattgacaacaaaaggagggaaactgaccgttgaaagagatgctgtgagaaccgcaacaccagaattctcaccaatcttgcaattcgagcaggacccagttcagattctcgatgctttgttgcctctttacctaaacagtcaggttttgagggcgttgcaggaatcattggcgagtgaactggctgctaggatgagtgctatgagtagtgccactgataatgctgtggagttgaagaagaacttgtctaggcaatacaataggcagaggcaagctaagattaccggggagatttttggagattgttgctggtgcagaggctttgacttgatttcgattttgattggattcagatcaatgggggaagaatggtggtgtttcttgttgttgatttcagataaccgtgtttggattgtagaggtaaaaacaaatctgggatcttgttaatttctatctctggtttataacaataatgcagattaaagatactattttttttgctgtgtaattcttccatacgtataatcttttgtgatcattgagaagtgaatatatatttatatattttgt

SEQ ID NO: 1041 - DNA, 1291 bp, Arnica chamissonis
gaattggtcaacaaccatatgttgatcatgtcttgctcaaattgtacaatgttggtctcttccaaaccatcacttgattcatcatcccccctttctttcagatctttcatcaccccacttcaaatccccagctcaaacccatcagcttccagctatgcaatctccaaatcatcttcatcgatccattgcagcctccgtgatcttcgcacccgtatcgattcagtcaagacacacagaagatcaccgaagcaatgaagcttgttgcagctgcaaaagttagaagagctcaagaagctgtcgtgaattcaagacctttttctgaaaccttagttgaggttctttacagcatcaatgaacagcttcaaacagaagacgttgacgtcccgttgaccagtgttcgaccggtgaagaaggtggcgctcgtggtggtcaccggagaccgtggtctttgcggcggttataataattttatcttgaaaaaagctgaagcaagaattagagagctcaagactcttggtcttgattatgttgtgatcagtgtgggcaaaaagggtaattcatatttcctccggcgaccgtacatcccggtggacaagttttttgatggaagcaatctcccgacagcgaaagaagctcaggcgattgcggatgatgtgttttcattgtttgtaagtgaagaggttgataaagtggaacttttgtacacaaagtttgtgtctttagtgaaatctaatcctgtgattcataccttacttccattatcacctaaaggagagatttgtgacatcaatggagtgtgtgttgatgctgctgaagatgagttctttaggctgaccactaaagaggggaagttgaccgtcgagcgcgaagcgattaggggcgaaaccgtggatttttcaccaatcttgcagttcgaacaagacccggttcagattcttgatgccttgttgccattgtatttgaacagtcagatattgagggctttacaggagtcattagcaagtaaacttgctgcaagaatgactgcaatggggaatgcgacagataacgcttcggagttgaagaagagcttgtctcaggtttacaatcgacagcgccaagccaagattaccggagaaattttggagattgttgctggtgctgatgcgttactttgatcatgtttggttcatgtgtgtttgacatgttgaattggatcataatatgtgttttttacagaattaattgtaatctgtaactcttccaaacattgaaatttgtgtatttgaatatatatatatgaataagcttt

SEQ ID NO: 1042 - DNA, 1254 bp, Flaveria ramosissima
aaccctgaactaaaaatcatgtcttgctccaatctaacaatgtgggtgtcttcaaaaccatctcttgattcatcatcacccctctctttcagatctttcatcacccctgttcaaatccccacttcaaacccatcaaactccaactatctcatctccaaatcatccacttcaatctactgcaacctccgtgagcttcgcactcgtatcgattcagtgaagaacacacagaagatcactgaggcaatgaagcttgttgcagctgcaaaagtcagaagagctcaagaagctgttgtgaacgcaagaccttttctgaaaccttagtcgaagtgctttacagcatcaatgaacagcttcaaacagaagatgttgatgtccctttgaccaatgttcgtccggtgaagaaggtggcgcttgtggtggtcaccggagaccgtggtctctgcggtggtttcaacaacttcatcttgaagaaagctgaagcaagaattaaagagctcaagactttgggtcttgattatgttgtgatcagtgtgggcaaaaagggtaattcatacttccaacggcgaccgtacattccggtggataagtttcttgacggaagcaatcttccaactgcaaaagaagctcaggcgattgcagatgatgtgttctcactgtttgtaagtgaagaagttgataaagtggagcttttgtacacaaagtttgtgtctttagtgaaatctgaccctgtgattcatactttacttccattgtcacctaaaggagagatttgtgatattaatggagtgtgtgttgatgctgctgaagatgagttcttcaggctgacaactaaagaggggaaattgacagttgaaagggatcttgttcgggccgaaacgatggatttttcaccaatcttgcagtttgaacaggaccctgttcagattcttgatgctttgttgccattgtatttgaacagtcagatcttgaggtctttacaggagtcattagcaagtgagcttgctgcaagaatgactgccatggggaatgcaaccgataacgcttcggagttgaagaagagcttgtctcgggtttacaatcgacagcgtcaagccaagattactggagagattttggagattgttgctggtgctgatgcattagcttgatcatctatcttcatcatgtttggtaattggtatagttcttgaatgtttaatcatatgtgtgtttaatgtgttgaatttgatcataatattgttgtttttactaggt

SEQ ID NO: 1043 - DNA, 1381 bp, Helianthus annuus
ggggtcttccacataccatccaaccatacaacaaaaagataagatttttatcaagaaaccaaacctcttcacacacccttcattgttgaattcttgaacaaccataattaaacaaaacaaaacaaaaaaaaacatgtcttgctcaaatttaacaatgttggtgtcatcaaaaccatcacttgattcctcatcaccactttcttttagatcattcattgcaccagttcaaattcccagttcaaatgccaacaattcgatatcgaaaccgtcttcttcttcgatccattgcagcctccgtgatcttcgaacccgtatcgattcggttaagaacacacagaagatcactgaagctatgaagcttgtggcagctgctaaagttagaagagctcaagaagctgtggtgaatgcaagaccattttcggagactttggttgaagtgctttatagcatcaatgaacaacttcaaacagaagatgttgatgtccccttgaccaatgttcgacccgtcaagaaggtggcgttggtggtggtcaccggagaccgtggtctctgcggcggtttcaacaacttcgtcttgaaaaaagccgaagcaagaatccgggagctcaagactcttggtcttgattatgttgtgatcagtgtaggcaaaaagggtaattcgtacttcgttcggcgaccccaaattccagtggacaagtttctcgaaggaagcaatctcccaaccgcgaaagaagctcaggcgatcgcagacgatgtgttttcgctctttgtaagcgaagaagtcgacaaagttgaacttttgtacacaaagtttgtgtcattagtgaaatctgatcctgtgattcatacactacttccattatcacccaaaggagaaatttgtgacataaatggagtatgtgttgatgctgctgaagatgagttctttaggctgaccacaaaagagggaaagttgaccgtcgaacgagacgttattagggccgaaaaaatggacttttcgccaatcttgcaattcgaacaggacccggttcagattcttgatgcattgttgccattgtatttgaacagtcaaatcttgagggctttgcaggagtcgttagcaagcgagcttgccgcaagaatgactgccatggggaatgcgacagataacgcgtccgagttgaagaagaacttgtcgcgggtttacaatcgccagcgccaagccaagattacaggcgagattttggagatcgttgcgggtgctgatgccttggcttgatcatcatgggaaaagttgtggaggatgtcaattttttgtgtggaattaattgtattctgtaatgctaatacttcctccaaacaaatgaaatttgtgtatttgaatatatgaataagttttcat

SEQ ID NO: 1044 - DNA, 1400 bp, Flaveria ramosissima
ccattgttgaatcttgaagaaccccaaattaattaaaaatcatgtcttgctccaatctaacaatgtgggtgtcttcaaaaccatctcttgattcatcatcacccctctctttcagatctttcatcacccctgttcaaatccccacttcaaacccatcaaactccaactatctcatctccaaatcatcttcttcaatccactgcaacctccgtgagctccgcactcgtatcgattcagtgaagaacacacagaagatcactgaggcaatgaagcttgttgcagctgcaaaagtcagaagagctcaagaagctgttgtgaacgcaagacccttttctgaaaccttagttgaagtgctttacagcatcaatgaacagcttcaaacagaagatgttgatgtccctttgaccaatgttcgtccggtgaagaaggtggcgcttgtggtggtcaccggagaccgtggtctctgcggtggtttcaacaacttcatcttgaagaaagctgaagcaagaatcaaagagctcaagactttgggtcttgattatgttgtgatcagtgtgggaaaaaagggtaattcatacttccaacggcgaccgtacattccggtggataagttcatcgacggaagcaatcttccgactgcaaaagaagctcaggcgattgcagatgatgtgttctcactgtttgtaagtgaagaagttgataaagtggagcttttgtacacaaagtttgtgtctttagtgaaatctgaccctgtgattcacaccttacttccattgtcacctaaaggagagatttgtgatattaatggagtgtgtgttgatgctgctgaagatgagttcttcaggctgacaactaaagaggggaaattgacagttgaaagggatgttgttcgggccgatacgatggatttttcaccaatcttgcagtttgaacaggaccctgttcagattcttgatgctttgttgccattgtatttgaacagtcagatcttgaggtctttacaggagtcattagcaagtgagcttgctgcaagaatgactgcaatggggaatgcaaccgataacgcttcggagttgaagaagaacttgtctcgggtttacaatcgacagcgtcaagccaagattactggagagattttggagattgttgctggtgctgatgcactagcttgatcatctatctatcttcatcatgtttggtaattggtatagttcttgaatgtttaatcatatgtgtttaatgtgttgaatttgatcataatattgtgttttttactaggcgaaattgtggaggatgttgaaaattttttctaggattaattgtaatctgtaatgctaatactccctccatactttgaatttgtgtatttgaatataatatcatatatgaataagttattg

SEQ ID NO: 1045 - DNA, 1336 bp, Flaveria ramosissima
gaaccctgaactaaaaatcatgtcttgctccaatctaacaatgtgggtgtcttcaaaacaatctcttgattcatcatcacccctctctttcagatctttcatcacccctgttcaaatccccacttcaaacccatcaaactccaactatctcatctccaaatcatccacttcaatccagtgcaacctccgtgagctccgcactcgtatcgattcagtgaagaacacacagaagatcactgaggcaatgaagcttgttgcagctgcaaaagtcagaagagctcaagaagctgttgtgaacgcaagacccttttctgaaaccttagttgaagtgctttacagcatcaatgaacagcttcaaacagaagatgttgatgtccctttgaccaatgttcgtccggtgaagaaggtggcgcttgtggtggtcaccggagaccgtggtctctgcggtggtttcaacaacttcatcttgaagaaagctgaagcaagaatcaaagagctcaagactttgggtcttgattatgttgtgatcagtgtgggaaaaaagggtaattcatacttccaacggcgaccgtacattccggtggataagttcatcgacggaagcaatcttccaactgcaaaagaagctcaggcgattgcagatgatgtgttctcactgtttgtaagtgaagaagttgataaagtggagcttttgtacacaaagtttgtgtctttagtgaaatctgaccctgtgattcacaccttacttccattgtcacctaaaggagagatttgtgatattaatggagtgtgtgttgatgctgctgaagatgagttcttcaggctgacaactaaagaggggaaattgacagttgaaagggatgttgttcgggccgatacgatggatttttcaccaatcttgcagtttgaacaggaccctgttcagattcttgatgctttgttgccattgtatttgaacagtcagatcttgaggtctttacaggagtcattagcaagtgagcttgctgcaagaatgactgccatggggaatgcaaccgataacgcttcggagttgaagaagagcttgtctcgggtttacaatcgacagcgtcaagccaagattactggagagattttggagattgttgctggtgctgatgcattagcttgatcatctatcttcatcatgtttggtaattggtatagttcttgaatgtttaatcatatgtgtgtttaatgtgttgtatttgatcataatattgttgtttttactaggtccgaaattgtggaaggattgttgtaattttttctaggtattaattagtaattctgtaatgtctaatactccctaccaaac

SEQ ID NO: 1046 - DNA, 1193 bp, Flaveria ramosissima
aaaatcatgtcttgctccaatctaacaatgtgggtgtcttcaaaaccatctcttgattcatcatcacccctctctttcagatctttcatcacccctgttcaaatccccacttcaaacccatcaaactccaactatctcatctccaaatcatcttcttcaatccactgcaacctccgtgagctccgcactcgtatcgattcagtgaagaacacacagaagatcactgaggcaatgaagcttgttgcagctgcaaaagtcagaagagctcaagaagctgttgtgaacgcaagacccttttctgaaaccttagttgaagtgctttacagcatcaatgaacagcttcaaacagaagatgttgatgtccctttgaccaatgttcgtccggtgaagaaggtggcgcttgtggtggtcaccggagaccgtggtctctgcggtggtttcaacaacttcatcttgaagaaagctgaagcaagaatcaaagagctcaagactttgggtcttgattatgttgtgatcagtgtgggaaaaaagggtaattcatacttccaacggcgaccgtacattccggtggataagttcatcgacggaagcaatcttccaactgcaaaagaagctcaggcgattgcagatgatgtgttctcactgtttgtaagtgaagaagttgataaagtggagcttttgtacacaaagtttgtgtctttagtgaaatctgaccctgtgattcacaccttacttccattgtcacctaaaggagagatttgtgatattaatggagtgtgtgttgatgctgctgaagatgagttcttcaggctgacaactaaagaggggaaattgacagttgaaagggatgttgttcgggccgatacgatggatttttcaccaatcttgcagtttgaacaggaccctgttcagattcttgatgctttgttgccattgtatttgaacagtcagatcttgaggtctttacaggagtcattagcaagtgagcttgctgcaagaatgactgcaatggggaatgcaaccgataacgcttcggagttgaagaagaacttgtctcgggtttacaatcgacagcgtcaagccaagattactggagagattttggagattgttgctggtgctgatgcactagcttgatcatctatctatcttcatcatgtttggcgaaattgtggaggatgttgtaaattttt

SEQ ID NO: 1047 - DNA, 1383 bp, Flaveria ramosissima
aatttcacacgtaccatccaccatacaagaaaaagataagatttttatcaagaaacataacctctcttcacacacccttcacctccattgttgaatcttgaagaaccctgaactaaaaatcatgtcttgctccaatctaacaatgtgggtgtcttcaaaaccatctcttgattcatcatcacccctctctttcagatctttcatcacccctgttcaaatccccacttcaaacccatcaaactccaactatctcatctccaaatcatcttcttcaatccactgcaacctccgtgagctccgcactcgtatcgattcagtgaagaacacacagaagatcactgaggcaatgaagcttgttgcagctgcaaaagtcagaagagctcaagaagctgttgtgaacgcaagacccttttctgaaaccttagttgaagtgctttacagcatcaatgaacagcttcaaacagaagatgttgatgtccctttgaccaatgttcgtccggtgaagaaggtggcgcttgtggtggtcaccggagaccgtggtctctgcggtggtttcaacaacttcatcttgaagaaagctgaagcaagaatcaaagagctcaagactttgggtcttgattatgttgtgatcagtgtgggaaaaaagggtaattcatacttccaacggcgaccgtacattccggtggataagttcatcgacggaagcaatcttccaactgcaaaagaagctcaggcgattgcagatgatgtgttctcactgtttgtaagtgaagaagttgataaagtggagcttttgtacacaaagtttgtgtctttagtgaaatctgaccctgtgattcacaccttacttccattgtcacctaaaggagagatttgtgatattaatggagtgtgtgttgatgctgctgaagatgagttcttcaggctgacaactaaagaggggaaattgacagttgaaagggatgttgttcgggccgatacgatggatttttcaccaatcttgcagtttgaacaggaccctgttcagattcttgatgctttgttgccattgtatttgaacagtcagatcttgaggtctttacaggagtcattagcaagtgagcttgctgcaagaatgactgcaatggggaatgcaaccgataacgcttcggagttgaagaagaacttgtctcgggtttacaatcgacagcgtcaagccaagattactggagagattttggagattgttgctggtgctgatgcactagcttgatcatctatctatcttcatcatgtttggtaattggcgaaattgtggaggatgttgaaatttttttctaggattaattgtaatctgtaatgctaatactccctccatactttgaatttgtgtatttgaatata

SEQ ID NO: 1048 - DNA, 1258 bp, Lotus japonicus
tctctatctgatgcctctaacctctccttccgttctatccacctcaacccttttcagcttcccttcacgcctctctgtatcccctgttcagtgcggcctcagagagctcagaacccgtatagaatccgtgaagaacacccagaaaatcacagaggcaatgaagcttgtggcagctgccaaagtcagaagagctcaagaagctgttgtcaatggaagacccttctcagagaccctcgttgaagtcctctacagcatcaacgagcagctccaaaccgaagatgtcgacgtccctctcaccaagatcaggccagtgaagaaggttgccctggtcgtttgcactggagatcgtggactctgcggtggattcaacaacttcatcttgaagaaagctgaagccagaatcaaagagttgaaggaacttggtctggaatacaccatcatcagtgtcggcaaaaagggtaactcctacttcattcgtagaccttacattccagttgatagatttcttgaaggtggcacgcttcccactgccaaagaggctcaagctattgcagatgatgttttctcactgtttgtgagtgaggaggttgataaggttgagctcttgtacacgaagtttgtgtcattggtgaaatctgaccctgtgattcatactctgcttcctctgtcaccaaaaggagaaatctgtgacatcaatgggaactgtgtggatgctgctgaggatgaactgttcaggttaacaaccaaggaagggaaattgactgtggagagagatacctttaggactaaaactgcagaattctcaccgattttgcagtttgagcaggaccctgttcagatccttgatactctgcttcctctgtatttgaacagtcaagtgttgagggcgttgcaggagtcacttgcgagtgagctcgctgcgcgaatgagcgcgatgagtaatgcgagtgataatgccagtgacttgaagaagaacttgtcaactgtgtataacaggcagcgtcaggcgaagatcacaggagaaattctggaaattgttgctggtgctaatgcccttgaatagaacagaacagaacactcttcttctctctgtctcatgatccatgcttggatttctttatgtgcaaactttgtgcgcgaggaaaactgcaattcaatctaaacggactctgtttttgttcactcctttttctctcttctaaactatatatgtaataattgatcaatatagtgcttcagagtgttagctctgttgatt

SEQ ID NO: 1049 - DNA, 1473 bp, Plantago ovata
tggtcctcatcaaaaccttccctctccgacacttctctgctatcctcccgatcgttcatagccccgtttcagatcccaaatcccagctcctcctccccatctactagatcaactaccttccaaatccagtgcaatcttcgcgaactgcgtggccgcattgattctgtaaagaacacacagaaaatcactgaagccatgaagctcgtggctgctgcaaaggtcaggagggcacaagaggctgtggttaatgccagacccttctccgaaacactagttgaagttctctacaacataaatgagcagctccagacagaagatgtcgatattccgctaaccaaggtcaggcctgtcaagaaagtaggtctggttgttgtcactggcgatcggggcctgtgcggtggatttaacaatatgattatcaaaaaagctgaagccaggatcagggaattgaagacacttggcctggatttcgttgtggtgagtgttgggaagaaagggaactcatatttcagtcgtaggccttacatcccagtcgataagtttattgagggaaccaatcttcccacctccaaagaagctcaggcgattgcggatgacgttttctcactattcgtgagtgaagaagtagacaaagttgagctcctgtatacaaagttcgtctctttggttaaatccgaccctgtaattcacactttgctgccattgtctcccaagggtgaaatctgtgatataaatggggtgtgcgttgatgcggctgaagacgagttcttcagattgacaactaaagaagggaagcttacagtggaaagagatgttatgaggactaagactgcagatttctcgccaatcttgcaattcgagcaggacccagttcagattcttgatgctctgctgcccctctacttaaacagtcaaatattgagatcgttgcaggaatcacttgctagtgagcttgctgctaggatgagtgccatgagcaatgctactgacaatgcatcagagttgaagaagaatctgtccatggtttacaacagaaagcgtcaagccaagattactggagagatcttggagattgttgcaggagccgatgccttggtctgaggatagtttttatcccataaccgtccttccctgtaggtaattctgcaggaattctcgtatctatattgtttatgcttgtaaaagaatagtaatccatcacacatttctaaattgtatttctcatgcgcgtacaaatctatgaggaacatcatttaattttgtaatgtaaagagcatcttactcacattcactgtttttatagcttctttctgcatttgttttccatctgaataatcagtgactggaagaacgctgtccaggcatatgttcatggtttctcggaaaaacaaagcagaaagaaataccttgagcttctgcaactgcaacacatcatcttgaaaatatgtgactaaaactactggcaagcaccag

SEQ ID NO: 1050 - DNA, 1636 bp, Citrus sinensis
ctcatttcctccaagccagaagaagcatacatgaaaaaaagataagacttcatgaaacaaacacctaaaacaaaccaagcccacaaagcagactctctctttcccttctctttgagtgcttagactctctccttgagctccaacaatccgttatcagttatcaccatgtcttgctcaaacctaactgtgtgtcgtgacacttcttcgctctcttttggctcatttctcaacccatttaggcctcctcacaattcaacccccaacaacccttctagatcttcatcagttactccaattcattgtggtctccgcgagctcagagaacgtattgattctgtaaagaacacacagaagatcaccgaggccatgaagcttgtggccgctgctaaagtcagaagagctcaggaagctgttgtcaatggcaggcctttctctgaaactcttgttgaggttctttacaacatcaatgagcagcttcaaaatgaagacatagatgttcctttgatcaaagttagacctgtcaagaaagttgctttggttgttgtcactggtgatcgtggtctttgtggtggtttcaacaacaatattattaagaaagctgaagcgagaattgcagaattgaagactcttggacttgattacactattattagtgttggtaagaagggtaatgcatatttccttcgtaggccttatattcctgttgatagatttcttgagggaggttcattacctactgctaaagaagctcagactatagcagatgatgtgttttcactctttgttagtgaagaagttgacaaggtggagcttttatacacaaagtttgtgtctttggttaagtctgatcctgtgattcacactttgcttccactatcaccaaggggagagatttgtgatgtgaatggtgtttgcgttgatgctgctgaggatgagttctttagattgacaactaaggaaggaaagttaactgttgagagagatgttgtgagaactgagactgcttctttctcacccattttgcaatttgagcaggacccagttcagattcttgatgctcttttgcccctctatctaaacagccagatcttgagggctttgcaggaatccttagccagcgagcttgcttcaagaatgagtgccatgagcaatgcaactgataatgcaatggagttgaagaagaacttgtctatcgtctacaacaggcagcgccaggccaaaattactggagagattttggagattgttgctggtgccgatgctttagtgtaaagaattatgcggggcttctcacatcttactcaattgtccatctttgtaggcaattttacgactgtttcccttattgattcaaatatgcttggtttaccaggagtttattcagaatttacactttttcactgtaattctcagctaataaactttgtccacaaatgagaaactggcactatatcttgcaacagaagagctttctacttatatttgtatgttctacatgttttcaccccggctagttcacttgtaaactacttgtataatttggatggatatgtaattccaggctccccttggtcacctctttgaatttttttcattttttaccgtaaaataaattaccagggtaatttctttgttt

SEQ ID NO: 1051 - DNA, 1359 bp, Euphorbia peplus
tctaatctgacaatgtgggtgtcttcaaaatcacctctttctgatgcttcttcactctctttctgctcttctctcagcccttttcaggttccatccggttcgccctcgaacaccccttcgagatcttcgtctgtgaccccaattcacagcagtctccgtgatcttcggaaccgaatagcgtcagtgaagaacacacagaagatcacagaagccatgaaacttgttgctgctgctaaagtgagaagagcacaagaagctgttgttaacggtaggcctttctctgaaactcttgtggaagttctttacaacataaatgaacagcttcaagttgaggatgtagatgctcctcttaccaaagttagacctgtcaagaaagtagctttagtcgtcattacgggcgatagaggtctttgtggtggttataacaatagtatactcaagaaagcagaagcaagaatcaaagaattgaaaggtcttggggttgagttcactattatcagcgtcggaaagaaggggaatacgtattttacccggcggccttatattccggtagataggtttattgaaggaactaatcttccaactgctaaagaagctcaagcaattgcagatgatgttttttccctgtttgttagtgaagaagtagataaagttgagcttttgtacacaaagtttgtgtctttagtcaaatctaaccctgtaatccacactttgctgccactttcaccgaagggtgaaatctgtgacatcaatggaaactgtgtggatgctgcagaagacgagttcttcaggctcacaacaaaagaaggtaaattgactgtggaaagaggtagtacgaggacgaaaacagcagatttctcagcaattttgcagtttgagcaggacccggttcagattctcgatgctcttttgccattgtatttgaacagtcagatcttgaaagcattgcaggaatctttggcgagtgagcttgctgctcggatgagtgctatgagcaatgcaacggataatgcgagtgagttgcagaaagaactttctcgggtttataacagaaaacgtcaggcgaagattactggagaaattttggagattgttgcaggtgccgacgctcttgtttagtctagtttattatatgtatattagtaactgtatctccacgatttctacttctataattcattcagtatatgatgtttgttttgataataggtatgatgagatagaaccaataatttttttcaaactttacttacattgtaattctcaaatgcttgtaatttgtaaacctcttgagaactgcactttatttgataaataagattaaggatatttcctggtaatagggtaattttaatcatg

SEQ ID NO: 1052 - DNA, 1692 bp, Citrus sinensis
aaatccttatctaaaaacctgatccacttcctccatctccctccactcgttccctctcatttcctccaagccagaagaagcatacatgaaaaaaagataagacttcatgaaacaaacacctaaaacaaaccaagcccacaaagcagactctctctttcccttctctttgagtgcttagactctcaccttgagctccaacaatccgttatcagttatcaccatgtcttgctcaaacctacctgtgtgtcgtgacacttcttcgctctcttttggctcatttctcaacccatttaggcctcctcacaatgcaacccccaacaacccttctagatcttcatcagttactccaattcattgtggtctccgcgagctcagagaacgtattgattctgtaaagaacacacagaagatcaccgaggccatgaagcttgtggccgctgctaaagtcagaagagctcaggaagctgttgtcaatggcaggcctttctctgaaactcttgttgaggttctttacaacatcaatgagcagcttcaaaatgaagacatagatgttcctttgatcaaagttagacctgtcaagaaagttgctttggttgttgtcactggtgatcgtggtctttgtggtggtttcaacaacaatattattaagaaagctgaagcgagaattgcagaattgaagactcttggacttgattacactattattagtgttggtaagaagggtaatgcatatttccttcgtaggccttatattcctgttgatagatttcttgagggaggttcattacctactgctaaagaagctcagactatagcagatgatgtgttttcactctttgttagtgaagaagttgacaaggtggagcttttatacacaaagtttgtgtctttggttaagtctgatcctgtgattcacactttgcttccactatcaccaaggggagagatttgtgatgtgaatggtgtttgcgtcgatgctgctgaggatgagttcttcagattgacaactaaggaaggaaagttaactgttgagagagatgttgtgagaactgagactgcttctttctcacccattttgcaatttgagcaggacccagttcagattcttgatgctcttttgcccctctatctaaacagccagatcttgagggctttgcaggaatccttagccagcgagcttgcttcaagaatgagtgccatgagcaatgcaactgataatgcaatggagttgaagaagaacttgtctatcgtctacaacaggcagcgccaggccaaaattactggagagattttggagattgttgctggtgccgatgctttagtgtaaagaattatgcggggcttctcacatcttactcaattgtccatctttgtaggcaattttacgactgtttcccttattgattcaaatatgcttggtttaccaggagtttattcagaatttacactttttcactgtaattctcagctaataaactttgtccacaaatgagaaactggcactatatcttgcaacagaagagctttctacttatatttgtatgttctacatgttttcaccccggctagttcacttgtaaactacttgtataatttggatggatatgtaattctaggctcccttggtcagctcttggattttgtcattgttaccgtaagtaaatcacaggtaattcttgtttatattacatt

SEQ ID NO: 1053 - DNA, 1356 bp, Primula obconica
tattcaagtcacccaaaatattaatcctaattctaagtctaaaggtaaaaaaaaaacccaaaaactaacactttgacaccatgtcttgctcaaacctctcattcaggtcctcactcaaccccttcctttccaacccatcctcccctgccctctcccctgccaggtcatcaccttcccccatccattgcgccctccgcgatcttcgtgaacgcatcgactccgttaaaaacacgcaaaaaatcaccgaagcaatgaaattagtggcggccgctaaggtccgtagagcccaagaagcggtcgtgaatggacgacccttctccgagaccctcgtatccgttttatataacattaacgagcagttgcaaatcgaagacgttgatgcgcctttgacaaaagtgcgtcccgttagaaaagttgcgttggtggttgtcacgggggaccgtgggttatgcggagggtttaataattatttaattaaaaaagccgaggcgaggatcaagcagctaaaggggcttgggatcgagtacacggtgataagcgtgggaaagaagggaaattcatattttcaacggcgtccgtatattccggtggataagtttcttgaaggggggaatttgccgaccgcgaaagaggcacaggcgattgcggatgatgttttttccctttttgtgagcgaagaggtcgataaggtcgagttgttgtataccaagtttgtgtccttggtgaaatccgagcccgttatacatacattgctaccattgtcgcctaaaggtgagatatgcgacataaatgggacatgcgtggatgcggccgacgacgagtttttccgactaacaacaaaagaaggtaagctgacggtggagcgtggtaccatgaggaccgaaacagtagatttttccccaatcctccaattcgagcaagacccggtccaaatccttgatgcacttttgccattgtatctaaacagccaaatattgagggctcttcaggaatccttggctagtgagctggcggcccgtatgagtgcgatgagtaatgcgtcggataacgcgacagagttgaagaaaagcctctcgcaggtttataatagacagcgtcaggcgaagatcaccggagagattttggagattgtgtcgggggcaaatgctcttgagtgaggcggaaaaatattggaaatagtacaatgtgtttattttgaggtggttttgttttgtgggtagtttacttgatttttgtattatgcttgttcaagaataatttatatataaatgacacttgtattctaaagaatgtacaaaactaaggaaactcttgtacattcatattgagtcataagaatattttaactatttttgc

SEQ ID NO: 1054 - DNA, 1660 bp, Medicago truncatula
attatggccggggatctcaaaacctctctacttcctttcattccctccactcattcctttcatgccaatagagattagagaatccaaacacaacacacacaacacattaacattagaacaagataagacatcacaaaactaaaaaaacaactcataatataaccaaccaaatccacacagaccatcctctctttctctgctgtaaactctgcagagcctcatcattgcaacaatgtcttgctccaatatcaccatgttggtctcatccaaaccttcattacctgatgcctctaacctctctttccgttctgctctcaacccttttcagcttccttcacaaaactcatcatcttcttgcactccttcaagaccaactcaaattcagtgtggtctaagagaactcagaaaccgtattgattctgtcaaaaacactcagaaaatcactgaagcaatgaagcttgtggctgctgcaaaagtcagaagagctcaagaagctgttgttaatggcagacctttctcacagacactagttgaagtcctttacagcatcaatgaacagcttcaaaccgacgatatcgaagctcctctaactaagcttagaccagtgaaaaaagttgctcttgttgtttgcactggtgatagaggtctctgtggtggattcaacaatgcaatattgaaaaaagctgaaaaaaggattgctgagttgaaaggtcttggacttgattacactattatcagtgttggtagaaagggtaactcttatttccttcgtagaccttatatacctgttgataggtttcttgaaggtggaaaccttcctactgctaaagaagcacaaactattgcggatgatgttttctcactctttgttagtgaagaagttgacaaagttgaacttttgtacactaaatttgtgtcattagtgaaatcagagcctataatccatactttgcttccactgtcaccaaaaggtgaaatctgtgatattaatggaaactgtgttgatgctgccgaggatgagcttttcaggttaacaacaaaagaaggaaagttaactgttgaaagagatgctgttaggtctaagacgattgatttttcgccgattttgcagtttgagcaggatcctgttcagattcttgatgcacttttgccactttatttgaacagtcaaatcttgagggctttgcaggaatcacttgctagtgaattagctgctagaatgactgctatgagtagtgcttgtgataatgctattgagttgaagaagaatttatcaagggtttataatagacagcgtcaagctaagatcactggtgaaatcctggaaattgttgctggtgctgatgccttggtatagagtgtatttatatgttatattctctcatccatggttggattcctttgtaggtataatggatattgcccttttcattctatatataatatgcttatgcttgtataagactgttatgctatgcatgcaattgttacaattttattgtcttttcctaatatgcaaactttgtgcactaggaaaactgcaatttaatttgaagtggactcactctttgttcagtttttttccattctgagttatatataaatgtaataacatatctgtataaataatattcagaaagttctgtgttaatttgttcta

SEQ ID NO: 1055 - DNA, 2627 bp, Artemisia annua
atgttgaattaggcttacttgaaaagacactagacgttgtttcttcaatgaggagtgaatattaaagtttcggattgtatcttttgtgccattgtaaatgggtattcaaagaaaagagcgttaagttcagcggctaaggtgtatgaacagttagttacaaatggttgtgagcctggtcaagtgacctacgcatccgttataaacatttattttaggctcggggtatatgacaaagcggaagaagtattctgggaaatggacaataaggggtttgataaatgtgtagtggcttactctagtatgattgcaatgtatgggaaagtcaacaggattagggacgcgatgaggcttctagctcgaatgaaagaaagaggggttgagctaaacgcgtggatttacaattctctccttgatatgcatggaaaagtcttgaatttgaaacaagttgagaagatctggaaagagatgaaacgaaggaaagttgtacctgataaagtgagttacacgagtgttataagtgcttatagtaaggctcgagagtttgatatgtgtatgaaatattataatgagtataggcttaatggtggtgttattgatagggcgttgggtgggattatggtaggaaaatgagtagagtggatgaactagtgaagcttttgcaagatatgaagaatgaaggtacgggcttagatgcacggctttatagatcttcgttgaatgctttgagggatgcgggtgtgcatatccaagttaaatggttggaagagagctttgatccaagtttgtaagaggtttagaggaggggaggtcttgcattttacagttaaaactctttttaaaaagctgtaattagagttttcggaagaatcgtggtataattacttgtaccttatgcaaaaaagcatctatattcatgacttcgtgtgaattcttttgttgcagatacggaagagccacatatactcgagagggttcagtcgagtcccataaacaactttgttttggatactgccggtgtaatttaagtgtttcatggatctgcccatggttgtaaatccctaaacatttttgaatctaaactgtctaaagtaaataggccagagttatattaagaagccacgggcacttagagaggaccaaaaaaaaaaaaaaaagtacggatactccgacggggatccttgtattgtcacacatacaattcaaccatacaaacaaaaagataagatttttatcaagaaacaaaacacttcacacaaaccttagccccattgttgaatcttgaacaaaaaaaagaagcatgtcttgctcaaatttgacaacaatgtgggtgtcatcaaaaccatcacttgattcatcttcaccactttcattcagatcattcatatctcctgttcaaatcccctcttcaaatccttccaatggcaactattcgatatcgaaatcttctacttccatccattgcaaccttcgtgagcttagaactcgtattgactcagttaagaacactcaaaagatcactgaggctatgaagcttgtggctgctgctaaagttaggagagcgcaagaagctgttgtgaatgcaagaccattttccgaaacattagttgaggttctttacagtattaatgagcagcttcaaacagaagatgttgatgttcctttagttaatgttagacctgtgaagaaggtggcacttgttgtggtgacaggagaccgtggtctttgtggcggttttaacaactttatcttgaaaaaagccgaagcacgaattcgtgaactcaagactcttggtcttgattacgttatcattagtgtgggtaaaaagggtaattcttacttttcaaggagaccacagattccagttgataagtatcttgatggaagcaatcttccaactgcgaaagaagctcaagcactctttgtaagtgaagaagtcgataaagtcgaacttttgtacacaaagtttgtgtctttagtgaaatctgaccctgtaatccatactttacttccgttgtcacctaaaggtgagatatgtgatattaatggtgtgtgtgttgatgctgctgaagacgagttctttaggttgactactaaagaaggaaagttgactgtggaacgagacgttgttaggagcgaaactatagacttttcaccaatcttgcaatttgaacaagaccctgttcagattcttgatgctttgttgccattgtatttgaacagtcagattttgagggctttgcaggagtctttagcaagtgaacttgctgcaagaatgactgctatggggaatgcaactgataatgcttctgagttgaagaagagcttgtcccgagtctataaccgaaagcgtcaagccaagattactggtgagattttggagattgttgctggtgctgatgcattagtttgatgatcatgttatggaatcggtatagttcttgttttgatgttatgtgtttttcgtgttgtattcgattatatatgtgtactactttacaggaaaaatttgtggaggatgtcaaattttttcggaattaattgtaatctgtttaatactccctccaaacaaatgaaattatgtgtatttgaatatatatatcatatatgaataagtttttcgcatcaaa

SEQ ID NO: 1056 - DNA, 1254 bp, Guizotia abyssinica
attcttgatttcatcttgagatcaaagattcattcatcatgtcttcctccaatctaacaacaatgtgggtatcatcaaaaccatcacttgatttcaaatcattcatcaacccacttcaactcccttcaacaaaccctaattaccatgcaaactccaaatccaccacttcaatcaattgcaacctccgcgagcttcgaacccgaatcgattcggttaaaaacactcaaaagatcacagaagcaatgaagcttgttgcagctgcaaaagtcagaagagctcaagaagcagtggtcaatgcaagaccattttctgaaaccctagttgaagttctttatagtatcaatgaacagttgcagactgaagatgttgacgtcccgttgaccaatgttagaccggttaaaaaagttgcattggtggttgttactggtgatcgtggtctttgtggtgggtttaataactttatattgaagaaagctgaagctaggattaaggagcttaagactcttgggcttgattatgttgttattagtgtgggtaaaaagggaaattcgtattttttacgacggccgaatatcccggtcgataagtttctcgatggaagcaacctcccgactgcgaaagaagcccaggcgatcgcagacgatgtattttcattattcgtaagcgaagaagtggataaagtggaacttttgtacacaaagtttgtgtcattggttaaatctgatcctgtgatacatacattacttccattatctcctaaaggggagatttgtgatataaatggtgtgtgtgttgatgctgccgaagacgagttctttagattgactacaaaagaggggaaattgaccgttgagcgagatgtaatcaggactgaaacaatggatttttcgcctatcttgcagtttgaacaggacccggttcagattttggttgctttgttgccattgtatttaaacagtcagattttgagggctttgcaggagtcgttggcgagtgaactagcggcacgaatgactgcgatggggaatgcgacggataatgcttctgagttgaagaagaacttgtctagggtatacaatcgtcaaacgtcagctaagattactggggagattttggagattgtcgcgggtgccgatgcattgggttaaacttatttttcatcatctttggtatggttaggtgtgtgtattgatcatacatcatactcactctccaaaaggtggaatttggatattgatatatatgaataggttt

SEQ ID NO: 1057 - DNA, 1193 bp, Ambrosia trifida
aataatcatgtcttgctcaaatctaacaatgttgtgtcatcaaaccatcactcgactcatcctcaccactttctttcagatcattcattgcaccagtgcaaattcccagctcaaacccatcaaatgccaaccattcgacatcgaaaccgtcttcttcgatccattgcagcctccgtgatcttcgaacccgtatagattcggttaagaacacgcaaaagatcactgaggcaatgaagcttgtggctgctgcaaaagttagaagagctcaagaagctgttgtgaatgcaagaccgttttctgaaactttggttgaagtactttatagcattaatgaacaacttcaaaccgaagatgttgatgtccccttgacgaatgttcgacccgtcaagaaggttgcgctggtggttgtcaccggagaccgtggtctatgcggcggtttcaacaactttatcttgaaaaaagccgaagcaagaattcgggaactcaagactcttggtcttgattatgttgtgatcagtgtgggcaaaaagggtaattcgtatttccttcggagaccatacattccagttgacaagtttctcgatggaagcaatctcccaactgcgaaagaagcgcaggcgatagcagacgatgtgttttcgctgtttgtaagtgaagaagtggacaaagtagaacttttgtacacaaagtttgtgtctttagtcaaatctgatcctgtgattcatacattgcttccattatcacccaaaggtgagatttgtgatatcaatggtatatgtgttgatgctgctgaagatgagttctttaggctgactactaaagagggaaagttgactgtcgaacgagatgttgttagggccgaaaccatggacttttcgccaatcttgcagtttgaacaagacccggttcagattcttgatgcgttgttgccgttgtatttgaacagtcagatcttgagggctttgcaggagtcattagcaagtgagcttgctgcaagaatgactgctatgggaaatgcgacagataacgcgtctgagttgaagaagaacttgtcgcgggtttacaatcgccagcgccaagccaagattacaggagagattttggagattgttgctggtgctgatgcattggcttgatcataaagtttgggaaaagttgtggaggatgtcaatttttttggaatgaatttgtaa

SEQ ID NO: 1058 - DNA, 1693 bp, Citrus clementina
aaatccttatctaaaaacctgatccacttcctccatctccctccactcgttccctctcatttcctccaagccagaagaagcatacatgaaaaaaagataagacttcatgaaacaaacacctaaaacaaaccaagcccacaaagcggactctctctttcccttctctttgagtgcttagactctctccttgagctccaacaatccgttatcagttatcaccatgtcttgctcaaacctaactgtgtgtcgtgacacttcttcgctctcttttggctcatttctcaacccatttaggcctcctcacaattcaaccccaaacaacccttctagaccttcatcagttactccaattcattgtggtctccgcgagctcagagaacgtattgattctgtaaagaacacacagaagatcaccgaggccatgaagcttgtggccgctgctaaagtcagaagagctcaggaagctgttgtcaatggcaggcctttctctgaaactcttgttgaggttctttacaacatcaatgagcagcttcaaaatgaagacatagatgttcctttgatcaaagttagacctgtcaagaaagttgctttggttgttgtcactggtgatcgtggtctttgtggtggtttcaacaacaatcttattaagaaagctgaagcgagaattgcagaattgaggactcttggacttgattacactattattagtgttggtaagaagggtaatgcatatttccttcgtaggccttatattcctgttgatagatttcttgagggaggttcattacctactgctaaagaagctcagactatagcagatgatgtgttttcactctttgttagtgaagaagttgacaaggtggagcttttatacacaaagtttgtgtctttggttaagtctgatcctgtgattcacactttgcttccactatcaccaatgggagagatttgtgatgtgaatggtgtttgcgttgatgctgctgaggatgagttctttagattgacaactaaggaaggaaagttaactgttgagagagatgttgtgagaactgagactgcttctttctcacccattttgcaatttgagcaggacccagttcagattcttgatgctcttttgcccctctatctaaacagccagatcttgagggctttgcaggaatccttagccagtgagcttgcttcaagaatgagtgccatgagcaatgcaactgataatgcaatggagttgaagaagaacttgtctatcgtctacaacaggcagcgccaggccaaaattactggagagattttggagattgttgctggtgccgatgccttagtgtaaagaattatccggggcttctcacatcttactcaattgtccatctttgtaggcaattttacgactgtttcccttattgattcaaatatgcttggtttaccaggagtttattcagaatttacactttttcactgtaattctcagctaataaactttgtccacaaatgagaaactggcactatatcttgcaacagaagagctttctacttatatttgtatgttctacatgttttcaccccggctagttcacttgtaaactacttgcataatttggatggatatgtaattccaggctcccttggtcagctcttggattttgtcattgttaccgtaagtaaatcacaggtaattcttgtttatattacattt

SEQ ID NO: 1059 - DNA, 1422 bp, Flaveria ramosissima
gaaacataacctcttcacacacccctcacctccattgttgaatcttgaagaaccctgagttaaaaatcatgtcttgctccaatctaacaatgtgggtgtcttcaaaaccatctcttgattcatcatcacccctctctttcagatctttcatcacccctgttcaaatccccacttcaaacccatcaaactccaactatctcatctccaaatcatccacttcaatccactgcaacctccgtgagcttcgcactcgtatcgattcagtgaagaacacacagaagatcaccgaggcaatgaagcttgttgcagctgcaaaagtcagaagagctcaagaagctgttgtgaacgcaagacccttttctgaaaccttagttgaagtgctttacagcatcaatgaacagcttcaaacagaagatgttgatgtcccattgaccaatgttcgtccggtgaagaaggtggcgcttgtggtggtcaccggagaccgtggtctctgcggtggtttcaacaacttcatcttgaagaaagctgaagcaagaatgaaagagctcaagactttgggtcttgattatgtcgtgatcagtgtgggcaaaaagggtaattcatacttccaacggcgaccgtacattccggtggataagtttatcgacggaagcaatcttccgactgcaaaagaagctcaggcgattgcagatgatgtgttctcactgtttgtaagtgaagaagttgataaagtggagcttttgtacacaaagtttgtgtctttggtgaaatctgaccctgtgattcataccttacttccattatcacctaaaggagagatttgtgatgttaatggagtgtgtgttgatgctgctgaagatgagttcttcaggctgacaactaaagagggaaaattgacggttgaaagggatgttgttcgggccgatacgatggatttttcacctatcttgcagtttgaacaggaccctgttcagattcttgatgctttgttgccattgtatttgaacagtcagatcttgaggtctttacaggagtcattagcaagtgagcttgctgcaagaatgactgcaatggggaatgcaaccgataacgcttcggagttgaagaagaacttgtctcgggtttacaatcgacagcgtcaagccaagattactggagagattttggagattgttgccggtgctgatgcactagcttgatcatctatctatcttcatcatgtttggtaattggtatagttcttgaatgtttaatcatatgtgtttaatgtgttgaatttgatcataatattgtgttttttacaggcgaaattgtggaggatgttgaaattttttcaggattaattgtaatctgtaatgctaatactccctccatactttgaatttgtgtatttgaatatatcatatatgaataagttattgg

SEQ ID NO: 1060 - DNA, 1270 bp, Helianthus annuus
caccaccatgtcttgctcaatctaaaatgtgggtgtcttcgtcaaaaccctcacttgattcatcatcacccctttctttcagatcattcatcaccccttctccaattcccacttcaaacccatcaaactccaactatgggatttcaaaatcttcttcttcaatccattgcagcctccgggatcttcgaacccgtatcgattcagttaagaacacacagaagatcacagaagcaatgaagcttgtggcagctgcaaaagtcagaagagctcaagaagctgttgtcaatgcaagacccttttccgaaactttggttgaagttctttacagcatcaatgagcagcttcaaacagaagatgttgatgtccccttgaccaatattcgaccggtgaagaaggtggcgcttgtcgtggtcaccggagaccgtggtctctgcggtgggttcaataactttatcttgaaaaaagccgaagcaagaatcaaggaactcaagactcttggtcttgattatgttgtcatcagtgtgggtaaaaagggtaattcgtatttcctccggcgaccgtacattccggtggataagtttcttgacggaagcaatcttccgactgcgaaagaagctcaggcgattgcagacgacgtgttttcgctgtttgtaagtgaagaagtggataaagtggaacttttgtacacaaagtttgtgtctttagtgaaatctgatcctgtgattcatactttacttccattgtcaccaaaaggggagatttgtgacatcaatggcgtctgtgttgatgctgctgaagacgagttctttaggttgactactaaagaggggaagttgaccgtggaacgagatgtggttagggccgatacattggacttttcaccgatcttgcagttcgaacaagacccggttcagattcttgatgctttgttgccgttgtatctgaacagtcagatattgagggctttgcaggagtcattggcaagtgagcttgctgcaagaatgactgcaatggggaatgcaacggataacgcttcagagttgaagaagaacttgtctcgggtttacaatcgacagcgccaggccaagattacaggagagattttggaaattgttgctggtgctgatgcgttagcttgatcatcgtgggtatagctcctgcaactgattgattaagcgaatgtgtttttcgtgtggaataataatatgtatttttaacaggaaaaacaggtggaggatgtcatattttttggaattagttgttcctccaa

SEQ ID NO: 1061 - DNA, 1596 bp, Fragaria vesca
gcttcttcttcacaaaccaaaaccccatctaaaagaaaaccaaacctcacaaaccagacccccactttctctgttcatttgcagagagagttagctagttagttcagaaaacttgcgctaaactcaaaaccatgtcttgttcaaatgtgacaatgtgggtgtcctctaaaccttccctcactgacacctccaccctctccttccgctcttgcctcagccctttccagcttccttctcagaactcactcaccggcaacccatcaagatcttccaccgtgacatgtggcctccgtgagcttcgtgatcgtattgcctctgtatccaacaccaagaagatcaccgaagccatgaagcttgtggctgctgccaaagtccgtagagctcaagaagctgtcgtaaatggaagacctttttcgcaaactctagtggaagtcctttacaacatcaatgagcagctccaagtagaagacatagattcacctcttaccaatgttagacctgtcaagaaggtcgctcttgttgttgtgacaggtgatcgtggtctttgcggaggtttcaacaatcagatcattaagaaagccgagaggaggattgcggagttgaaggctcttggtcttgagtatactattgtgagtgttggcaagaagggtaactcctatttttcacgtcggccttatattccggttgataagttcattgaaggaaccaatcaacctaccgccaaggaagcacaggccatagccgatgacgttttctctctttttgttagtgaggaagtcgacaaggtggagcttctgtacaccaagttcgtgtctttggtgaaggctgatcctgtgattcacaccttgttgccactctcaccgaaaggagagatttgcgacatcaatggcacttgtgtagatgctgctgaagatgagttcttcagattgacaacaaaagaagggaaattgacagtagagagagatgcaaccactacagctaccgttgatttctctccgattctgcagtttgagcaggatcctgttcagattctcgatgcattgctacctttgtaccttaacagtcaagttttgagggcattgcaggagtcattggcaagtgagcttgctgctaggatgactgctatgagcaatgcgtcggataatgcagtcgagttgaagaagaacttgtcgcaggtttacaacaggcagcgccaggcgaaaatcaccggggagatcttggagattgtttctggtgccgatgctttaacctaagtaggtatgatatgacatggctactgcttgcatcaaatttcttcacacttgattgtaatttttctcagcgctgcgtataaactgtgtgcacaaagagaagtgcaatgccaaatgttattttggttttggaaccaaatgtcattttttctacatcatagttaatatataataataataccacgctaatgtaattaaggattattcgtaagtttcgttcatcaatcagatatagatttgcaattgcttgttagttgttgtatcctagctccttattatgtatacttgaatacttgatactgatatgcttctttggtaatgcttgagcagaacctcaatgtttcat

SEQ ID NO: 1062 - DNA, 976 bp, Brassica juncea
caatgtggggggtttcatcaaacccatctctttccgattcctcttccttgtccttccgctctgttctcaacccacttcctctcccaaaccacaacacctctccctcaagatcatcctctgtttcaccaatccaatcctccctccgtgagctcagagaccgaatcgattctgtcaaaaacactcagaagatcaccgaagccatgaagcttgtcgctgccgcaaaagtcaggagagctcaagaagccgtcgtcaacggccgacccttttcagaaaccctagtcgaggttctttacaacatcaacgaacagcttcaaaccgatgacatcgatgtgcccttaaccaagatcagaccggttaagaaagttgcactcgtggtcgtgaccggagatcgtgggttatgtggtgggttcaataacttcatcatcaagaaagcagaggcgaggatcaaggagcttcaaggtctaggtcttgctacacagtcattagcgtggggaagaagggaactcttacttcctccgtcgtccttacatccccgtcgacaagtacctcgaagccgggaccttaccgacggcgaaagaggctcaagctgttgctgatgatgtcttctctctgtttataagcgaggaagtcgacaaggtggagctcttgtacacgaagttcgtgtctctggtcaaatcagaacccgtgatccacacgctactgcctctatcgcccaaaggagagatctgcgacatcaacgggaactgtgttgacgctgccgaagacgagctcttcaggttaacgaccaaagaagggaagcttacggtcgaaagggagacttttaggacaccaactgctgatttctcgccgatcttgcagttcgagcaagaccctgttcagattcttgatgctttgttgcctctgtatcttaacagtcagattctcagggctttacaggagtctttggcgagtgagcttgcagctagaatgagtgcaa

SEQ ID NO: 1063 - DNA, 1464 bp, Aquilegia formosa
aaagaaaaagaaaaaggaaagaaaaaaagaaaagaaaagaaaacaccatcaaacgaaaatccccaataaacaaaactcatcactcaaaaaacacccctctttcaactctgcagatctctgcattgcagagctaacccaaatcaaaaccatgtcttgttcaaatctaacaatgtgggtatcttcaaaatctcctctttcagacacttcttcattgtccttcggggcatctctcaatccaattcgtcttccttcacaaaacttaactacaatcaccccttctcgttctataacatcaaacccaattcgttgtagtcttcgtgcacttcgtgaccgtattgattcagttaaaaacacccaaaagattactgaagcaatgaaacttgtggctgctgctaaagtcagaagagctcaagaagctgttgttaatggaagacccttttccgagacacttgttgaggttctatacagcataaatgaacaggtacaaggtgatattgatgatattcctttaactaaagttcgtcctgttaagaaagttggtctagttgttataactggtgatcgtggtctttgtggtggttttaacaattttgttttgaaaaaagccgaagctcgaatggctgaattaagacaacttggtattgaattcactattattagtgttggaaagaaggggaattcatattttattcgtcgcccttatatcccagttgataaatttcttgaaggtggaaatttgcccactactaaagaagctcaagctattgctgatgatgtgttttcgctttttattagtgaagaagtcgataaggttgagcttctatataccaagtttgtttcattggttaaggctgatccagtaattcacactttgcttccattgtctccaaagggagaagtttgtgacattaatggtgtttgtgttgatgccgctgaggatgagttgtttagattgacgacaaaagaagggaaattgacagtggagagggacgtagttatgagcaaaactgaggatttctcacccatattgcaatttgaacaagacccagttcagattcttgatgccttgttacctctttatttgaacagtcagatattgagagcattgcaggaatcccttgcgagtgagcttgctgctaggatgactgcaatgagtgctgcaactgataatgctagtgagctaaagaaggatctttctatgaagtacaataggcggcgtcaagcgaagattactggtgagattttggagattgttgctggtgccgatgctcttatatgatttcattgctactggtactcctttgagcttcagttcttcttgttttggtgggtattttataattcattgtcatatgcttaattgtttaaagaaaatcatgtaaaaatagacagctttataattgtaatttacagctgcattcgggcatcccatctaatgagcattgtggattcaaataaacaatg

SEQ ID NO: 1064 - DNA, 1430 bp, Vaccinium corymbosum
accaatagaatcccatttgcccattatccccccatacagtcttctcctccattgctactgattttccacacagaaacccttcacaaatttctacccaaaaaacagcctccaatggcttcttgtgctaacacaacaatgcggctctactcaaacttcaacccattccaactcccaaccaaacactcattatcgtcatcccattccaatcctccttgcaaacctttccatgtcacctgcagcctccgggacctccgtgaccgcatcggctccgtcaagaacactcaaaaaatcactgaagccatgaaactagtggcggcagctaaagtcaggagagcccaagaagccgtcgttaacggccggcccttctccgaaaccctcgtggaagtcctttacagcatcaacgagcagatacaaacggaagacgtcgacgtgcccctcaccaaagtcaggcctgtcaagaaagttgccctggttgtggtcactggtgacaaaggcctttgtggtgggttcaataaccaagtgattaaaaaagccgaagcgcgaatagctgagctgaaaggccttggtttagagtacactgtgatcagtgttggtaaaaagggtaatgcttatttccaaaggcggccttacattccagtggataggtatctggaaggagggtatctgcctactgctaaagaagcccaagctatagctgatgatgtcttttcgcttttcgttagtgaagaggttgacaaggtggagcttttgtacacgaaattcgtttcgctgctccggtcggatcccgtgatccacaccctcctcccactttccccgaaaggggagatctgcgacattaacgggacgtgcgtggatgccgcggaagacgagttctttcggttgacgacgaaagaagggaagctgacggtggagagggacacggtgagggcacaaacggaggaattttcgccgattctgcagttcgagcaggacccggttcagattcttgatgcattgctgcctttgtatttgaacagccagattctgagggcgctgcaggagtcactggctagtgagcttgcggctcgtatgaccgcgatgagtaatgcttcggataacgccgaggaactcaagaagtcgctttcgatgatttacaatagggagcggcaggcgaagattaccggagagatgttggagattgttgccggagccgctgccatggggggctaaaaatgggtggctgaaaatatttcctctctgtgttttaggtggttttaggtgggtctttcctttgttcctaaaactattctatgcagagtggatacaatttttacttgtaatattgtataatgtgtgcaaattttgtgcacaacgacaacccataatgtgttttttggaacacaaggacatttcaccttcttcctctcaggtatataatataatacttgtat

SEQ ID NO: 1065 - DNA, 1421 bp, Aquilegia formosa
caccatcaaacgaaaatccccaataaacaaaactcatcactcaaaaaacacccctctttcaactctgcagatctctgcattgcagagctaacccaaatcaaaaccatgtcttgttcaaatctaacaatgtgggtatcttcaaaatctcctctttcagacacttcttcattgtccttcggggcatctctcaatccaattcgtcttccttcacaaaacttaactacaatcaccccttctcgttctataacatcaaacccaattcgttgtagtcttcgtgcacttcgtgaccgtattgattcagttaaaaacacccaaaagattactgaagcaatgaaacttgtggctgctgctaaagtcagaagagctcaagaagctgttgttaatggaagacccttttccgagacacttgttgaggttctatacagcataaatgaacaggtacaaggtgatattgatgatattcctttaactaaagttcgtcctgttaagaaagttggtctagttgttataactggtgatcgtggtctttgtggtggttttaacaattttgttttgaaaaaagccgaagctcgaatggctgaattaagacaacttggtattgaattcactattattagtgttggaaagaaggggaattcatattttattcgtcgcccttatatcccagttgataaatttcttgaaggtggaaatttgcccactactaaagaagctcaagctattgctgatgatgtgttttcgctttttattagtgaagaagtcgataaggttgagcttctatataccaagtttgtttcattggttaaggctgatccagtaattcacactttgcttccattgtctccaaagggagaagtttgtgacattaatggtgtttgtgttgatgccgctgaggatgagttgtttagattgacgacaaaagaagggaaattgacagtggagagggacgtagttatgagcaaaactgaggatttctcacccatattgcaatttgaacaagacccagttcagattcttgatgccttgttacctctttatttgaacagtcagatattgagagcattgcaggaatcccttgcgagtgagcttgctgctaggatgactgcaatgagtgctgcaactgataatgctagtgagctaaagaaggatctttctatgaagtacaataggcggcgtcaagcgaagattactggtgagattttggagattgttgctggtgccgatgctcttatatgatttcattgctactggtactcctttgagcttcagttcttcttgttttggtgggtattttataattcattgtcatatgcttaattgtttaaagaaaatcatgtaaaaatagacagctttataattgtaatttacagctgcattcgggcatcccatctaatgagcattgtggattcaaataaacaatg

SEQ ID NO: 1066 - DNA, 1406 bp, Panax ginseng
ttacggccgggtccttcagttcttgcatcaacccttttcagatttcaaaccaaaattcaaccatttcgaatccctcttctagatcctcatcagtcaccccaattcattgcagtcttcgcgatcttcgtgaacgtatagattcagtcaagaatacccagaagattaccgaggctatgaagcttgttgctgctgctaaagtgagaagagcacaagaagctgtggtcaatgccagacccttttcagaaactcttgttgaagttctttacagtatcaatgagcagctccaaacagaggatattgatgtctcgcttacaaatgtccggccggtaaagaaggttgctttggtggttgtcaccggcgatcgcggtctctgtggcggtttcaacaatgcaatcatcaaaaaagctgaagcccggatcagagaattgaaggctcttggcctagattacactgtaattagtgttggtaaaaagggtaacacgtattttcaacgtaggccttatataccagtagataaatttcttgaagggggtaatctcccaactgcaaaagaagctcaggcaatagcagatgatgttttttcactttttgtgagtgaggaggttgataaagttgaacttttgtacacgaaattcgtttcattggttaaatccaatcccgtgattcataccttgcttccattatcacctaagggagagatttgtgacataaatgggacatgtgttgatgcagcagaagatgagttcttcaggctgacaacgaaggaagggaaattgaccgtggagagagatactgtgaggactgaaacagttgaattttctcctgttttgcaatttgagcaagaccctgttcaaattcttgatgctttgctgcctctttatctcaatagccaaattctgagatcattgcaggaatcactagccagtgagcttgctgctaggatgagtgccatgagcagtgcaaccgacaatgccaaggagctcaagaagaacttatcgcaagtctataataggcagcgtcaggccaaaattacaggtgagatattggagattgttgctggagccgatgctttagtctaacaagtttacttgtttatctttatgtatttttgcgggtgacccttgatcattcaatgatgcttgtttttataacaaataagcagagtaggcactttccagttccgtacaaacttgtatgatgagaacactgaatgtatttccgaacataaagagcattacattcatctttatatataatgtattaaatctttcccttgtatttgtaatacttgaattactaatttttatagagttcacttccacaccttcctttttgtgtttctctgttcaactacttattggacacgtattgtaatgttgtattaatttcatagaaagattctgctt

SEQ ID NO: 1067 - DNA, 1293 bp, Linum usitatissimum
acagacaccatgtcctcctgctccaatctaacaatgtgggtgtcctcaagacattctctttcggacccttgcctcttctcatctatcacccctttcaaaatctccatcccaaaatcatctacttcccgatcctcctcctcctctattcctttgattcagtgcagctccctccgtgaactccgaactcgtatcgaatccgtcaagaacacccaaaagatcactgaagccatgaagctcgtggcggccgctaaagtcaggagagcccaagaagcggttgttaacgggcgtcccttctcagaaaccctggtggaagtcctgtacaacatcaacgagcagctccaggttgaagacgtagatgcccctttgaccaaagtccgtccggtgaagaaggtggcccttgtagtcatcactggtgacagaggactctgcggcggctacaacagccagatcatcaaaaaggcagagcttaggatcaaggaattgaagtccctgggactagaatacaccatcatcagcgttggtagaaagggaaatacctatttccttcgccgtccctacatccccgtcgatcgtttccttgaaggctccaatcttcccacaaccaaagaagcccagaccatcgccgacgatgtattctcgctgttcgtgagcgaggaagtggacaaagttgagcttctctacactaaattcgtgtctctggtgaagtctgaccccgtaatccacacgcttcttcccctttctcccaaaggcgagatctgcgacataaacggagtgtgcgttgacgctgccgaggacgagttcttcaggcttaccacaaaggaggggaagctgacggtggagagagacgtggtgaggacggcaactccagatttctctccgattttgcagttcgagcaggatccggttcagatactggatgcattgcttcccttgtacctcaacagtcagatactcaaggctctgcaggaatcattggcgagtgagctggccaacaggatgagcgccatgagcaccgcgtcggataatgcgtcggacctcaagaagagtctctccaaagtttacaatagacagcgtcaagccaagattaccggcgagattctcgaaatcgttgctggtgccgacgccttgacataaataaccaaaaaaagaagaagaagaagaagaagaaaccccacacccacgttctacttgttaatctgttgtttgtaggtaaggtaattgaaaacaacagaggctttggtctgcttgcgcttccttccttccttctttcttgtatgccttggtaatgaatga

SEQ ID NO: 1068 - DNA, 1297 bp, Helianthus annuus
atgtgggtgacttcttcacacaatcatttgattcaacttcgcccccttcggtcgtattgttcatattccatctccaaataccacttcgtattataactatgggacttcttcttcaaaatcttcaatccagtgcagcctccgggatcttcgaacccgtatcgattcagttaagaacacacagaagatcacagaagcaatgaagcttgtggcagctgcaaaagtcagaagagctcaagaagctgttgtcaatgcaaggcccttttccgaaactttggttgaagttctttacagcatcaatgagcagcttcaaacagaagatgttgatgtccccttgaccaatattcgaccggtgaagaaggtggcgcttgtggtggtcaccggagaccgtggtctctgcggtgggttcaataactttatcttgaaaaaagccgaagcaagaatcaaggaactcaagactcttggtcttgattatgttgtgatcagtgtgggtaaaaagggtaattcgtatttcgtccggcgaccgtacattccggtggataagtttcttgacggaagcaatcttccgactgcgaaagaagctcaggcgattgcagacgacgtgttttcgctgtttgtaagtgaagaagtggataaagtggaacttttgtacacaaagtttgtgtctttagtgaaatctgatcctgtgattcatactttacttccattgtcaccaaaaggggagatttgtgacatcaatggagtctgtgttgatgctgctgaagacgagttctttaggttgactactaaagaggggaagttgaccgtggaacgagatgtggttagggccgatacaatggacttttcaccgatcttgcagttcgaacaagacccggttcagattcttgatgctttgttgccgttgtatctgaacagtcagatattgagggctttgcaggagtcattggcaagtgagcttgctgcaagaatgactgcaatggggaacgcaacggataacgcttcagagttgaagaagaacttgtctcgggtttacaatcgacagcgccaggccaagattacaggagagattttggaaattgttgctggtgctgatgcgttagcttgatcatcatgggaaaaacaggtggaggatgtcatatttttttggaattagttgttccctccaaataaatcgaattggtgtacttgaatatatataatatatatacccatatatatgtgtgaatatgaataagtttcaatgctttatcttctaactcaagaatatataatttactttaattctctcaaaaaaaaaaaa

SEQ ID NO: 1069 - DNA, 1684 bp, Vaccinium corymbosum
acctcacattttccctcctcttctccacaccaatagaatcccattgcccattatccccccatacagtcttctcctccattgctactgattttccacacagaaacccttcacaaatttctacccaaaaaacagcctccaatggcttcttgtgctaacacaacaatgcggctctactcaaacttcaacccattccaactcccaaccaaacacccattatcgtcatcccattccaatcctccttgcaaacctttccatgtcacctgcagcctccgggacctccgcgaccgcatcggctccgtcaagaacacccaaaaaatcactgaagccatgaaactagtggcggcagctaaagtcaggagagcccaagaagccgtcgttaacggccggcccttctctgaaaccctcgtggaagtcctttacagcatcaacgaacagatacaaacggaagacgtcgacgtgcccctcaccaaagtcaggcctgtcaagaaagttgccctggttgtggtcactggtgacaaaggcctttgtggtgggttcaataaccaactgattaaaaaagccgaaggccgaatagctgagctgaaaggccttggtttagagtacactgtgatcagtgttggtaaaaagggtaatgcttatttccaaaggcggccttacattccagtggataggtatctggaaggagggtatctgcctactgctaaagaagcccaagctatagctgatgatgtcttttcgcttttcgttagtgaagaggttgacaaggtggagcttttgtacacaaaattcgtttcgctgctccggtcggatcccgtgatccacaccctcctcccactttccccgaaaggggagatctgcgacattaacgggacgtgcgtggatgccgcggaagacgagttctttcggttgacgacgaaagaagggaagctgacggtggagagggacacggtgagggcacaaacggaggaattttcgccgattctgcagttcgagcaggacccggttcagattcttgatgcattgctgcctttgtatttgaacagccagattctgagggcgctgcaggagtcactggctagtgagcttgcggctcgtatgaccgcgatgagtaatgcttcggataacgccgaggaactcaagaagtcgctttcgatgatttacaacagggagcggcaggcgaagattaccggagagatgttggagattgttgccggagccgctgccatggggggctaaaaatgggtggctgaaaatatttctttctcttctactgtttcttggccttttcttgactactgtcccgttctctgtgttttaggtgggtctttcctttgttcctaaaattattctatgcagagtggatacaatttttacttgtaatattgtataatgtgtgcaaattttgtgcacaacgacaacccataatgtgttttttggaacacagggacatttcaccttcttcctctcaggtatataatataatacttgtattatttggagttcacctccatggagtctgtgttgatctgaaacacattcatgaatggtcctgcgactgaattcacggcgcctataaatacatacaacaatcggtagaggtagttacgaaattcatttagacaaaccaacaagtaataaaacgtaactaatataacaaatcgtacaatagaggaattattagtaa

SEQ ID NO: 1070 - DNA, 1445 bp, Arabidopsis lyrata
ttcttcttacactgtttgtttataaataaaacctggaagctcagctccatggtgaagtatgttttgtgcaaccatatgagctctgatggtgattctggtcacaggagattcatgaaatttgtgattcattgcatcaagaatagaagactacagggggaggttaattagattatcttaaggtgtataaaatggaaaagaagagcgtaaaaatttctgataagttgtctctgattagagtgttaagaggtataatatgtttgatggtgttagtttcaacagcttttatgatgttaatattctgggggttcctatcagctgtattgttgaggcttttcagcgtacgctatagccgtaaatgtgtttccttcttctttggttcgtggctcgccttgtggcccttcctctttgagaagattaacaggaccaaagttatcttctctggcgataaggttccttgcgaggatcgagtattgctcattgcaaaccaccgaacagaagttgattggatgtacttctgggatcttgcactgcgtaaaggccagattgggaatataaaatatgtgcttaagagtagtttgatgaaattacctctctttggttgggcgtttcacctctttgagtttattcccgttgagcggaaatgggaagtcgatgaagcaaacttgaggcagatactttcgagttttaaggatccccgagacgctttatggcttgctcttttccccgagggcacagattacacagaggctaaatgcgaaaggagtaagaaatttgctgctgaaaatggccttccaatactgaacaacgttctgcttcccagaacaaaaggtttcgtctcctgcttgcaagaattgagttgctcacttgatgcagtttatgatgtgaccatcggttataaaacccgctgcccatctttcttagacaatgtttatggaattgagccatcagaagttcacatccacatccgtcgtatcaacgtaacccaaatcccaaatcaagaaaaggacatcaatgcttggttaatgaacacattccagctcaaagaccagctgctcaatgacttttactccaatggccatttcccgaacgaaggaacagagaaagagttcaacacaaagaagtacctcataaactgcttggcagtgattgccttcaccaccatctgtacgcatctcaccttcttctcatcaatgatttggttcaagatttatgtctctttggcctgtgcctacttgacctctgctacacatttcaatcttcgttctgttccacttgttgagactgcaaaaaaagccttcaaattactaaacaaataaactttcattgttttcaatccacatgatggaatcttttttacttctgtatttcggggttcagaatcaatccactttctacttatgaaatgtgacctcaagctgcaatatatgattagctctatttgagaa

SEQ ID NO: 1071 - DNA, 1466 bp, Eutrema halophilum
gttctttaagtctttgatcatataactgcaggtgaagtatgacctgtccaagaactcaaagatgatgatgatgttatgacgctctgaatgtgattctggtacaaccaatcaagacacagacgcaacaggaggttaagtagatcatcttaaggtgtaaaaaaaatggaaaagaaagttacaaagagtgaagaaaatataccaaactctaataataagttgtctctgataagagtgttaagaggtataacatgcctgatggtgttggtttcaacagcttttatgatgttgatattctgggggttcctctcagctgtagtgttgaggcttttcagtgtacactatagccgtaaatgtgtttccttcttctttggctcgtggctcgccttgtggccatttctctttgagaagataaacagaaccaaagttgttttctgtggggataaggttccttgtgaggaacgagtattgctcatggcaaatcaccggacagaagttgattggatgtacttctgggatcttgcgctgcgtaaaggccagattggtaatatgaaatatgttctcaagagcagtttgatgaagttacctctgtttggttgggcgtttcacctcttcgagtttattcctgttgagcggaaatgggaagtcgatgaagcaaacttgaggcagatggtttcgagttttaaggatccacgagatgctttatggcttgctcttttccccgagggcacagattacacagaggctaaatgcgaaaggagtaagaaatttgcagctgcaaatggccttcctgttctgaacaacgtgctgcttcccagaacaaaaggtttcgtctcctgtttggaagaattgagttgctcacttgatgcagtttatgatgtgaccatcgggtataaaaaccgttgcccgtctttcttagacaatgtctatggtattgagccatcagaagttcacatccacatccgtcgtatcaacctaacccaaatcccaaataaagaaaaggagatcaatgcttggttagtgaacacattccagctcaaagaccagctgctcaatgacttctactctcgtggccatttccctaacgaaggaacagaaaaagagttcaacacaacgaagtacctcataaactgcttggcagtgattgtcttcacgatcatctgtacgcatctcaccttcttctcgtcaatgatttggttcaagatctatgtctctttggcctgtgcctacttgacctctgctacacatttgaatcttcgtgctgttccacttgtagagactgcaaaaagagccttcaaattagtaaacaaataaactttactttgtgtttattaattcacatgatggaatcatttttttttctctttcacttttgtattttggggttaatactcaatcccatttctacttatgaaatatgagtttaagctgcaatatatgatcagatttatattagaatctcttcatat

SEQ ID NO: 1072 - DNA, 1442 bp, Eutrema parvulum
gttcttaagcctttgatcatataaactgcaggtgaagttggaacaatatgagatctaacggtgactatggaaacacgagatttgtgaaatctaagatttattgaatcaagaacagacacaacaggagggtaaatagattatcttaaaggtgtcacaaaatggaaaagaaagttacaaagagtgaagaaaatatatcaaactctagtaataagttgtctctgataagagtgttgagaggtattatatgcctgatggtgttagtttcaacagcttttatgatgttgatattctggggcttcctatcaggtgtagtgttgaggcttttcagcgtacactatagccgtaaatgtgtttccttcttctttggctcgtggctcgcgttgtggcctttcctctttgagaagataaacagaaccaaagttgtgttctgtggggataaggttccttgcgaggaacgagtattgctcattgcgaatcaccgaactgaagttgattggatgtacttctgggatcttgcgctgcgtaaaggacagattgggaatatgaaatacgtgcttaagagcagtttgatgaaactacctctgtttggttgggcgtttcacctctttgagtttattcccgttgagcggaaatgggaagtcgatgaagcaaacttgaggcagatagtttcaagctttaaagatcctcgagatgccttatggcttgctcttttccccgagggcacagattacacagaggctaaatgcgaaaggagtaagaagtttgcagctgaacatggcttaccagcactgagtaatgtgttgcttcccaggacaaaaggttttgtctcctgcttgcaagaattgagttgctcacttgatgcagtttatgatgtcaccatcggttataaaacccgttgtccgtctttcttagacaatgtctatggtattgaaccatcagaagttcacatccacatccgtcgtatcaaccaaactcaaatcccaaatcaagaaaaggaaatcaatgcttggttaatgaacacattccagctcaaagaccagctgctcagtgacttccactcctgtggccatttccctaacgaaggaacagaaatagagttcagcacgaagaagtacctcataaactgcttggcagtgattgtcttcacgattatctgtacgcatctcaccttcttctcgtcgatgccttggttcaagatctatgtcactttggcctgtgtgtacttgacctctgctacacatttcaatcttcgttctgctccacttgttgagactgcaaaaaaggccttcaaattagtaaacaaataagctttcaatgtttttcagttcacatgatggtgatcatttttttttttgtatttttggcggctaagactcggtccattttctacttatgatatgtgagctcaagctgcaatagatgatgagctctgttctataatg

SEQ ID NO: 1073 - DNA, 1548 bp, Brassica rapa
gtaagctgtcttcttcttctatcttatttccagaacaaaataaaacaaaaaatatctgatagtatattttacatctgcattgtatcctgattctttctgttctttaagtctttgatcatatcaaagcaggtgaagttaagaactcttatgatgatgttgtaaccatacgaacctctgatggtgtcaattcttgaatcaagagcagacacaacataggagggtaaatagattatcttaaggtgttcacaagatgaaaaataaagttacaaagagtgaaggaaacataccgaactctgacaacaagttgtctctgataagaatgttgagaggtataacatgtctgatggtgctggtttcaacagcttttatgatgttgatattctgggggttcctatcaggcgtagtgttgagactcttcagcatacactatagccgtaaatgtgtttctttcttcttcggctcctggctcgccttgtggcctttcctctttgagaagataaacggaaccaaagttgtcttctctggggacaaagttccttgcgaggaacgagtattgctcattgcgaatcaccgaaccgaagttgattggatgtacttctgggatcttgcactgcgcaaaggccagattgggaacatgaagtatgtgctgaagagcagcttgatgaaactacctctgtttggttgggcgtttcacctctttgagtttattcccgttgagcggagatgggaagtggatgaagcgaacttgaggcagatagtttcgagttttaaggatcctcgagatgctttgtggcttgctcttttccctgaaggcacagattacacagaggctaaatgcgaaaggagcaagaagtttgcagctgaacatggcttaccagtactgagcaacgtcctgcttccaaggactaaaggtttcgtctcttgcttgcaagaactgagttcctcacttgatgcagtttatgacgtcaccatcggttataaaacccgttgtccgtctttcttagacaatgtctacggtattgaaccatcagaagttcacatccgaatccgtcgaatcgaccaaagccaaatcccaaatcaagaaaaggagatcaatgattggttaatgaacgcgttccagctcaaagaccagcttctcagtgacttctactccagtggccatttccctaacgaaggaacagaaaaagagttcaacacactgaagcacctcataaactgcttggcagtgattgtcttcacggtcatctgcgcgtatctcaccttcttttcgtcgatggtctggttcaagatctatgtctctttggtctgtgcctacttggcctccgctacacatttcaatcttcgttctgttccacttgttgagactgcaaaaaaggccttcaaatgattaaacaaataaactttcattgttttccattttacatgatggagtaatgtttttttcttttactgttagattttgaggttaagactcaatccaatttctacttatgaaatgtgagcacaagctgcaagcaaagtgttatacttcaatcaaatctccttcgg

SEQ ID NO: 1074 - DNA, 1516 bp, Raphanus sativus
  misc_feature (18)..(18): n is a, c, g, or t
  misc_feature (582)..(582): n is a, c, g, or t
  misc_feature (1266)..(1266): n is a, c, g, or t
  misc_feature (1496)..(1496): n is a, c, g, or t
gggtaagcagtaagctgncttcttcttcttccagcaaactttcagaaaataaataaaaaatctgataggtggattttacaacttgcattgtattctgattctttttgtgaagtatgttgttctgtgctaagaactctattatgatgtttatcaccatataagctctaatggtgactatgataaccccggattggtgaaattcactttctattgaatcaagaatatacacaacaggagtgtatatatatagattatctttaaggtgtcacaaaaatggaaaagaaacttaaaaactctaataagatgtctctaataagaatgttgagaggtatagcatgtctgatggtgttggtttcaacagcttttatgatgttgattttctggggtttcctatcagctgtagtggtgaggcttttcagcttacactacagccgtagatgtgtttctttcttctttggctcctggctcgccttgtggcctttcctcttcgagaagatcaacagaaccaaagttgtcttctctggggataaggttccttgcgaggaacgagtgttgctcattgccaatcaccgaacagaggtngattggatgtacttctgggatcttgcactgcgtaaaggacagattgggaatatgaagtatgtgctcaagagcagtttgatgaagttgcctctgtttggttgggcgtttcacctctttgagtttatccccgttgagcggagatggaaagtagatgaagcaaacttgaggcagatggtttccagttttaaggatcctcgagatgctttgtggcttggtcttttccccgagggcacagattacacagaggctaaatgcgaaaggagcaagaagtttgcagctgaaaatggccttccagtactgaacaatgtgttgcttcccaagacaaaaggtttcgtctcctgcttggaggagttgaatggctcacttgatgcagtttatgatgtgaccatcggttacaaaacccgttgtccgtctttcttagacaatgtctatggtactgaaccatcagaagttcacatccacatccgtcgtatcagccaaaaccaaatcccaaatgaagaaaaggaaatcaatgcttggttaatgagcacattcgagatcaaagaccagctgctcagtgacttctacactcgtggccatttccctaacgaaggaacagaaaaagagttcagcacattaaagcacctcattaactgcttggcggtgattgtgttcaccatcatctgtacgcatctcaccttcttntcgtcgatgatctggttcaagatctatgtctctttggtctgtgcctacttgacctatgctactcatttcaactttcgtcctgctccacttgttgagactgcaaaacaagctttcaaattagcaaacaaataaacctatcttttaatgtttatattttagtattatattttgaggttgagactagatccaatttctgcttatggaatgtgaactcaagctccaataaatgntgtgaagtctatcttatatg

SEQ ID NO: 1075 - DNA, 1795 bp, Brassica rapa
ttttttttttaattccttcctgagttttgagctatcatggtcggaagtttttttttcttttttttacagtgtatataatatacgagatgcttctaaaaataaagcttctttcttttttattttaaatccagctataagtcagattcttagttttttttttcaatctattaattaatctctcaacccttagtgtgttaagtaattaaacattaaggatttctcagcttcgagtcttttttaaaaaaattcaagacattttttccatagtttgcttctcttttgattaatatattgtgttatgtcaagtgcttaaattctttatcatcctaaaacattttcctaaagtctttgatcatataactgcaggtgagtatgttctgtgccaagaactctgttctgatgttatcaccatatgatctctaatggtgactatggtaacaccagactggtgaaattcactatttattgaatcaagaacacacacaacaggaggggtatatatagattatctttataaggtgtcacaaaatggaaaagaaacttacaaactctaataacatgtctctgataagaatgttaagaggtatcatatgtctgatggtgttggtttcaacagcttttatgatgttgattttctgggggttcatatcagctgtagtgatgaggcttttcagcttacactacagccgtaaatgtgtttctttcttctttggctcctggctcgccttgtggcctttcctctttgagaagatcaacagaaccaaagttatcttctctggggacaaggttccttgtgagtcacgagtgttgctcattgccaatcaccgaacagaggttgactggatgtacttctgggatcttgcactgcgtaaaggtcagattgggaatatgaagtatgtccttaagagcagtctgatgaagttgcctctgttcggttgggcgtttcacctctttgagtttatccccgttgagcggaaatggaaagtagatgaagcaaacttgaggcagatggtttccagtttcaaggatcctcgagatggtttatggcttggtcttttccccgagggcacagattacacagaggctaaatgcgaaaggagcaagaagtttgcagctgagaatggccttccagaactgaacaatgtgttgcttcccaagacaaaaggttttgtctcctgcttggaagaattggattcctcacttgatgcagtttatgatgtgaccatcggttacaaaacccgttgtccatctttcttagacaatgtctacggtactgaaccatcagaagttcacatccacatccgtcgtatcagccaaaaccaaatcccgaatcaggaaaaggaaatcaatgcttggttaatgaacacattccagctcaaagaccagctgctcagtgagttctactctcgtggccatttccctaacgaaggaacagaaaaagagttcagcacaataaagcaactcataaactgcttggcggtgattgtgttcacgatcatctgtacgcatctcaccttcttctcgtcgatgatctggttcaagatctatgtctctttggtctgtgcctacttgacctatgctactcatttcaatcttcgtcctgcgccacttgttgagactgcaaagaaaagctttcaaattagtaaaaaaatgaacttttaatgttatgccatttcgcatgatggaataatgtttttcttttagtatatattttgaggttaagactctatccaatttctacatgtgaaatgtgaactcaagctgcaataaatgaacttttactccatcttatatg

SEQ ID NO: 1076 - DNA, 1369 bp, Brassica napus
aatactgttctgatgttatcaccatatgatctctaatggtgactaatctatggtaacaccagattggtgaaattcaatatttattgaatcaagaacacacacaacaggagggggatatagattatctttaaggtgtcacaaaatggaaaagaaacttaaaaactctaataacctgtctctgataagaatgttaagaggtatcatatgtctgatggtgttggtttcaacagcttttatgatgttgattttctgggggttcctatcagctgtagtgatgaggcttttcagcttacactacagccgtaaatgtgtttatttcttctttggctcctggctcgccttgtggcctttcctctttgagaagatcaatagaaccaaagttatcttctcaggggataaggttccttgtgagtcacgagtgttgctcattgccaatcaccgaacagaggttgactggatgtacttctgggatcttgcactgcgtaaaggtcagattgggaatatgaagtatgtccttaagagcagtctgatgaagttgcctctgttcggttgggcgtttcacctctttgagtttatccccgttgagcggaaatggaaagtagatgaagcaaacttgaggcagatggtttccagttttaaggatcctcgagatggtttatggcttggtctttttcccgagggcacagattacacagaggctaaatgcgaaaggagcaagaagtttgcagctgagaatggccttccagaactgaacaatgtgttgcttcccaagacaaaaggttttgtctcctgcttggaagaattggattcctcacttgatgcagtttatgatgtgaccatcggttacaaaacccgttgtccgtctttcttagacaatgtctatggtactgaaccatcagaagttcacatccacatccgtcgaatcagccaaaacaatcccaaatgaagaaagaatcaatgcttggttaatgaacacattccagatcaaagaccagctgctcagtgagttctactctcgtggccatttccctaacgaaggaacagaaaaagagttcagcacaataaagcaactcataaactgcttggcggtgattgtgttcacgatcatctgcacgcatctcaccttcttctcgtcgatgatctggttcaagatatatgtctctttggtctgtgcctacttgacctatgctactcatttcaatcttcgtcctgcgcctcttgttgagactgcaaagaaaagcttctatagtaaaaaattgaacttttaatgttatgtcatttcgcatgatggaataatgtttttcttttagtatatattttgaggttaagactctatccaacttctacttatgaaatgtgaatccaagcc

SEQ ID NO: 1077 - DNA, 1401 bp, Brassica napus
aggtgagtatgttctgtgccaagcactctgttctgatgttatcaccatatgatctctaatagtgactatggtaaccccagattggtgaaattcactatttattgaatcaagaacatacacaacaggaggggtatatatagattatctttataaggtgtcacaaaatggaaaagaaacttacaaactctaataacatgtctctgataagaatgttaagaggtatcatatgtctgatggtgttggtttcaacagcttttatgatgttgattttctgggggttcctatcagctgtagtgatgaggcttttcagcttacactacagccgtaaatgtgtttatttcttctttggctcgtggctcgccttgtggcctttcctctttgagaagatcaacagaaccaaagttatcttctctggggataaggttccttgtgagtcacgagtgttgctcattgccaatcaccgaacagaggttgactggatgtacttctgggatcttgcactgcgtaaaggtcagattgggaatatgaagtatgtccttaagagcagtctgatgaagttgcctctgttcggttgggcgtttcacctctttgagtttatccccgttgagcggaaatggaaagtagatgaagcaaacttgaggcagatggtttccagttttaaggatcctcgagatggtttatggcttggtcttttccccgagggcacagattacacagaggcgaaacgcgaaaggagcaagaagtttgcagctgaaaatggtttacccatactgaacaacgtgttgcttcccaagacaaaaggtttcgtctcctgcttggaagaactgggttgctcacttgatgcagtttatgatgtgaccatcggttacaaaacccgttgtccgtctttcttagacaatgtctatggtactgaaccatcagaagttcacatccacatccgtcgaatcagccaaaaccaaatcccaaatgaagaaaaggaaatcagtgcttggttaatgaacacattccagatcaaagaccagctgctcagtgagttctactctcgtggccatttccctaacgaaggaacagaaaaagagttcagcacaataaagcaactgataaactgcttggcggtgattgtgttcacgatcatctgtacgcatctcaccttcttctcgtcgatgatctggttcaagatctatgtctctttggtctgtgcctacttgacctgtgctactcatttcaatcttcgtcctgcgccacttgttgagactgcaaagaaaagctttcaaattagtaaaaaaatgaacttttaatgttatgccatttcgcatgatggaataatgtttttctttttgtatatattttgaggttaagactctatccaatttctacttgtgaaatgtgaactcaagctgc

SEQ ID NO: 1078 - DNA, 2475 bp, Arabidopsis lyrata
gagatatcaatttcctttttctgggcctgtctctctctctttctccgaacgaaatcactgacctgacctgatctctctcttcctccttgtcggctgtaggtcttctccgggaagaaagcttcgaacccaattaacgccggacggtaaacggtgaccgactagtctccaaaagctcaagtcaatgagaaaatgctcttcaattttaacgttttagagatccatccatacccaacgagccgtgttttcgcattttcttgccgtggtttctcaccatcttcgtcgctatgtcaagatttctgatctctaggattgttggaaaacaaacgcaatctctattgtcgaaccagaaagagagagtgtcccaatggggaagctatagaactgcttttacagctgctctaaggtcgccgcaattcagaacttactcttcatctggtagggttccgagtaatgggtattgtatattggcctttagagatcttaaaggaagttttttgagtaagcatctgtcacgaagttattctactgtccctgcaagaaatgtagttagtcatcatgcccaagttgcttggaaaaggcttcattataagtattctgagcgtataagtactatggctcaggcgttcagcttgtctcttacccgttcacacttgttaatacctgggatcgttgctctcacttgtggacaagtagcttgggctcaaagagctcctggttcggggataaatcactatgcttcagataaatccctttatacaagggcgaagaatggtcctatctttctgtcttcgttattgttttcggttatagagggttttattttgattgggagggctttttatatagcttgtttgtttactcctagtattctgatggggctggttgtggaatcatgtgggcctcgttttaggaaaatttggcttcagatggtccatcgaactctggaaagagcaggtcctgcttttatcaaatggggtcaatgggcagccacacgaccagatctattccccaaggatttgtgtttacagctctcaaagcttcacagtaatgctcctgagcatagctttgcctacactaagaaaactatcgagaaggcatttggtcgtaaactctctgagatatttgaggagtttgaagaggtgccagtggcatcagggagtattgcccaagtacatagagcttctttaaggtttcagtatccaggacaaaagtccaagtcttcgttggttgctgttaaagttaggcatcccggtgttggtgaatctattaggagagattttgtgataattaatttggtggcaaaaatatcgactttaattccagctttgaaatggctaagattggacgagagtgtgcaacagtttggtgtcttcatgttgtctcaagttgatctcgcgagggaagcttcacatttgagtcggttcatatataacttccgtagatggaaggatgtctctttccctaaacctgtgtatccgcttgtacatcctgctgttttggtggagacatatgagcacggagaaagcgtggcacgttatgttgatggaatggaaggacatgaatggattaagactagattggctcatatcgggacccatgccctcttgaagatgctcttggttgataactttattcacgctgacatgcatccgggaaatatccttgtccggaaaaaggcttccggtggaggccttttcaaaacgaagaagcctcacattgttttccttgatgtgggaatgactgcggaactctcaaagaacgaccgagagaacttacttgattttttcaaggcggttgcgcgtagagatggccggactgctgctgaacgaacacttaaattatcaagaaagcagaattgtcccaatccagaggcttttatcgaggaagtagaggaggcattcaaattctggggaacccctgagggagatttagtacatccagcagattgtatgcacgaattacttgagaaagtaagacgtcatagagttaatattgatgggaatgtgtgcactgtgatggtgacaacattagttctcgagggttggcagcggaaacttgacccaggatatgatgtgatgcacacgttgcaaacaatggtgttgaaaaccgactgggctaagtctctttcttacacggtggatggtctgatggcgccgtaggagaagaaaggtcccatctttttgaaattttgtttgttatcatcataggagtcgaaacaatttacacatcttagatgagagaacatagaaagaaagtacatgttcttgtgatcctcttgtttatttttcattcttttgtcttttgctttttattgtcatggattttggttcattctaactacatagattgtatttacgcggttggtttccgttataaaccgcctgtttattctctgaaccaaagaacagtgaacaaaacaatgaaaaaagactgcctgagaatggcccagaggatatgaataaagtgtttacatcc

SEQ ID NO: 1079 - DNA, 2514 bp, Eutrema halophilum
gagacctccaatttcgcttttgtgggcctctctctctctctcctaacgaaatctccgacctgacctattctctctctctctccctccgtgtcggctttaggttttctccgggaggtattttcgaacccaaattaacgccgggaggaaaaacggtgaccgactaatccttgcccttgcccgcctaaagctgaagtcaatgagaaaatgctccttaagcttaacgttttagagatccatacccaacaatcggcgttttcacattttcttgcaccatcgccgccatgtcaagattttttatctttagaatcgtaggaaaacacacgcaatctcttttgtcgaaccagaaagagagagggtcccaatggggaagctatagaactgctattacagctgctctaaggtcgccccagttcagagtttactcgtcctctgctagacttccaagcaatgggcattgtacattttcccttcgagatcctaaaggaagctttttgaggaatcatctgtcgcgaagttattctacggcctctgcaagaaatgtagctactcatcatgctcaagtcgcttggaaaaggattcatcataagtgttccgtgcgccaatggagcttacctcgtataagtactattgctcaagcgttcaccttgtcgattacccgttcacacttgttaatacccggcatcgttgctctcacttgtggacaagtagcattggcgcaaagagctcccaattatgcgttagatccctacccttcacatcaatccctctatacaagggcaaagaatggtcccatctttctgtcttcgttgttgttttcggttatagagggttttattttgattgggagggctttttacatagcttgtttgtttactcctagtgttctgatgggtctggttgtggagtcatgtgggcctcgttttaggaaaatatggcttgagatggtccatcgaactctggaaagagcaggtcctgctttcattaaatggggtcaatgggcagccacgcgaccagatctcttccccaaggatttgtgttcacagctctcaaagcttcacagtaatgctcctgagcatagttttgcctacactaagaaaactatcgagaaggcatttggtcgtaaactttctgagatatttgaggagtttgaagaggcaccagtggcatccgggagtattgcccaagtacatagagcttctttgaggtttcagtatccaggacaaaagtccaagtcttcgttggttgctgtaaaagttagacatccgggtgttggtgaatcgattcgaagagattttgtgatcattaacttggtggcaaagatatcgacttttattccggctttgaaatggctgagattggacgagagtgtgcaacagtttggtgtcttcatgctgtctcaagttgatctcgcgagggaagcttctcatttgagtcggttcatatacaacttccgcagatggaaagatgtctcttttcctaaacctgtgtatccacttgtacatcctgctgttttggtggagacatatgagcacggagaaagcgtggcgcgttatgttgatggcatggaaggacatgaatggattaagactagattggctcatatcgggactcatgctctcttgaagatgctcttggttgataactttattcacgctgacatgcatccgggaaatatccttgtccggaaaaaggcttcacgtggaggccttttcaaagcgaagaagccacacatcgttttccttgatgtgggaatgactgcagaactctcaaagaacgaccgagagaacttacttgattttttcaaggcggttgcgcttagggatggccggactgctgctgagagaacacttaaattatcaagaaagcaaaattgtcccaatccagaagcttttatcgaggaagtagaagaagcatttaaattctggggaacacctgagggagatttagtacatccagcagattgcatgcatgaattacttgagaaagttagacgtcatagagttaatattgacgggaatgtatgcaccgtgatggtaacaacattagttctcgagggctggcaacggaaacttgatccaggatacgatgtgatgcacacgctgcaaacaatggtgctgaaaaccgactgggctaagtctctttcttacacggtggatggtctgatggcgccgtaggagaaagaaggtcccatctttgtcaaattttgtttgtcatcatcataggaggcgaagcattttttacacatcttagatgagacttgagagagcatagaaagaaagtacatgttcttttgttcctcttgtttaattttcattcttttctcttccttttgctttttgttattatggattttggttcattctaactacatagattgtatttagtcggttggttttcctatgttaaccgcccgtttgttctctgaaccgaaagaacaatgaacataaaacaagaaaaagactgcctgagaatggcacagagaatttgaataaagtgtttacatccatgtatttc

SEQ ID NO: 1080 - DNA, 2425 bp, Eutrema parvulum
aggttttctccgggaggtattttcgaacccaactaacgccgggaaggaaaaacggtgaccgactaatcctttgtccttgcccttgcccttgcccctaccaagtggaagtcaatgagaaaatgctccttaattttaacgttttagagatccatacccatcaagtgacgttttcgcatttttttgcattggtttcttctcaccatcgccgccatgtcgagattttttatctttagaatcgttggaaaacacacgcaatcacttttctcgaaccagaaagagagaagatcccaatggggaagctacagaactgctgtgacagttgctctaaggtcgtctcatttccgagtttactcttcctctgctagaattccgagtaatgggcattgtatatcttcccttcgtgatcttaaaggaagcgttttgagtaatcacctgtcacggcgttattatactaccgcctctgcaagaaatgtagttactcatcatgctcaagttgcttggaaaaggcttcatcgtaagtattctgtgcgccaatggaacttacctcgtataaataccattgctcaagcgttctgcttgtctctttcccgttcacacttgttaatacccggcatcgtcgctgtcacctgtggacaagtagcatgggcgcaaagagttcccagttctgcttcagatccctatccttcacataaatccctctatacaagggcaaagaacggtcctatctttctgacttcgctattgttttcggttatagagggttttattttaattgggagggctttttatatagcttgtttgtttactcctagtattctgatggggctggttgttgaagtatgtgggcctcgttttaggaaaatatggcttgagatggtccatcaaactcttgaaagagcaggtcctgctttcatcaaatggggtcaatgggcagccacgagaccagatctcttccccaaggatctgtgttcgcagctctcaaagcttcacagcaatgctcctgagcatagttttgcccacactaaaaaaactatcgagaaggcatttggtcgtaaactttctgagatatttgaggattttgaagaggcgccagtggcatcagggagtattgcccaagtacatagagcttctttgaggtttcagtatccagggcaaaagtccaagtcttcgttggttgctgttaaagttagacatccaggtgttggtgaatcgattagaagagattttgtgataatcaatttggtggcaaaaatatcgactttaattccggctttgaagtggttgaggttggacgagagtgtacaacagtttggtgtcttcatgctgtctcaagttgatcttgcgagggaagcttctcatttgagtcggttcatatacaacttccgcagatggaaagatgtctcttttcctaaacctgtgtatccacttgtacaccctgctgttttggtggagacatatgagcacggagaaagtgtggcacgttatgttgatggcatggacggacatgagtggattaagactagattggctcacatcgggactcatgctctcttgaagatgctcctggttgataactttattcacgctgacatgcatccgggaaatatccttgtccggaaaaaggcctctcgtggagttttcaaaacaaagaagccacacatcgttttccttgatgtgggaatgactgcagaactctcaaagaacgaccgagagaacttgcttgattttttcaaggcggttgcacgtagggatggccggactgctgctgagcgaacacttaaattatcaagaaagcaaaattgtcccaatccagaggcttttattgaggaagtagaagaagcattcaaattctggggaacccctgagggagatttagtacatccagcagattgcatgcacgaattacttgagaaagtaagacgtcatagagttaatattgacgggaatgtatgcaccgtgatggtgacaacattagttcttgagggctggcaacggaaacttgatccaggatacgatgtgatgcacacactgcaaacaatggtgctgaaaaccgactgggctaagtctctttcttacacggtggatggtctgatggcgccgtagaagaaggtttccatcacttttcaaattttgtttgtcatcataataggcgtcgacaaatttttacacatcttagatgagggaacatagaaagaaagtacatgttctcgatgttcctcttgtttatttttcattctttttgcttttttttgttatggatattggttcattctaactaatagattgtatttacgcggttggtttcctgtattaaccgcccgtttgttctctgaaccgaagaacagtgaacataaaataatgaaaaaaagactgcctgagaatggtccagcgaatttgaataaagtgtttacatccatgtatgcca

SEQ ID NO: 1081 - DNA, 3091 bp, Brassica rapa
ctctctctctctctctctcttcccttgtcggctttaggtttcttctccgggaggtattttcgaacccaaccaacgccggtgaccgacttaatcattaccctttcttgctcccaccaagtccaagtcaatgagaaaatgctccttattttaaacgtgttaaagatccaccatacccaacaacaacaagctacgtttcctcctcattctctcgcattggtttctcaccctcgccgccatgtcaagatttttaatctttagaatcgttggaaaacaaaaggaatatcttttattaaatcagaaagagagagcttcccaagctgctctaaggtcgcctcagttcagagtttacacttcctcctctaggattccgagtaatggactttgtaaaggaagctttttgagtaatcacctgtcgcgccgttgttgttctactactactactactgtctctgcaagaaatgtagtcactcatcatgctcaagttgcttggaacaggcttcaccgccaatggaacttacctcgcataaacaccattgctcaagctttctgcttgtctctcacccgttcacacctcttaatccccggcatcgctgccgtcacttgtggaaaagtagcatgggcggcgcaacgagctcccttagatccctatccttcgcataaatcactctacacaagggccaagaacggtcccatcttcctcacttcgttgttgttttcggttatagagggttttattttgatagggagagctttctacatagcttgtttgtttactcctagtgttctgatgggtctggttgttgaagtgtgtgggccacggtttaggaaagtgtggcttgagatggttcatcgaactcttgaacgagcaggtcctgctttcatcaaatggggtcaatgggcagctaccagaccagatctcttccctcaggatctatgctcccagctctcaaagcttcacagtgatgctcctcagcatagctttgcgtacaccaagaaaactatagagaaggcgtttggtcgtaaactctccgagatattcgaggagtttgaagaggcgccgttagcgtcagggagcattgctcaggtccacagagcttccttgaggtttcagtatccagggcaaaagtcaaagtcttctttagttgctgttaaagttagacatccaggcgtaggtgaatctataaggagagactttgtgataatcaacttcgtggcgagggtatcgactttggttcctgctttgaagtggctgagactggacgagagtgtgcagcagttcggtgtcttcatgctatctcaagtcgatctcgcgagggaagcttctcatttgagcaggttcatatacaacttcaggagatggaaagatgtttctttccctaaacctgtgtatccgcttgtgcaccctgctgttctggtggagacttatgagcacggagagagcgtggcgcgttacgttgatggcgtggaaggacatgagtggattaaaactagattagctcacattgggactcatgctctcttgaagatgctcctggttgataactttattcacgctgacatgcatccggggaacatccttgtccggaaaaaggcttctcgtggaggtcttttcaaaacgaagaagccacatatcgttttccttgacgtggggatgactgcagagctatcaaagaacgacagagagaacttgcttgatttcttcaaggcggttgcgcttagagatggcaggactgctgctgagcgaacgcttaagttatctagaaagcagaactgccccaatccagaggcttttattgaggaagtagaagaagcattcaagttctggggaaccgctgagggagacttagtgcatccagcagattgtatgcacgagttacttgagaaagtaaggcgccatagagttaatattgatgggaatgtatgcaccgtgatggtgacaacactagttctcgagggttggcaacggaagcttgatccaggatatgatgtgatgcacacgctgcaaacaatggtgctgaaaaccgactgggctaagtctctttcttatacggtggatggtctgatggcaccgtaggagaataaaaggtttcaatctttttttttcaaatgttgtttgtcatcataataggagtcgacaggttttacacatcttagatgaaagaacatagaaagaaagtacatgttcttgtttatttttcattctttttttaatctcctttttttctttttgttggtatggattttggttcattctaactccatcatagatttgtatttacgcggttgatgtcctgtattaaccgcctgtttgttctcttaaccgaagaacagtgaacataaaacaattagaaggactgcctgtgaatggtccagagaatttgaataaagtgttcacgtccatgtacatctctctgcctatctatctagttgtcttgtacaccttgtggtttttctgattttattttgacaacagtataacagaaccgaaccagaacaaaatgcctgacaacgtattgtttctgttgtatagtttcgtttctttttgcagcttaaaatatctaaactctagttcagaaactgaattgacgcatatcttctctgtaacttacaacggtatctatgaccatcatcatcaaatatattatcatacaaataggtggctatatatacagataactggcactggtacacactattagcatacaagtgggttctcaatgtttctcctttcaaatagaacttccatgtttgctctataccacagtttcgaaaagacaaacatgaaagttatcttctgacatgattatgcgtcaatggtgaacacaccacagctgatgatgatacagagcttgtctcagtatactctcgtctacgttgggtttttagggttcagatgacattgttgatacaataactggaggagaatgcagctcaagcaaagattttccttcgggatagccgcctatgcatagcgtgtctcctcgaccatgccagataccgtcatgtacattgtttatctccagtgttttcgacacctgagttaatgtacaaaacggacacataagatggtggatgcaatcgtcaaagaaat

SEQ ID NO: 1082 - DNA, 2628 bp, Brassica rapa
ctgagacataaatctacacgatatagctctgcaccctacctttacctttcaaatttgacaattttattacaaaacataaacataatctgatttggttatgagagaaatgtttcggacaggctgtgtttgcttcacgtcattgcttaggttgacaatgtcacacgtcgaccaaaaatcaaatttagcattaatcctaagcccaaagatcttacttttgttgtgggcctccctttctctctctctttcctgacctattctctctctctctctctctgtgttcgcgtcggctttaggtcttctccgggaggtactttcgaaacccaattaacgccgggagacaacaacggtgaccctcttatcctttgccctttcacccaccaagtggaagccaatgagaaaatgctccttaatcttaacgttctagagatccatcaagctacctttgtttctcaccatcgccaccgccatgtcaagatttttcatctatagactcgttggcaaacacactcaatctcttttctctaaccacaaagagacaagatcccaatggggaagctttaaaactgctctgaggtctcctcagttcagagttcactcttcctccgctggttattgtacaaccgtctctgcgagaaatgtagttactcatactcaccatgctcaagttgcttggaacaggctccttcaccgacaatggaacttacctcgtatcaacaccattgctcaagccttctgcttgtctctctcccttcgttcacacctcttaatacccggcatcgcagccgtcacttgtggaaagctagcgtgggcgcagaagaagagagctccccccttagatccatacccttctcataaatcactctacacaagagcaaagaacggtcccatctttataacctcgctgatactttcccttatagagttcttcattttaatcgggagagctttctacatatcttgtttgtttactcctagtatcttgatgggcctagtcgtcgagctatgcgggcctcggttcaggaaactatggctagagacggtccaccgaactctcgagagagcgggtcccgctttcatcaaatggggtcaatgggcagctactagaccagacctcttccccaaggatctctgcacgcagctctctaagcttcacagcgacgctcctcagcatagcttcgcctacactaagaagaccatagagaaagcctttggccgtaagctctcggagatattcgaggagtttgaagaggctccattggcgtcagggagcattgctcaagtccatagagcttctctgaggtttcagtatccaggacagaagtcaaagtcttctctggttgctgttaaagttaggcatccaggcgttggtgaatctattagaagagattttgtgataatcaatttcgtggcgagggtgtctactttggtcccggctttgaagtggctgaggctggacgagagtgtgcagcagtttggtgtgtttatgctctctcaagtcgatctcgcaagagaagcttctcatttgagtaggtttatatacaacttcaggagatggaaagatgtttctttccctaaacctgtgtatcctctcgttcaccctgcggttttggttgagacgtatgagcatggagagagcgtggcgggttatgttgacggcatggagggacatgagtggatcaagactaggttggctcatattgggactcatgctctcttgaagatgctcctggttgataactttattcacgctgacatgcatccggggaatattcttgttcggaagaaggcttctcgtggagtgttcaagacgaagaagccgcacattgttttccttgatgtgggaatgactgcagagctctctaagaatgatagagagaacttacttgattttttcaaggcggttgcgcttagagatggcaggactgctgctgagaggacgcttaagttgtcaaggaagcagaattgtcctaatccagaggctttcattgaggaagtggaagaagcgttcaaattctggggaactcctgagggagatttagtgcatccagcagattgcatgcatgagttacttgagaaagtaagacgtcatagagttaatattgacgggaatgtgtgcactgtgatggtcacaacattagttctcgagggttggcaaaggaaacttgatccaggatacgatgtgatgcacacgctgcaaacaatggtgttgaaaaccgactgggctaagtctctttcttacacggtggatggtctgatggcaccgtaggagaagaaaggtttccatctttttttaaagttttgtttgtcatcataataggagtcgacaaattttacaaatcttagatgagggaacatagaaagaaagtatatgttcttgatggtcttgtttatttctctattattatttttttcttcttctttttgttgttaaggattttggttcattctaactacatagattgtatttaagcggtcggttacctgtattaaccgcccgtttgttctctgaactgaagaacagtgaacataaaacaatgaaaacttctgcctgagaatgatggtgcaaagaatttgaataaagtgttctctttgtatatatctctgtgtatcaatctgtcttgttccctt

SEQ ID NO: 1083 - DNA, 1441 bp, Arabidopsis lyrata
agagattcaagaaaacccaaaaaacaaaacactttagatttttttttttggttgaatcgaatctgttttttttcaacttcaaactttttttttccctccgttcaatatatcattgaacttacaacaaaatcatatgtttctgtggcaatttgtgtctttcatgcttgttatttgatggataacatcaactttgaattctcaaacgcttcacaagaaagccggctacagtcgcagccgtttaatttacaagatttgaatatgattcaatacaatcaaccaccatctccttggactaccgaaaccttctctggtctttctccgtacgattgcactgccaatcaatcttttcccgtacaatgttcatcttcaaaaccctacccttcctcgtttcatccgtaccatcatcaatcttctgatcctccatcattagaccaatctgtatcgatgcttcctatgcagcctcttccggatcaatatttgaaaccattctatcaaagatcatgcgcgaatgatttcgccgcaacaaatgcatcatcagcctcatactcgctttcttttgaagcaaatcatgatccacaagaactatgcaggaggacctatagtagttctaatgtaacacatctgaatttctcatcattacaacctaaacaaaatcatccaagattttcttctcctccttcattctcaacccatggagggtcggtggctcctaactgtgtgaacaagacacggataagatggactcaagatcttcatgagaagtttgtggagtgcgttaatcgcattggtggtgctgataaggcaacgcccaaggcgatattgaagttgatggattctgatggactcacaatatttcatgttaaaagccacttacagaagtatagaattgcgaaatacatgcccgagtctcaagaaggcaagtttgagaaaagagcttgtgcgaaagagctgtctcagcttgacacaagaactggagtgcaaattaaagaggcacttcagcttcaactagatgttcagaggcatcttcatgaacaactagagattcaacgaaacctacaactaagaatcgaagaacaagggaaacaactgaaaatgatgatggaacaacaacaaaaaacgaaaaagagtcttctaaagccaccagacgctgaagcatcattgtgtcttctcgcttccgatgactctcctccttcgcctttcttggtacaagacactgaagccttgatgctaacaagttatgaagacactcaactccagtcaaagataagttgaaaaaatgagagagtaatggctaaatagaaaaggcctaaagcatgtttctactctattcaaagtggtgtaaagttataagagtcgcgacaagagaatgtccaaagtgctgctacacacactaacacttgagaacagaatcaggtactaaatgtgagcaagtggtgtgtga

SEQ ID NO: 1084 - DNA, 1652 bp, Eutrema parvulum
ccctcttgcacctgaagactttggaggaatgtgaagagattccacaaaaccaaaaaacactttagatttcatttcgatcgttattcctccgattctttttttcatttttttttcaaactgctaacttttttgccttgctttcaatatatctagaacgtgcaacaagatcatatgtttctgatgcaaacctggcaaccttggtctgtcttgtttgttctttgatggataacatcaactttgaatcatcaaccgcttcacaaggaagcccactacagttgcagtcgcagccgcaaccgccccagccgtttaatttacaagacatgaatatgatccattacaaccaatcatctccatggactaacgagactttctcgggttttactccatacgattgcacagcgaatcaatctttctccgtacaatgttcatcttcaaaaccctatcctgcctcgtttcatccgcaccatcatcaatctttggatcctccatcactagaccaatcacaatcgatggttcttatgcaacctcttcctgatccatatttgaagccattatatcaaagatcatgcgcgcacgattttgccgcaacaaatgcttcatcagcctcatactctctttcttttgaagcaagtcaagatccacaagaactatgcaggaggacctatagtaattctaatgtaacagaattgaatttctcatcatcacatcatcatcaacctaagcaaactcatccaagattttcttctccaccttccttctcaacccatggagggtccatggctcctaattgtggtacggttatcgggaacaagacacggataaggtggactcaggatcttcatgagaagttcgtggagtgcgtaaattgccttggtggtgctgataaggcaacgcccaaggcgatactgaagctgatggattctgatggactcacaatatttcatgttaaaagccacttacagaagtataggattgcgaaatacatccctgactctcaagaaggcaagtttgagaagagatcttgttccaaagatctgtctcagcttgacacaaaaactggagtgcaaattaaagaggcactcaagcttcaactagatgttcagaggcatcttcatgaacaactagagattcaacgaaacctacaactgagaatcgaggaacaagggaagcaattgaaaagaatgatagaacaacaacaaaaaacgaaagagtgtcttctgaagacaccaaacgccgaagcatcattgtccctctccgaccactcttctccgcctttctcagtacaagacgccgaagcacttatgctaacaagtgagacactcaattccaatcaaagataagctgaataatgagagattggctaaatagaaaaggcctaaagcatgtttttactctattcaaagtggtataaagttatgagagtcgcgacaagagaatgtccaaagtgctacacacactaacacttggaaacagaatcaggtactaaatgtgtgcaagtggtgtgtgatggggtctcagtcatatactaatagatgtgtgagattattcttaattaactatttgtttttttaaatcacacaaagagatagcttcttaaattagtaacgttacttttaacattttacatgaggagatccacgtcttattctttt

SEQ ID NO: 1085 - DNA, 1725 bp, Eutrema halophilum
ccctcttgcacctgaagactttggaggaatgtaaagagattccagaaaactcaaaaaccaaaaaaacaaaacactttagatttcatttcgatcgttattcctccgattattttttgttttttgtttagtcgaatcttctcatttttttcttatattttttttccaacttcgaacttattttagtttcttccgtttaatatatcattgaacgtgcaacaagatcatatgtttctgatgcaaaactggcaatccgggtctctcttgtttgttctttgatggataacataaactttgaattctcaaacgcctcacaaggaagccggctacaatcgcagccgcaaccgccccagccgtttaacttacaagacgtgaatatgatccattacaatcaatcatctccatggactaccgaaactttctctgattttactccatacgactgcacagccaatccatctttctccggacaatgttcattatcaaagccctatccttcctcgttgcatccataccatcatcaatcttccgatcctccatccttggaccaatccgaatcgatggttcctatgcagcctcttccggatcgatacttaaagccattatatcaaagatcatgcgccaacgatttcgccgcagcaaatgcttcatcagcctcatactcgctttcttttgaagcaagtcaagattcacaaggactatgtaggagtacctatagtaattctaatgtaacacaactgaatttctcatcgtcacatcatcaacctaaacaaactcatccaagattttcctctcctccttccttctcaacccatggatcagggtccatggctcctaactgtgggacgataaccgggaacaagacacggataagatggactcaagatcttcatgagaagttcgtggagtgcgtgaatcgccttggtggtgctgacaaggcaacgcccaaggcgatactgaagctgatggattctgaaggactcacaatatttcatgttaaaagccacttacagaagtataggattgcgaaatacatccctgattctgaagaaggcaagtttgagaagagagcttgtgccaaagagctgtctcagcttgacacaaaaactggagtgcaaattaaagaggcactccagcttcaactggatgttcagaggcatcttcacgaacaattagagattcaacgcaacctacaactgcgaatcgaagaacaagggaaacaattgaaaataatgatagaacaacaacaaaaaacaaaagagagtcttctgaaaacgccaaacaccgaagcatcattgcctctctcagctcccgatcactctccaccgcctgtctccatacaagaccccgaagccctgatgctaacaaactatggagacgctctactccattcaaagataggttgaaaaagaagagattggttaactagaaaagtcctaaagcatgtttcaattcttactctattcaaagtggtataaagttataagcgtcgcgacaagagaatggacaaagtgctacacacactaacacttgggagcagaatcaggtactaaatgtgggcaagtggtgtgtgatggggtctcagtcatagactaatagatgtgtgagattattctcattaatatttgttttattaaaaaactcacatagagagatagcttcttagattagtaacgttgctttttaacattgtgcatgaggaaccccacgttttatttctttcttttt

SEQ ID NO: 1086 - DNA, 2044 bp, Secale cereale
gactctcctaaaaccccaatcttgtcggcttacgcgccctcatttccgtccccctcccttctccgccggcgcctcctcctcctccttcccaccccacgccgcgctagggcttatcaaaaccccccaggtgcgggcggtttatgcgcctcgggcggtggtgaatcttgctgcctgcgaggaggatgcaggccaccgggagcgtgacttgggtcgtcggtgcccaggcgtctgtcttggggagatgcagcggcgggttgccctacccttcgtcgtcgtcgtcttctgcttcctctggtaggtcccaggggctcggcacggtgcggtgctccgtgcaggcgcaggagaagaagccacgggtgaggaagactaaggaggagcggagggagatggtcgagtccttcgtcggcacgtatcgggtttcaaacaacgggaaatttccttcagtcaatcttacacacaaggaagttggaggatcatattatatagtccgtgaaattatgagagatatcatccaagagaacagagttcttggccctggtgacttgaatgctaagacattgagttttgaggattgccctgattcttcagaattatcaaataggcatgaattgggccaaggcaacatagagatattagatatgtctaatgggtatcttggcaacaaagattctgtgttggaaacgtctgacaaggatgaaacattttcattgcaaacgaatttcatcagcactcaacagttactgacttcatctgatatcttggaatctggtattctgaacagtgtactccaaaatgggaatgtagcagatgcaacatgcttggagctaaaccttgagaaacaagacgaagccttgcgtgggcaaccaagggagtctcagactaatagctctgagatgcaagccccatctcttgctcatgtttctgatttgcataaggaaaatgagctcaacaaggcaggggatgagcatggtgaaacaaccagtagcgtcactgatgaagtcactctttccccagaacatagtgttgtttctctaacaaacggtgcacttttacatgagcatgtgacatcacctgacgattgtggtgtcacaactaatactgctgttgatgaggctattgtttgctcagataataatggcgttcttcagacagatcagatccttatacaggagcatgagatagtacctgaaacagcaagtatcaagacagaagttgttcagattgcagatggccaatttagatctgcaacacctgcagctcaaacggatgcttataccttaaatacaagtgcagcaacaatagaatcagctgtgttcattgatcatcatgacgtggttgagcaaccactgcttggtgccagccctaacaaacaacggaagccagaagatcttgcctctcgaccagcaatggatacaaagggttttctgcaaaaggaagacaaccacaacacgctagagaaagatgaaagtgaattcaagaaatcagtatctggcatcacagacgaagagcgtgaggcaagcaaggctaatcatgaacaagggataactgcgacaacaacgatcagcaggagaactggtaagggacagcagaagaaagaggacaacctattttggcttatcgtaagggcatttgttgtttctatgtccaagttgtgggcaaaatgagtgatgggcgaaatgcatcttcatctggtactgcctgggatgtcttcctgcctactaggaaacgagaagcggtttgcgaagctccaatctccctgatgcatatagatgttcttcttgcgcagcactttgggtgttttgttatgcttggtttagtttatagcctacttttgtagttcagatgtatcgtttggtcaacttggtctgctgtgtcaagttgacactgccaactctagagaagtactcaggagtttcttattctgtaggagcaagatctgtcttgagctctgaaagcagcagtttgtacattcaccgatttaatcgagcatgaatgatttctgttgatttttctgcaattatggaagcttgttccttccgtcaca

SEQ ID NO: 1087 - DNA, 1729 bp, Triticum aestivum
ccacgggtgaggaagaccaaggaggagcggagggagatggtcgagtccttcgttgacacgtatcgggtttcaaacaacgggaaatttccttcagtcaatcttacacacaaggaagttggaggatcatattatatagtccgtgaaattatgagagatatcatccaagagaacagagttcttggccctggtgacttgaatgctaagacgttgagttttgaggattgccctgattcttcagaattatcaaataggcatgaattgggccaagacaacatagagatattagatatgtctgatgggtatcatggcaacaaagattatgtgctggaaatgtctgacaaggatgaagcattttcattgcaaacgaatttcatcagcactcaacagttactgacctcatctgatatcttggaatctggtattctgaacagtgtactccaaaatgggaatgtagcagatgcaacatgcttggagccaaaccttgagaaacaagacgaagcctttcgtgggaaaccaagtgagtctcagactaatagttctgagatgcaagccccatctcttgctcatgtttctgatttgcataaggaaattgagctcaacaatgcaggggatgagcatgaggaaacaaccagtagcatcactgatgaagtcactctttccccagaacctagtgttgtttctcaaacaaatggtgcacttctacatgagcatgtgacttcacctgatgattgtggtgtcacaactaatacttctgttgatgaggctattgtttactcagaaaataatggcgttcttcagacagatcggatccttatacaggagcatgagatagtacctgaaacagcaagtatcaagacagaagttgttcagattgcagatggccaatttagatctgcaacacctgcaactcaaatggatgcttatacctcgaatacaagtgcagcaacaatagaatcagctgtgtccattgatcatcatgatgtggttgagcaaccactgcttggtgccagccctaacgaacaacgaaagtcagaagatcttgcctctcgaccagcaatggatacaaagggttttctgcaaaaggaatacaaccacaacacggtagagaaagatgtaagtgaattcaagaaatcagtatctggcatcacagaggaagagcgtgaggcaagcaaggctaatcatgaacatgggataagtgcgacaacaacgatcagcaggagaactgggaagggacagcagaagaaagaggacaacctattttggcttatcgtaagggcatttgttgtttctatgtccaagttgtgggcaaaatgagtgatgggcgaaatgcatcttcatctggtactgcctgggatgtcttcctgcctactaggaaacgagaagcgcctttgcggagctccgatctccctgatgcatatagatgtcttcttgcgcagcactttgggtgttttgttatgcttggtttagtttatagcctatttttgtagttcagatgtatcgtttggtcaacttgctctgctgtgtcaagttgacactgccaactctagagaagtactcaggagtttcttattttgtaggagtataagatctgtcttgagctctgaaagaagcagttcgtacattcaccgatttaatcgagcatggatgatttcctgttaagacttttctgcaattattatggaagcttgttccttccccgtcacagcgagcagcgtttagcaaccgcctc

SEQ ID NO: 1088 - DNA, 1784 bp, Secale cereale
agcagcgagggggttcgccgagtccacggcggagatgctgcgggagctggggctcggcgtgtgggacgtcgccgcgcagagcctcgcgggcgccgaggacagcgagctcgcgcggcggctccggcggccggcggcggccgcgggcaagcgcctcagcttcatgaacgagtacctccccgaggaccgcgaccccgtcaggtgctgggtcgtcgttgccgccgtcgcattcgtcgcgctcctcgtattaggtgtaggaagtagtgatgataccccagtggagcaaccgaagaaactttacataagccccccaaatgctaaaagattccaacttcctgatggacgacatctggcttacgaagaaaaaggaatttcagctgacagggcaagattttcactggttgctccccattcatttctttcgtcaaggctagcaggaattcctggaatcagctcatctcttctagaggaatttggggcacgacttgtgacctatgatcttcctggttttggtgaaagtgatcctcatccaggccgaaatctgaattcttctgcattagacatgcttcacttggccgatgcccttgggattgtggacaagttctgggttgtaggctattctggaggtggcatgcatgcttggagtgctctgcgctacattcctgaccgggtggcaggtgcagcaatgttcgcccctatggcaaatccatatgactccaagatgaccaaggatgagaaacgtaaaatatgggacaggtggtcaactaaacgaaaactaatgcacattttagctcggaggttcccatcactattacgcctcttctatcaccgaagcttcctttctggaaagcaaggacagcctgagagttggttatcattgtcaatgggaaagaaggacaaaactttactggaagctcctacattcagcgcattttgggaaaaggatgttgcagagtctgtacgccagggagatgtgcagccatttgtcgaggaagctgtgctgcaagtatctgattggggtttcagcttgtcagacattcaaatgcagaagaaagaggatcagggagtatttgaatttatcaagtctctgttcagtcaggctgaacgagagtgggtgggatttctgggcccaatccacatttggcagggaatggatgaccgggtggtgcccccgtcggcgaccgagtttgcccggaggatggttccaggagccactgtccacaagcttctggacgaaggccacttctcatacttctgtttctgcgacgagtgccaccggcagatattctccaccctgtttggcaccccgcagggccctctcaatcctgcaccggaatccagtgaagtggccctcgaaccgacggaagaaacaatccctgcatatgaagaagctgcagaacaggagcaggaaacatcaggcctggcctgatatcatattcagcctcaggatcaagagtatagatacaagagtacaagaagatgttactagtaggaagctcaaagaaaagataggcttttccttccttgccgccagtggagaaatgctgaccgataggtggactgagtagagagccgagtataaaacgaagctctgggtctggggtctggatggggggctgcactgattgtgctggttcagtataatgtacagaaaagccttgaaagttctgcaaaagaaatcacctgcttgatgcgcctctagcgcgactctctcgatattggcattcgattggccttgtgatgacgcggcgcccttgcatacctattctgcacatttgcttactatg

SEQ ID NO: 1089 - DNA, 1304 bp, Triticum aestivum
ccctttccgatggcctccacgtcgtcgtctccgctctctcttgtcctcctccggccgctcccatgcagatccctcctcctctcaaagcacaggaagccatttcccaccccaagaaccggccgcctggcagcttcagcagcagcaggagctcagcagcggttgctgcggccgccggagaccggccgctggagcaggagctcgaggagcggcagagacttcgcgtgcttatcctacaacaacccgcccccgccttccaataaggattcgaacgagtggcccatccttcgccggtgggatgtgccatgggagtggcaaactgttgtgctcagcatggtgggctgtggagtaagctttgctctgacaggattggttgagcagtcgatattgcaatacgtagggttttcagccacgggggcaactatagatgagaaggcagaaatactgttcctcggacaacttagcgtgactgctgttgtgcttggtgttatatttagcatcaccaataccttccgaccattccctgatgatgtcttccgttacgatgtcaaagaaccattcaagctgcaaaatggctggcttctgtgggctggtattggcctctttggtgcagtcatttccattgctttagttggagctgccatgacctatctgaatggtgcacctccagagagagagaaggactcactggtccttttactgcccctaattggctcatcaactctcagcactgcctatttggtgggaataactggagttctagcaccaattctggaggagactgtgttccgaggatttctaatggtgtccttgactaagtggtttcctactccagtctgcgtgattctcagtgctgctgtatttgccttcgcccatttgacacctgatcaattcccacaactgtttgtacttggtgttgcactggggtttacatatgctcaaactcgcaatcttctagctcctattacaatacatgcattttggaactcgggagttatactactgctaacctttcttcagttgcaaggatacgatatcaaggagctattgggggcgtcttgaagtctttataaccgtccggattttagctttgtgcatatccttgagtaacttctgcaaaaagatctggaagaacaatgagctttcctttattcgactgcttagtgtatgatcttactcggcaaggcacacaatgtatggtctacaagatgtcttacaaaatatgattatgtatggttcgtttcatactactgccaacctacgtggtggaaaatgttcaatcatacaaatagaaaatacggttattg

SEQ ID NO: 1090 - DNA, 1480 bp, Triticum aestivum
cagcgagcagagagagcagaggagtgagaagcgcgcgccctttccgatggcctccacgtcgtcgtctccgctctctcttgtcctcctccggccgctcccatgcagatccctcctcctctcaaagcacaggaagccatttcccaccccaagaaccggccgcctggcagcttcagcagcagcaggagctcagcagcggttgctgcggccgccggagaccggccgctggagcaggagctcgaggagcggcagagacttcgcgtgcttatcctacaacaacccgcccccgccttccaataaggattcgaacgagtggcccatccttcgccggtgggatgtgccatgggagtggcaaactgttgtgctcagcatggtgggctgtggagtaagctttgctctgacaggattggttgagcagtcgatattgcaatacgtagggttttcagccacgggggcaactatagatgagaaggcagaaatactgttcctcggacaacttagcgtgactgctgttgtgcttggtgttatatttagcatcaccaataccttccgaccattccctgatgatgtcttccgttacgatgtcaaagaaccattcaagctgcaaaatggctggcttctgtgggctggtattggcctctttggtgcagtcatttccattgctttagttggagctgccatgacctatctgaatggtgcacctccagagagagagaaggactcactggtccttttactgcccctaattggctcatcaactctcagcactgcctatttggtgggaataactggagttctagcaccaattctggaggagactgtgttccgaggatttctaatggtgtccttgactaagtggtttcctactccagtctgcgtgattctcagtgctgctgtatttgccttcgctcatttgacacctgatcaattcccacaactgtttgtacttggtgttgcactggggtttacatatgctcaaactcgcaatcttctagctcctattacaatacatgcattttggaactcgggagttatactactgctaacctttcttcagttgcaaggatacgatatcaaggagctattgggggcgtcttgaagtctttataaccgtccagattttagctttgtgcatatccttgagtaacttctgcaaaaagatctggaagaacaatgagctttcctttattcgactgcttagtgtatgatcttactcggtaaggcacgcaatgtatggtctacaagatgtcttacaaaatatgattatgtatggttcgtttcatactactgccaacctacgtggtggaaaatgttcaatcatacaaatagaaaatacggttattgctataagaaatgcgttgtacgtggctttcaggttggctcaagtaatggttcttccttgcaagtgggcaatggatgttcataccatgctaggtgcattaagtaaaacttataccaataaatctatctcactggcattttc

SEQ ID NO: 1091 - DNA, 1497 bp, Secale cereale
cagcgagcagagagagcagaggagtaagaagcgccccccctttccgatggcctccacgtcgttgtctccgctctctcttgtcctcctccggccgctcccatgcagatccctcctcctatccaagcacaggagaccatttcccaccccaagaactggccgcctggcagcttcagcagcagcaggagctcagcagcggttgctgcggccgccggagaccggccggtggagcaggagctcgaggagcggcagagacttcgcgtgcttatcctacaacaatccgccccggattccaataaggactcgagcgagtggcccatccttcgccggtgggatgtgccatgggagtggcaaactgttgtgctcagcatggtgggctgtggagtaagctttgctctgacaggattggttgagcagtcgatattgcaatacgtagggttttcagccgcgggggcaactatagatgagaaggcaggaatactgttcctcggacaacttagcgtgactgctgttgtgcttggtgttatatttagcatcaccaataccttccgaccattccctgatgatgtcttccgttacgatgttaaagaaccattcaagctgcaaaatggctggcttctgtgggctggtattggcctctttggtgcagtcatttccattgctttagttggaactgccatgacctatctgaatggtgcacctccagagagagagaaggactcactggtccttttactgccactaattggctcatcaactctcagcactgcctatttggtggggattactggagttctagcaccaattctggaggagactgtgttccgaggatttctaatggtgtccttgactaaatggtttcctactccagtctgcgtgattctcagtgctgctgtatttgccttcgctcatttgacacctgatcaattcccacaactgtttgtacttggtgttgcactggggtttacatatgctcaaactcgcaatcttctagctcctattacaatacatgcattttggaactcgggagttatagtactgctaacctttcttcagttgcaagggtacgatatcaaagagctgttgggggcatcttgaaggctttatcataaccgaccggattttagctttgtgcatatccttgagtaacttccgcaaaaagatttggaagaacaatgagctttcatttattcgactgcttagtgtatgatcttactgggtaaggcacgcaatgtatggtctataagatgtctcacagaatatgattgtatatggttcctttcatactactgccaacctacgtggtggaaattgttcaatcatacaaatagacaatacagttattgctataagaaatgcattgtacttgtatgtagctttcaggttggctcaactgttcttccttgcaagtgggcaatggatgttcatatcatgctaggtccattaagtaaaacttgtaccaataaatctatctcactgggattttcagttatttttttc

SEQ ID NO: 1092 - DNA, 1515 bp, Avena sativa
agcgtctctgatggcctccacgtcgtcgtccccgctctctcttctcctcctccggccgctcccatgcagatccctcctcctatccaagcacaggaagccacttcgctccccaagaactggccgcctagcagcttcaacagcagcaggagctcagcagtggtcggtgcggccgccggagaccggccggtggaggaggagcggtggaggcttcgtctgcgcctcctacaacaatccacctccgccttccagtaaggattcagacgagtggcccgtccttcgccggtgggatgtgccatgggagtggcaaacccttgtgctcagcatggtgggctgtggagtaagctttgctctgacaggactggttgagcagacggtactgcaatacgtagggtattcagctgcgggggcaagtatagatgagaaggcaggaatactctttctgggacaacttagcgtgacggctattgtgcttggtgtcatatttagcatcaccaatacctttcgaccgttccctgatgatatcttccgttacgatattaaagaaccattcaagctgagaaatggctggcttctgtgggctggtattggcctctttggtgcagtcatttctattgcattggttggagctgccatgtcctatctgaatggtcaacctccagagagagagaaggactcactggtccttctactgccactaattggctcatcaaccctcagcactgcctatttagtgggcataactggagttctagcaccaattctggaggagactgtgtttcgaggatttctaatggtgtccttgactaagtggtttcctactccagtctgtgtggttctcagtgctgctgtatttgccttcgctcatttgacacctgatcaattcccacaactgtttgtacttggtgttgcactagggtttacatatgctcaaactcgcaatcttctggctcctattacaatacatgcattttggaactcgggggttattttactgcttacgtttcttcagttgcaagggtatgatatcaaggagctcttgggggcatcttgaaggctttaaccgatcagctttagctttgtgcatatccttcagtaacttcagaaaagaggcctggaaaagaacaatgagctctcatttattctactgtttaatgtttggcatctactgtccaagtaggcaattttatgttccctgaagccctaaagtaagctgttaggaaagtaacagcattatattttactgtaatgatctaacttaagggctaaggctatgcaaaacagaagttcctacaacatattatctggataatacatgcactgtatggcataagataagatgtcttgcggacataggattgtatatggttgagcctacctggcgtaatggatgttcacattttgctagattgagtaaccttgtacctatctatctcactgggttttatctgttttctttcctatggatacatactgtgtgaatggaggaattgcaaatatgctccaacttgttctttc

SEQ ID NO: 1093 - DNA, 1363 bp, Brachypodium distachyon
ctacagcgagcagagaaggaaacgaaagaagcgtgttctcaacttctcatggcctgttcgtcgtcttcgtctccgctctctcttcttctcctccggcctctcccacgcatacccctcatccattccaggcacaggaagccattccctttcccaagaactggccgcatagcagcttcagcggcagcaagagctcagcagcggttgctgcggccgcgggagaccggccggtggaggagaagcttgaggagcggaggaggcttcgtgtgcttatcctacagtaacccgcccccgccttccaataaggattcggatgagtggcctgtccttcgccggtgggatgtgccatgggagtggcaaaccgttgtgctcaccatggtgggctgtggagtaagctttgctctgacaggattggttgagcagtcggtgttgcaatacgcagggtataaagctgcaggggcaactatagatgagaaggcagaaatactctttctcgggcaacttagcgtgacagcagttctgcttggtgttatatttagcatcaccaataccttccgaccattcccggatgatatctttcgttatgatattaaagaaccattcaaactaagaaatggctggcttctgtgggctggtattggtctctttggtgcagtcatttccatagctctagttggagctgccatgacctatctgaatggtgaacctccagagagagagaaggactcactggttcttttactgccactaattggctcgtcaactctcagcactgcctatttggtgggtattactggagttctagcaccaattctggaggagactgtgtttcgaggatttctaatggtgtccttgactaagtggtttcctactccagtatgtgtggtgttcagtgctgctgtatttgcctttgctcatctgactcctgatcaatttccgcagctgtttgtacttggtgttgcactagggtttacatatgctcaaactcgcaatcttctagctcctattacaatacatgcattttggaactcaggagttatattactgctaacttttcttcagttgcaagggtatgatatcaaggagctcctgggggcatcttgaagacttcaactgatcagcttttggctttgtgtatatccttcggtaacttcagccaaaaaaacgaaatgactaatgatctctatttttactgtttaatgatcgatatttacggtgcaagtaagcaattttatgtacccttacaataagttgtcacataatttgtatgtatccttgcactaacttttatgtactggtccagctaattcatgttgtgtatatgaaatcagcgtcctccgatggcgcttcctctggcaacatgttt

SEQ ID NO: 1094 - DNA, 1315 bp, Brachypodium distachyon
agcgagcagagaaggaaacgaaagaagcgtgttctcaacttctcatggcctgttcgtcgtcttcgtctccgctctctcttcttctcctccggcctctcccacgcatacccctcatccattccaggcacaggaagccattccctttcccaagaactggccgcatagcagcttcagcggcagcaagagctcagcagcggttgctgcggccgcgggagaccggccggtggaggagaagcttgaggagcggaggaggcttcgtgtgcttatcctacagtaacccgcccccgccttccaataaggattcggatgagtggcctgtccttcgccggtgggatgtgccatgggagtggcaaaccgttgtgctcaccatggtgggctgtggagtaagctttgctctgacaggattggttgagcagtcggtgttgcaatacgcagggtataaagctgcaggggcaactatagatgagaaggcagaaatactctttctcgggcaacttagcgtgacagcagttctgcttggtgttatatttagcatcaccaataccttccgaccattcccggatgatatctttcgttatgatattaaagaaccattcaaactaagaaatggctggcttctgtgggctggtattggtctctttggtgcagtcatttccatagctctagttggagctgccatgacctatctgaatggtgaacctccagagagagagaaggactcactggttcttttactgccactaattggctcgtcaactctcagcactgcctatttggtgggtattactggagttctagcaccaattctggaggagactgtgtttcgaggatttctaatggtgtccttgactaagtggtttcctactccagtatgtgtggtgttcagtgctgctgtatttgcctttgctcatctgactcctgatcaatttccgcagctgtttgtacttggtgttgcactagggtttacatatgctcaaactcgcaatcttctagctcctattacaatacatgcattttggaactcaggagttatattactgctaacttttcttcagttgcaagggtatgatatcaaggagctcctgggggcatcttgaagacttcaactgatcagcttttggctttgtgtatatccttcggtaacttcagccaaaaaaacgaaatgactaatgatctctatttttactgtttaatgatcgatatttacggtgcaagtaagcaattttatgtacccttacaataagttgtcacataatttgtatgtatccttgcactaacttttatgtactggtccagctaattcatgttgtgtata

SEQ ID NO: 1095 - DNA, 1290 bp, Triticum aestivum
tggagcaggagctcgaggagcggcagagacttcgcgtgcttatcctacaacaacccgccaccgccttccagtaaggattcgaacgagtggcccgtccttcgccgatgggatgtgccatgggagtggcaaactgttgtcctcagcatggtgggctgtggagtaagctttgctctgacaggattggttgagcagtcgatactgcaatacgtagggttttcagccgcgggggcaactatagatgagaaggcagaaatactgttcctcggacaacttagcgtgactgctgttgtgcttggtgttatatttagcatcaccaataccttccgaccattccctgaggatgtcttctgttacgatgtcaaagaaccattcaagctgcaaaatggctggcttctgtgggctggtattggcctctttggtgcagtcatttccattgctttagttggagctgccatgacctatctgaatggtgcacctccagagagagagaaggactcgctggtccttttactgccactaattggctcatcaactctcagcactgcctatttggtggggattactggagttctagcaccaattctggaggagactgtgttccgaggatttctaatggtgtccttgactaagtggtttcctactccagtctgcgtgattctcagtgctgctgtatttgccttcgcccatttgacacctgatcaattcccacaactgtttgtacttggtgttgcactggggtttacatatgctcaaactcgcaatcttctagctcctattacaatacatgcattttggaactcgggagttatactactgctaacctttcttcagttgcaagggtacgatatcaaggagctattgggggcgtcttgaagtctttataaccgtccggattttagctttgtgcatatccttgagtaacttctgcaaaaagatctggaagaacaatgagctttcctttattcgactgcttagtgtatgatcttactgggtaaggcacgcaatgtatggtctacaagatgtcttacaaaatatgattatgtatggttctttccatactactgccaatcttcgtggtggaaaatgtccaatcatacaaatatacaatacggttattgctataagaaatgcattgtacttgtacgtagctttcaggttggctcaatgattcttcctcgcaagtgggcaatggatgttcataccatgctagcattaagtaaaacttataccaataaatctatctcactgggattttctattatttttcctatggatgtactgtgtgaatgg

SEQ ID NO: 1096 - DNA, 1769 bp, Setaria italica
cgaacctcgaggtagctggcggcgtcggggggagacgcgagctcgcagaaggagacgaggctcgagacgaggtcagcatcgaaatccagctcgctccccttacgctcccgaagctcctgtagggcgcccttcagccactcgccggacgtgctcgccgacgtcgccatcgccgccgccgccaacacaaacgccggtacaggaagaagagggtatgactttttcgcgattcggaccctcgacttataggatatttcagtaatacgcctacccgtacaaattttgtttagtttttgccttggattatacgtcattttcaaaagacccctcatcttatccccgcgacgccgcgatacgccgatacttcaccgcgaggcttcaccatcgtgggcagagagcgaaaggcatgtttccgatggcatcctcctcatcgtcgtcgccgccgctctcgcttctccttatccgggcgctcccgtccaaacccctcctcctctcgaggcacaggaagccatttccctatccaaaatctggccgcatagcagttgcacgagcacagcagcggttactgcggttgccggagaccggccggtgggggaggagctggaggaggggcggaggcttcccgtgtttctcgtataatgccaacaacgaaagcccccctccttcggataagagttcagacaactggcgaatccttcagcggtgggatgtgccatgggagtggcaaactgttgtgctcagcatggtaggctgtggggtaagctttgttttaacaggattggttgagcaatccgctttgcaatatgtggggtttaaagctctggaggcaactatagatgagaaggcagaaatattgtttcttgggcaacttagcgtgacagtagttgtgcttggcgttatatttggcatcaccaatacttttcgaccattcccagatgatgtatttcgttatgatattaaagaaccattcaagctgaagaatggatggcttttgtgggctggagttggcctttttggagcaataatttctattggtttaaccggagctgctatgacttatctgaatggtgaacctcctgagagagagactgattcgctagttcttttgttgcccctgattggctcatccactaccagcactgcctttttggtgggaattactggagttttagcaccacttctggaggagactttgtttcgaggatttctaatggtgtccttgactaagtggtttccgactccagtttgtgtacttgtcagtgctgctgtatttgcccttgctcatctgactcctggacaatttccacagctgtttatacttggtgttgcactggggttttcgtatgctcaaacccgcaatcttctaactcctatcacaatacacgcattttggaactcgggagtaatattactgctcacctttcttcagctgcaaggatatgacatcaaggagctgttgggggcatcgtgaaggtttggacaaaccagcctggttttgtgcataaggtgatatgaagctctgttgggcgtgtgctctggcatacctgatgtgagcaaaaccacgtggaaagaaatatgggcgtgcaactgcaagttagctgttcagtgtaataggtggttgcgtttccggaagttttacgggacatcactactgtgtaaagcagtttatatatagtacgcatggcagatgaccttaatgcaagaactgcagaaacacctgtcaaaaataattaacgcatgaaatgcagacgaatttacgccctcgttcatct

SEQ ID NO: 1097 - DNA, 718 bp, Brachypodium distachyon
tcgccttgtgtaacctcaaagtacgcctttgtcatccggtcgcggtatgcggggccggctaaactggtagggaaggaagcggccgggggattctccccacgaaccaaacaagaccaatcttcggcgagccaccggcgaacactcacatcaagaggcggcggatcaaagagaggagacgagaagatgggtggcggcatggaggtgaacaagaaccggtggatcgaggagtggaacgccggccgagagaacctcgagctcaacttccgctttacgcgccgcagcctcgccgtcatcggactcttcggcctcgccgtccccatcctcgtctacaagggcatcgttcgcgaattccatatgcaggacgaggacgccggcaggccgtacaggaagttcctgtgatcatcgcctactgtggatttcgagacgccatctgccggacttcgatccgggagatggaatctccgttcggtttgttcctgtactgttgtaatcagaccagagtattttggaattcccaactgttgcgtggtatctgttgaataagctgtaatgacgtgatgtcttttcaattgctgaatactggcaagtttgatttggttaatcggaggtgaatctttgtgttctgcaaattcatgtgtgctttgtgttaagtggggtattagttcaaggtgaaattgcgtcttctttctgaaataatttactatgtgtgaactgaaca

SEQ ID NO: 1098 - DNA, 664 bp, Secale cereale
tgcccgtctcaccacgaaccaaaaccagaccaaatcttcggcgagctcatcggcacattctcagagcggagaggaagcaggaggcggcggatcaaggagaggagacgagaagatgggtggcggcatggaggtgaacaagaaccggtggattgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgtcggctccagtggatgtcgagactccgagccgtctgcagggtttcggtcagggagaggaatctccattcggtttgtttcccgtactgtcgtaatcagaccggagtattttgttctcacatgttgtgcgcgatatgtgttaaataagctgtaatgaaatgctgttcttgcaattgctgaaacctgagaagtctgatttggttaatttgaagtgaatatttgtgttatgcaatgttatttatgctttggatcaaatggggagtgatatcaggcgtgtgtgtgtggccttctgagaatatcaatcatgtttgtagtaaagaaaaaaaaaaactaga

SEQ ID NO: 1099 - DNA, 588 bp, Secale cereale
ggtttccgagtctgcctaaatcggtacaggaagtaagcggccgtctgcccgtctcaccacgaaccaaaaccagaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgtcagctccggtggatgccgagactccgggccgtctgcagggtttcggtcagggagaaggaatctccattcggtttgtttcccgtactgttgtaatcagaccggagtattttgttctcacatgttgtgcgcgatatgttttaaataagatgtaatgaaatgctgttcttacaattgctgaaacctgagaagtctgatttggttaatgtgaggt

SEQ ID NO: 1100 - DNA, 504 bp, Secale cereale
cacgaaccaaaaccagaccaaatcttcggcgagctcatcggcacattctcagagcggagaggaagcaggaggcggcggatcaaggagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgttggctccggtggatgtcgagactccgagccgtctgcagggtttcggtcagggagaaggaatctccattcggtttgtttcccgtactgttgtaatcagaccggagtattttgttctcacattgttgtgcgcgatatgtgttaaataagtctgtaatagtaaatgctgttcttactaattgctgaa

SEQ ID NO: 1101 - DNA, 459 bp, Secale cereale
cacgaaccaaaaccagaccaaatcttcggcgagctcatcggcacattctcagagcggagaggaagcaggaggcggcggatcaaggagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgttggctccagtggatgtcgagactccgagccgtctgcagggtttcggtcaggagaaggaagtctccatcgttgtttccgtactgtcgtaatcagaccgagtattgttctcacatgttgtgcgcgatatgtgttaaataag

SEQ ID NO: 1102 - DNA, 618 bp, Secale cereale
ggtttccgagtctgcctaaatcggtacaggaagtaagcggccgtctgcccgtctcaccacgaaccaaaaccagaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgtcagctccggtggatgccgagactccgggccgtctgcagggtttcggtcagggagaaggaatctccattcggtttgtttcccgtactgttgtaatcagaccggagtattttgttctcacatgttgtgcgcgatatgtgttaaataagctgtaatgaaatgctgttcttgcaattgctgaaacctgagaagtctgatttggttaatttgaagtgaatatttgtgttatgcaatgttatttatg

SEQ ID NO: 1103 - DNA, 567 bp, Secale cereale
acgaaccaaaaccagaccaaatcttcggcgagctcatcggcacattctcagagcggagaggaagcaggaggcggcggatcaaggagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgttggctccggtggatgtcgagactccgagccgtctgcagggtttcggtcagggagaaggaatctccattcggtttgtttcccgtactgtcgtaatcagaccggagtatttgttctcacatgttgtgcgcgatatgtgttaaataagctgtaatgaaatgctgttcttgcaattgctgaaacctagagagtctgatttggtttaatttgaagtgaatatttgtgttatgcaatgttatttatgctttgga

SEQ ID NO: 1104 - DNA, 526 bp, Secale cereale
gaaccaaaaccagaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgttgcctccggtggatgtcgagactccgagccgtctgcagggtttcggtcagggagaaggaatctccattcggtttgtttcccgttactgttgtaatcagaccggagtattttgttctcacatgttgtgcgcgatatgtgttaaataagctgtaatgaaatgctgttcttacaattgctgaaacctgagaagtctgatttggttaatttga

SEQ ID NO: 1105 - DNA, 597 bp, Secale cereale
ttttccgagtctgcctaaatcggtacaggaagtaagcggccgtctgcccgtctcaccacgaaccaaaaccagaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgttggctccggtggatgtcgagactccgagccgtctgcagggtttcggtcagggagaaggaatctccattcggtttgtttcccgtactgttgtaatcagaccggagtattttgttctcacatgttgtgcgcgatatgtgttaaataagctgtaatgaaatgctgttcttacaacttgcgttcaaacctgacgaagttactgtatttggtttaatttaggtagg

SEQ ID NO: 1106 - DNA, 722 bp, Secale cereale
acgaaccaaaaccagaccaaatcttcggcgagctcatcggcacattctcagagcggagaggaagcaggaggcggcggatcaaggagaggagacgagaagatgggtggcggcatggaggtgaacaagaaccggtggattgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgttggctccggtggatgtcgagactccgagccgtctgcagggtttcggcagggagaaggaatctccattcggtttcgtttcccgtactgttgtaatcagaccggagtattttgttctcacatgttgtgcgcgatatgtagttaaataagctagtaatagaaatgcttgttctgcaattgctgaaacctgagaagtctgatttggttaattttgaagtgaataatttgtgttatgcaaggttattttatgctttggatcaaatggggagtgatatcaggcgtgtgtgtgtggccttctgagaatatcaatcatgtttgtgtgatttcttactgggcatacctgcatagacctgagtgtattcggagttctatcgagaattctgctatttctaagcagttcagaacg

SEQ ID NO: 1107 - DNA, 480 bp, Secale cereale
ccaaaaccagaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagttcctgtgagcgtcagctccggtggatgccgagactccgggccgtctgcagggtttcggtcagggagaaggaatctccattcggtttgtttcccgtactgttgtaatcagaccggagttattttgttctcacatgttgtgcgcgatattgtttaaatagatgtaatggaatgctgttct

SEQ ID NO: 1108 - DNA, 531 bp, Secale cereale
gaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcgatcgtccgcgaatttccatatgcaggacgaggacgccggccggccgtacaggaagttcctgtgagcgttcagctccggtggatgccgagactccgggcctctgcagggtttcggtcagggagaaggaatctccatcggtttgtttcccgtactgttgtaatcagaccggagattttgttctcacatgttgtgcgcgatatgttttaaataagctgtaatgaaatgctgttcttacaattgctgaaacctgagaagtctgatttggttaatgtgaggtgaatatttgtgttat

SEQ ID NO: 1109 - DNA, 650 bp, Brachypodium distachyon
cggtatgcggggccggctaaactggtagggaaggaagcggccgtctgccattctccccacgaaccaaacaagaccaatcttcggcgagccaccggcgaacactcacatcaagaggcggcggatcaaagagaggagacgagaagatgggtggcggcatggaggtgaacaagaaccggtggatcgaggagtggaacgccggccgagagaacctcgagctcaacttccgctttacgcgccgcagcctcgccgtcatcggactcttcggcctcgccgtccccatcctcgtctacaagggcatcgttcgcgaattccatatgcaggacgaggacgccggcaggccgtacaggaagttcctgtgatcatcgcctactgtggatttcgagacgccatctgccggacttcgatccgggagatggaatctccgttcggtttgttcctgtactgttgtaatcagaccagagtattttggaattcccaactgttgcgtggtatctgttgaataagctgtaatgacgtgatgtcttttcaattgctgaatactggcaagtttgatttggttaatcggaggtgaatctttgtgttctgcaaattcatgtgtgctttgtgttaagtggggtattagttcaaggtgaaattgcgtcttctttctg

SEQ ID NO: 1110 - DNA, 301 bp, Leymus cinereus x Leymus triticoides
gcacgaggcaatcttgggcgagccaccggcacattctcagagcggagaagaagcaggaggcggcggatcaaggagaggagacgagaagatgggtggcggcatggaggtgaacaagaaccgctggatcgaggagtggaacgccggtcgggagaacctcgagctcaacttccgctttacccgccgcagcctcgccgtcatcggcctcttcggcctcgccgtccccatcctcgtctacaagggcatcgttcgcgaattccatatgcaggacgaggacgccggccggccctacaggaagttcctg

SEQ ID NO: 1111 - DNA, 462 bp, Pseudoroegneria spicata
gaggaagcaggaggcggcggatcaaggagaggagacgagaagatgggtggcggcatggaggtgaacaagaaccgctggatcgaggagtggaacgccggccgggagaacctcgagctcaacttccgctttacccgtcgcagcctcgccgtcatcggcctcttcggcctcgccgtccctatcctcgtctacaagggcatcgttcgcgaattccatatgcaggacgaggacgccggccggccgtacaggaagttcctgtgagcgtcccctccggtggatgccgagactcgagccgtctgcagggttccggtcagggagaaggaatctccattcggtttgttcccgtactgttgtaatcagaccggagtattttgttctcacatgttgtgcgcgatatgtgttaaataagctgtaatgaaatgctgttcttccaattgctgaaacctgagaagtctgatttggtta

SEQ ID NO: 1112 - DNA, 709 bp, Triticum aestivum
cccgtctcaccacgaaccaaaccagaccaatcttcggcgagcccatcggcacattctgagagcggagaggaagcaggaggcggcggatcaaggagaggagacgagaagatgggtggcggcatggaggtgaacaagaaccgctggatcgaggagtggaacgccggccgggagaacctcgagctcaacttccgctttacccgccgcagcctcgccgtcatcggcctcttcggcctcgccgtccccatcctcgtctacaagggcatcgttcgcgaattccatatgcaggacgaggacgccggccggccgtacaggaagttcctgtgagcgtcgcctccggtggatgtcgagactccgagccgtctgcagggtttcggtcagggagaaggaatctccattcggtttgtttcccgtactgttgtagtcagaccggagtattttgttctcacatgttgtgcgatatgtgttaaataagatgtaatgaaatgctgttcttgcaattgctgaaacctgagaagtctgatttggttaatttgaggtgaatatttgtgttatgcaatgttatttatgcttggatcaaatggggagtaatatcaggcgtgtgtgtgtgaccttctgacaatatcaatcatgtttggcgcgcttagctattagttgaccttccttgtatttgaaaattgattcttgtctgcgaccttgatttttactgggc

SEQ ID NO: 1113 - DNA, 708 bp, Triticum aestivum
cggtcacggttttcgagtctgcctaaatcggtacagaagtaagaggccgtctgcccgtctcaccacgaaccaaaccagaccaatcttcggcgagcccatcggcacattctgagagcggagaggaagcaggaggcggcggatcaaggagaggagacgagaagatgggtggcggcatggaggtgaacaagaaccgctggatcgaggagtggaacgccggccgggagaacctcgagctcaacttccgctttacccgccgcagcctcgccgtcatcggcctcttcggcctcgccgtccccatcctcgtctacaagggcatcgttcgcgaattccatatgcaggacgaggacgccggccggccgtacaggaagttcctgtgagcgtcgcctccggtggatgtcgagactccgagccgtctgcagggtttcggtcagggagaaggaatctccattcggtttgtttcccgtactgttgtagtcagaccggagtattttgttctcacatgtgcgcgatatgtgttaaataagatgtaatgaaatgctgttcttgcaattgctgaaacctgagaagtctgatttggttaatttgaggtgaatatttgtgttatgcattgttatttatgtttggaccaaatggggagtaatatcaggcgtgtgtgtgtgaccttctgacaatatcaatcatgtttgtgtgcttagctattagttgacc

SEQ ID NO: 1114 - DNA, 643 bp, Secale cereale
gtacagaagtaagcggccgtctgcccgtctcaccacgaaccaaaaccagaccaaatcttcggcgagctcatcggcacattctcagagcggagaggaagcaggaggcggcggatcaaggagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtccgcgaattccatatgcaggacgaggacgccggccggccgtacaggaagtttcctgtgagcgttggctccggtggatgtcgagactccgagccgtctgcagggtttcggtcagggagaaggaatctccattcggtttgtttcccgtactgttgtaatcagaccggagtattttgttctcacatgttgtgcgcgatatgtgttaaataagctgtaatgaaatgctgttcttacaattgctgaaacctgagaagtctgatttggttaatttgaggtgattatgttatgcaatgttgtttatgcttggattaaatggggagtaatatcaggcgagtgtgtggccttctgacaaaa

SEQ ID NO: 1115 - DNA, 684 bp, Avena sativa
accagaccaatcttcggcgagtcaccggcacattctcatctctcacagcggagcgggcggcggatcgaagagagcagacgagaagatgggtggcggcatggaggtgaacaagaaccggtggatcgaggagtggaacgccggccgggagaacctcgagctcaacttccgcttcacccgccgcagcctcgccatcatcggcctcttcggcctcgccgtccccgtcctcgtctacaagggcatcgtccgcgaattccatatgcaggacgaggacgccggacggccgtacaggaagttcctgtgagcgtcgcctccggtggggttccgagaaccgggccgcctgccgggcttcgatctgggagatgtggaatcaccgttcggtttgttcccgtgctgttgtaatcagaccggagtattttggatttctcaagtcgtgtggtatctgttcaataagctgtaatgaaatgctgtcctttcaacccctggaacctgaccagtttgatttggttaatttgaggtgaatattcgtgttatgtgatgctatgtgtgctttggatcaagcagggacttgttcgaggtgatttgtagctgtagtctagtatggcaaacatgtttctgagagtgttagctcaacacaaaactaagattgattctgtagttttagagtcgttgattgttttactgacg

SEQ ID NO: 1116 - DNA, 547 bp, Secale cereale
gaccaaatcttcggcgagctcatcggcacattctcagagcggagaggaagcaggaggcggcggatcaaggagaggagacgagaagatgggtgggggcatggaggtgaacaagaaccggtggattgaggagtggaacgccggccgggagaacctcgagctcaacttccgctttacccgccgcagtctcgccgtcatcggcctcttcggcctcgccgtccccatcctcgtctacaagggcatccttcgcgattccatatgcaggacgaggacgccggccggccgtacaggaagttcctgtgagcgtcagctccggtggatgccgagactcccgggccgtctgcagggtttcggtcagggagaaggaatctccattcggtttgtttcccgtactgttgtaatcagaccggagtattttgttctcacattgttgtgcgcgatatgtgttaaataagctgtaatgaaatgctgttcttacaattgctgaaacctgagaagtctgatttggttaatgtgaggtgaatatttgtgttatgcaatgttatttatg

SEQ ID NO: 1117 - DNA, 456 bp, Secale cereale
  misc_feature (259)..(259): n is a, c, g, or t
  misc_feature (276)..(276): n is a, c, g, or t
  misc_feature (293)..(293): n is a, c, g, or t
  misc_feature (311)..(311): n is a, c, g, or t
  misc_feature (330)..(330): n is a, c, g, or t
gctcatcggcattctcagagcggagaggaagcaggaggcggcggatcaaggagaggagacgagaagatgggtggcggcatggaggtgaacaagaaccggtggatcgaggagtggaacgccggccgggagaacctcgagctcaacttcgcgctttacccgccgcagtctcgccgtcatcggcgctcttcggcctcgccgtccccatcctcgtctacaagggcatcgtccgcgaattccatatgcaggacgaggacgccgnccggccgtacaggaagntcctgtgagcgttggcnccggtggatgtcgagacnccgagccgtctgcagggtntcggtcagggagaaggaatctccattcggtttgtttcccgtactgttgtaatcagaccggagtattttgttctcacatgttgtgcgcgatatgtgttaaataagctgtaatgaaatgctgttctta

SEQ ID NO: 1118 - DNA, 645 bp, Cenchrus ciliaris
tccgggcccgcgacggggacggggtcggggtcggggaggcggcgggcgtggagatgagccgctccatgggaggagaagattagagtttagataggaggaggagtcgtcgggagaccagggcggaggatgatgtgcctgcctcccggagaagcaggccagtcttccccaaatcctcccaagccaaatcactctctcgccgtctcgctagcaacccgcacacatttcgcatcgcggcggatcgaaggaagagaggaggagaagatgggtggcggcatggaggtgaacaagaaccggtggatcgaggagtggaacgccggacgggagaacctcgagttcaacttccgctggactcgccgcagcctcgccgtcgtcggcctgttcggcctcgccgtccccatcctcgtctacaagggcatcgtccgcgaattccatatgcaggacgaggacgctggccggccgtacaggaagttcctctgagcggcgcgcctgctcctcggctgggctgcgaggagtctttgctcggtttgtgcccgtactgctttagtcttaatctgatggagcattttggaatgctgaaccgttttgtgggataccgatgaataaggtgtaatgacttgttgtcttttcaactgctgaaactcgata

SEQ ID NO: 1119 - DNA, 699 bp, Pennisetum glaucum
ggggaacaactcttgtgtaatcctgattatacgccttcgcaatcctgtacgagcacctccaacctgagaggctgagaagccgaccagtcttccccaaatcctccaaaccaaatcactctctcgcccccgtctcgctagcaacccgcacacatttcgcatcgcggcggatcgaaggaagagaggaggagaagatgggtggcggcatggaggtgaacaagaaccggtggatcgaggagtggaacgccggccgggagaacctcgagttcaacttccgctggacccgccgcagcctcgccgtcgtcggcctgttcggcctcgccgtccccatcctcgtctacaagggcatcgtccgcgaattccatatgcaggacgaggacgctggccggccgtaccggaagttcctctgagcggcgcgcctgctccctcggccgggctgcgaggagtcttcgctcggtttgtgcccgtactgcttttgtatgaatctgatagagccgctgtgtgggatcccaatgaataaggtgtaatgacttgttgtcttttcaactgccgaaactcgatatgtttgaattgatttgataatgttttgctatcaatagcagtgggtaccagtgttattcatgactttggtggaagggatatatctcggagtattatatatactcgcaaatgaactgaattagtgatttcagtccgtggctg

SEQ ID NO: 1120 - DNA, 718 bp, Avena sativa
gcggccgtccgcgcactctctgtctctctccacgaaccagaccagaccaatcttcggcgagtcaccggcacattctcatttctcacatcggagcggcggcggatcggagagagcagacgagaagatgggtggcggcatggaggtgaacaagaaccggtggatcgaggagtggaacgccggccgggagaacctggagctcaacttccgcttcacccgccgcagcctcgccatcatcggcctcttcggcatcgccgtcccagtcctcgtctacaagggcatcgtccgcgaattccatatgcaggacgaggacgccggacggccgtacaggaagttcctgtgagtgtcgcctccggtggggtttcgagaaccgggccgcctgccgggcttcgatctgggagatgtggaatcaccgttcggtttgttcccgtgctgttgtaatcagaccggagtattttggatttctcgagtcgtgtggtatctgttcaataagctgtaatgaaatgctgtcctttcaactcctggaacctgaccagtttgatttggttaatttgaggtgaatatttgtgttatgccttgctgtttgtgctttggatcaaattgggattagttcgaggttatatatgtagctgtagactagtatgtgtactgctgacgattgcaagcatgtttctagagtgttagctgaacacgaaattaagattgattctgagtttagagc

SEQ ID NO: 1121 - DNA, 644 bp, Sorghum bicolor
aagcagtctcccccaaaattccccgaaccaaatcactctcacggtctcaccgtctccccagcaaccagcacacatttccctttggcggatcgaaaggaggaggagaagatgggtggcggcatggaggtgcacaaaaaccggtggatcgaagagtggaacgccggccgcgagaacctcgagttcaacttccgctggacccgccgcagcctcgccgtcatcggcctcttcggcctcgctgtccccatcctcgtctacaagggcatcgtccgcgaattccatatgcaggacgaggatgccgggcggccgtacaggaagttcctctgagcgtcgtcccgggctgctggagacgtcgatcccttgaccggggctgcgaggaggggagtttccattcggtttgtgccggtattgttttagtctgaatctgatggagcattttggaatgctgaactgttgtgtcggatccaaatgaataaggtgtaatgactcgtctttttaattactgaaatttgacatgtttgaattgatttggtcactttttatggtaaaatagctgcatcgtcatgtactgcctatgactatgtgtgtgctgtggaggactataggatattcatggaggggaagttcagttattcagtttaatcctg

SEQ ID NO: 1122 - DNA, 1241 bp, Sorghum bicolor
cacaccacacgcgctgcggcgctgggtcctctctaaaccggacgaagcagtctcccccaaaattccccgaaccaaatcactctcacggtctcaccgtctccccagcaaccagcacacatttccctttggcggatcgaaaggaggaggagaagatgggtggcggcatggaggtgcacaaaaaccggtggatcgaagagtggaacgccggccgcgagaacctcgagttcaacttccgctggacccgccgcagcctcgccgtcatcggcctcttcggcctcgctgtccccatcctcgtctacaagggcatcgtccgcgaattccatatgcaggacgaggatgccgggcggccgtacaggaagttcctctgagcgtcgtcccgggctgctggagacgtcgatcccttgaccggggctgcgaggaggggagtttccattcggtttgtgccggtattgttttagtctgaatctgatggagcattttggaatgctgaactgttgtgtcggatccaaatgaataaggtgtaatgactcgtctttttaattactgaaatttgacatgtttgaattgatttggtcactttttatggtaaaatagctgcatcgtcatgtactgcctatgactatgtgtgtgctgtggaggactataggatattcatggaggggaagttcagttattcagtttaatcctggattggaatgtgcggtttgctttgttttgccttccttagatgttatattgcaaatatagtggcatgataacctcatattcaaactaaacatgttgtaaatgttcggtagcatagttcaagttagatcatgatagtgccttggtggttcttgctggtgcttaagttcagcattacctagatgaagatctagttttgtttaccaaaatgggtatttgacttgtctctcaatgagcagtggtttcatccattaattgagttagttggatagcaggagagatgttgaacaggataattctttgaagtcaataaaacctagtaatatttatagttttgagcagattggtgctgtgcatgtcatgtcatgtctgtgctttgctgctcaataccattgtagtttggtacttaggttctcaacagccttacctaagttgataaatcttgagtacagtataattgctaggcagcgtatttgaaatctgatttttttccatctgttttttgctcattagttacaacgccctctagttttggcttcaaacccattgctttgcac

SEQ ID NO: 1123 - DNA, 445 bp, Secale cereale
gaccaaatcttcggcgagctcatcggcacattctcagagcggagaggaagcaggaggcggcggatcaagcagaggagacgagaagatgggtggcggcatggaggtgaacaagaaccggtggatcgaggagtggaacgcggccgggagaacctcgagctcaacttccgctttacccgccgcagtctcgccgtcatcggcctcttcggcctcgccgtcccatcctcgtctacaagggcatcgtccgcggattccatatgcaggacgaggacgcccgggccggccgtacaggaagttcctgtgagcgttggctccggtggatgtcgagactccgagccgtctgcagggtttcgtcagggagaaggaatctccattcggtttgttcccgtatgtcgtaatcagaccggagtattttgttctcacatgttgtgcgcgatatgtagttaaa

SEQ ID NO: 1124 - DNA, 489 bp, Secale cereale
aaccaaaaccagaccaaatcttcggcgagctcatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtcccatcctcgtctacaagggcatcgtccgcgaattccatatgcaggacgaggactccggcggccgtacaggaagttcctgtgagcgtcagctccggtggatgccgagactccgggccgtctgcagggtttcgtcagggagaaggaatctccattcggtttgtttccccgtatgttgtaatcagaccggagtattttgtctcacatgttgtgcgcgatatgtgttaaataagctgtaatgaaatgctgtcttgcattgctgaa

SEQ ID NO: 1125 - DNA, 802 bp, Setaria italica
cttgtgtaatcctaactatacgcctccgcgatccgtctgcggtacgcgcaatccccttcctccaaccggagaagcaggccagtcttccccaaatcctccaaaccaaatcactctctcgccgtctcgctagcaaccagcacccatttcgcatcgcggcggatcgaaggaagagaggaggagaagatgggtggcggcatggaggtgcacaagaaccggtggatcgaggagtggaacgccggccgggagaacctcgagttcaacttccgctggacccgccgcagcctcgccgtcgtcgggctgttcggcctcgccgtccccatcctcgtctacaagggcatcgtccgcgaattccatatgcaggacgaggacgctggccggccgtaccggaagttcctctgagcggcgcgcctgctccctcggccgggctgcgaggagtcttcgctcggtttgtgcccgtactgctttagtctgaatctgatggagcattctggaatgctgaaccgttgtgtgggatcccaatgaataaggtgtaatgacttgtcttttcaactgctgaaacttgatatgtttgaattgatttgataatgttctgctgtcaatagcagtgggtaccagtgttattcatgacttcggtggaagggatatactcagggtattatatactcgcaaatgaactgaatgagtgattttagtctgtggctgcctggctgaagtggagtacgaggcttgctttgctgtgcccttgttaggtgttatatggttgcaagtataatgagatgatagcttgattttctaactagag

SEQ ID NO: 1126 - DNA, 809 bp, Zea mays
tcacgatttaatttaaaaatgaactagcggatgataaatattcgagaagggaggtagtatcaccgtatatactgttgtgccaaataatatttgtgccatagacaacattatttcagttattatagagtgattttaaatagataaaagacaaaagagctactcgagatagtataaagctgcaggcctgcagtcgcccccaaattccccgaaccaaatcactcccaccgtctccacagcaaccagcacacatttccctttggcggatcgaaggaaggaaggaggagatgggtggcggcatggaggtgcacaaaaaccggtggatcgaagagtggaacgccggccgggagaacctcgagttcaacttccgctggacccgccgcagcctcgccgtcgtcggcctcttcggcctcgctgtccccatcctcgtctacaagggcatcgtccgcgaattccatatgcaggacgaggatgcaggtcggccatacaggaagttcctgtaagcggcgtccagggctgcaggatacgtcgattcctcgaccggggctgcgaggaggggagtttccgttcagtttgtgtcggtattgttttagtctgaatctgatgaagcaatttggaatgctgaattattgtgcctgatccaaatgaataaggtgtaatgactcgtcttttcaattactgaaactggagatgtttgaatttacttggtcacttgtatggtaaaatagcagcgttgtcatatactgtttatgacttcatttgagcgccgtggaggaatatgggatatccatggaggattggagtttgcagtt

SEQ ID NO: 1127 - DNA, 683 bp, Zea mays
agacaacattactttagttattatcgtatatactgctacccgagataggataacctgcagtcgcccccaaatttccccgaaccaaatcactcccaccgtctccacagcaaccagcacacatttccctttggcggatcgaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcaggccggccatacaggaagttcctgtaagcggcgtccagggccgcaggagacgtcgatccctcgaccggggctgcgaggaggggagtttccattcagtttgtgtcggtattgttttagtctgaatctgatggagcagtttggaatgctgaactattgtgcctgatccaaatgaataaggtgtaatgactcgtcttttcaattactgaaactgaacatgtttgaatttatctggtcacttgtatggtaaaatagcagcgttgtcaattgtcatatactgtttatgacttcattcgagcgccgtggaggaatattggatattcatggaggattggagtttgc

SEQ ID NO: 1128 - DNA, 514 bp, Avena sativa
ttctctccacgaaccagaccagaccaatcttcggcgagtcaccggcacattctcacagcggagcggcggcggatcgaagagagcagacgagaagatgggtggcggcatggaggtgaacaagaaccggtggatcgaggagtggaacgcaggccgtgagaacctggagctcaacttccgcttcacccgccgcagcctcgccatcatcggcctctttggcatcgccgtccccgtcctcgtctacaagggcatcgtccgcgaattccatatgcaggacgaggacgccggacggccgcacaggaagttcctgtgagcgtcgcctccggtggggtttcgagaaccgggccgtctgccgggcttcgatctgggagatgtggaatcaccgttcggtttgttcccgtgctgttgtaatcagaccggagtattttggaattctcaagtcgtgtcgtatctgttcaataagctgtaatgaaatgctgtcctttcgactcctggaacctgaccagttcgatttggt

SEQ ID NO: 1129 - DNA, 510 bp, Saccharum officinarum
ctacccggtcccgaattcccgggtcggcccaagccgtcgggcagacccgacacatgactctttggcggttcgaagggaggaggagaagatgggtggcggcatggaggtgcacaaaaaccggtggatcgaagagtggaacgccggccgcgagaacctcgagttcaacttccgctggacccgccgcagcctcgccgtcgtcggcctcttcggcctcgctgtccccatcctcgtctacaagggcatcgtccgcgaattccatatgcaggacgaggatgccggccggccgtacaggaagttcctgtaagcggcgtcccgggctgcaggagacgtcgatccctcgaccgggctgcgaggaggggagtttccattcggtttgtgccggtattgttttagtctgaatctgatggagcattttggaatgctgaactgttgtgtcggatccaaatgaataaggtgtaatgacccgtctttttcaattactgaaattggacatgtttgaattgatttggt

SEQ ID NO: 1130 - DNA, 626 bp, Cynodon dactylon
gctgctagaaatccccatttcgcgttgcggccaatcgaaggaagcgaggagaagatgggaggcggcatggaggtgcacaagaaccggtgggtcgaggagtggaacgccggccgcgagaacctcgagttcaacttccgctggacccgccgcagcctcgccgtcgtcggcctcttcggtctcgctgtccccatcctcgtctacaagggcatcgtccgcgaattccatatgcaggacgaggacgccggtaggccatacaggaagttcctctgaagggcgcgcctgcaacggacgtcgagccctctgccctagctgcgggagaagggcctccgctcggtttgtgcccgtactgttttagtttggatctgatggagcattttgtgatgctgaactgctgcgaaggatcccgatgaataaggtgtaatgactatgttgtcttataacattctgaagctcgacatgtttgaattgatttgctcattttgtggtgaattgcagcatatatggttgtttatgactctgcctgttgcaaatcagcaaatgggattggcgtgaggcatgctttgtttatgcttagtttcttgggaaatggctatggctgattttagcctgtgtctggagtagtgttc

SEQ ID NO: 1131 - DNA, 3053 bp, Oryza sativa
cgcaagtgtgagcccggaagtacgctctcgttctccgcatgcgggttgcaatcctcgcggcatccttggtaatccccaaacgccagggacagtagcgaccttgcggccgtctccccaaaccagatcggcgtcgggtctttgccccttttcacgagcccaccagcgcattctcgcagccggagagaggaggcggcggcggcggcggatcgaggagagggagcggagaagatggggggcggcatggaggtgcacaagaacaagtggatcgaggagtggaacgcaggccgcgagaacctcgagttcaacttccgctggacccgccgcagcctcgccgtcgtcggcctcttcggactcgccgtccccatcctcgtctacaagggcatcgtccgcgaattccatatgcaggacgaggacgccggccggccgtacaggaagtttctgtgagtgctgcctccggtggatgcctcgagactgcgaccgggagaaggactctccgttcggtttgttctccatactgttttaattggacagggagtattttggagtgctcagactgttgcgtgggatctgtttgttgaataagctgtcatgacttgttgtcttttcaattgctgaaatcttggagattttattcggttaattcggctgaataacagtgttgcaatgttgtttgtgcgttcttcaggtactaattagaaccgtagtttgcttgtctcatttattaaaatctgaaatggattacagtgaatggttttagcatgtcgtttctctagtgtggcctacgtagtacgtgctattggattggctgaatagatgcagaaaattgatagcaccgatgcccatgaggcaaggtattgaccaagaactttcttacgattaattatggctttgggagtttgagtgcattgatgttatacgggctgtttcatagcaacccaatgtaggctctaaataaaattgtatggattggaagctgcactgaggcactgataaagtaataatgatcattattcctatgtggcttggatgagatttcatttctagtctcaaaattattgtactttaccactcttcaattatacttgttccttggccactatgccctgtgtatttgctatacatgagtaggtgtctaggaccttttcagtttttgcctataaaaacattaagttactttttcttcagcacttgctagatatgatggtctgagtctgtgaacagcctaactggttgagtagtctcagttgcctggcaaatggttcatagcttatttgcataactttactgatatactgtagtatagctagtttttttttttcttccttagtattttcatgtataaaacttcatatattcacagcgtttagtatagatgaaattgttagttacaatagctgtaactcatcgactaccgaaacaacaggtaatgctatttgagcagacctggagagagaacaggatttaattgcttttctgattcatgttgatggaaatgataggtaagagtacgaacagttttctgataataagttctgtagagttagcattcttgaactgctacagcagagtatgccactcccttttttgtggaaagggccaagcttcatgttgatggaagtacagttgactttcatcttgctatattattattgtattgtctggtgaagtcttatggaacatcttgcatactgatgatccattgactccagttatccactgaacattttcagcaaagtaatagatgaaactgtgaccataggccacatggtattagatgtgttgtgttgcatacctgtccatacacttctataactgggttttgttttctattgcactgtttcaatgagatttttttactgttagtaagaaaggtagattttgtgattttcttttgttggatatgttaatgtagcgtggttggttgaaagggcatgttttttacatactaggaaactaatttagcctgttctctatggaaaagatggtatgctagcaacttcaaaatctttgctgcttatatatggagtatatatatttgcatttgatcacgcggtcgatttgctgatgcaccattatcatatcatatgtacctatagcctccttcaaactactgggtatatatgttagattagacttaataaggctagagtattgttttaaaacatcgtgtatttggatgtcaccccatgcaccaattattagaaaaccattgtaaccatctcaacttgaacatttgatatctttaatttcttttatataactaaactgtcaccgtctcatccactccaatagctactgcgttgtatgaaacttgctagttcttgtttagttttttgcttccaagatgtgttcctgcttactgctggcgtgtataatgaagtatggactcaaaaagtctatgggtgatggagtgaccaaattgctatttcaatttaccagttgtggataacttcacagtgaccgtgttttattttagtgcattttttgcttgatctttagttgtctcttcgaagttcttaagaaccttcatcattcatgggctgcctcctttattttgttctgagcttctaaaatggaattaacataactgatgtggctgggtttactctttccttctgatgttacatgcggttcttatgcttagtaccaaataatcacataaattgcttttgacatgtcagtctaggttgatatgtcatcatagtggcacccaaatgaaaataaaatctgcctcatatgtcaaaatcctgaatctctctctcatagctacgactgacgaacttccgagcagaaaaaacatgagcggacacgttgtttctgaatattgcaggttgattgctggccatacttgtctagtgatgaatggtgatacaagtatcgaagccactgcccagaaaaaaacagaggtcagcctcattctgtgtattaagctgtcaacctatatcattggctcgcaagtgctctgccggtatctgaccaggtccacctggttaatgctacacttgcataaaaaaaaaatccatgactaagttcatgtttagcggtttagtgcc

SEQ ID NO: 1132 - DNA, 718 bp, Panicum virgatum
gggggggggtcccttgcattgcaaggtcgcactcgcaccatcccccaccaaattcgccgccgcggcatagggctctccatccgtcgccgacgagcagagctagggaggaaccgaggaaaggaagaagatgggtggcggcatggaggtgcacaagaaccggtggatcgaggagtggaacgccggccgcgagaacctcgagttcaacttccgctggacgcgccgcagcctcgccgtcgtcggcctcttcggcctcgccgtccccatcctcgtctacaagggcatcgttcgcgaattccacatgcaagatgaggatgcaggaagaccgttgaggaaattcttgtaatatgaagaattatgctcactttgtttcaagaaataagtgtttttatcagatcttggagctttcaacttgcttgagaaacataattatactcaattctctgtaagcactttaagtagttgtgtgttgctccaagtgtttctttgcggaacctatgtaccttcttggcttcattatgactaactatgccacccgggcatgctttattttccccccaagaggacagtatgtaattgtggtgttgtgctggtgggttctggtttttcagtaagctggtgtacccatgctttatttttcccccaagaggacagtatgtaattgtggtgttgtgccggtgggttctggtttttcagtaagctggtgcacccatgctttggt

SEQ ID NO: 1133 - DNA, 618 bp, Panicum virgatum
cgctcgaggggtgttgcacctggcccggcacggtcgcactcccacctcgccccaccaaattcgccgccgcagcatagggctcttcatccgtcgccgacgagcagagctagcgaggggaaggagaagatgggtggcgggatggaggtgcacaagaaccggtggatcgaggagtggaacgccggccgcgagaacctcgagttcaacttccgctggacgcgccgcagcctcgccgtcgtaggcctcttcggcctcgccgtccccatcctcgtctacaagggcatcgttcgcgaattccacatgcaagatgaggatgcgggaagaccgttgaggaagttcctgtaacctggagaaccatgctcattttgtttaagaaataagtgtttttgccagatcttggcagtgtcaacatgagaaacataattgtactcagttctctgtaatcacttaagttgttgtgcttcgctccagctgtttctttgaggaacctctgtaccttcttggcttctttatgactatggcaatgggcatacattattttcccaccaagaggagtatgtagctgtgtagctgtgctggtgggttctgtttattcagtaagttggtgcacccgtgttttgg

SEQ ID NO: 1134 - DNA, 787 bp, Panicum virgatum
gcattcggtcgcactcgcaccaccaaattcgccgccgcaggctatcaaaaaaaaaaaaatcgccgccgcagcatagggctctccatccgtcgccgacgagcagagccagcgaggggaaggagaagatgggtggcgggatggaagtgcacaagaaccggtggatcgaggagtggaacgccggccgcgagaacctcgagttcaacttccgctggacgcgccgcagcctcgccgtcgtcggcctattcggcctcgccgtccccatcctcgtctacaagggcatcgttcgcgaattccacatgcaagatgaggatgcgggaagaccgttgaggaagttcctgtaaccaggagaaccatgctcattttgcttaagaaataagtgttttgccagatcttggcagtgtcaacatgagaaacataattatactcagttctctgtcaccactttaagttgttgtgcttcgctccagctgtttctttgaggaacctgtgtaccttcttggcttctttatggccatgggcatacattatcaacgcccaaccccccaagaggagtatgcaactgtgtagctgtgctggtgggttcagttttttcagtaagctggtgcacccgtgttttggtaaaaatcaaatagcctcactgaccctcgcccatagagcacggtatttttttgtaatgcaaaatttccataaaaaggtcttttctgtgctttgagattcctatgctctaagcttcctttttagggtttggagacgtttttaaatatatgtcaataatttctcttacaat

SEQ ID NO: 1135 - DNA, 3739 bp, Oryza sativa
acagaaaaatattgtaggcgatgagaagagtcaaacagatctagttttccttagtgacaacaaaggatataaaaccattccataccaaaaaaaattgaaagcatcccaatatattccattatattatcaacagaagagtgaacttcatgaagccataaaatttacaaggcaaggcagtttcaaaagaaacactagaaactgagatagactgaactatgttctctttggaaaacgtaaaactgaaagacacaagccctttcagctatgcatattattttggatcaagatcaagcacaatccatatgacaagtcaagcgaaaacaattacttacgtttctaacaacctggataaactagaaatgctgataacttatacctagagaaaaagttgcaggtacactacagttctacactgaacacgctcttgtatgtttaactgtcggcctgtcgctacctcatacagctcgtagagtgaaaagctgaagggaaataagtaaaatgcagtgatccattaagctcgcaatgtagactgttgtataacacaataacaggttcaccaaagtaaactacaccgtaacacacatataataccagtatttgtaattaattgcaactcaaagtcttaactctcatcagtagctatttggggagacccaaaattaacaaacattcaaacagaaaggaactaaaattatgtagaagaaatgcaatacaggttgccgtatccaatagacgcgcatccacgcgggtcgtggtgaggaacagccgaatagcagctggcgagaattgagctaggacccctagattggggagaggagctgggcgaggcggggcttgggctcggagttcatgccgatgaggatgacgagcgggatgaatccgtagtgggccactaccttcgcgttcttcatcgcccacgtggtccactccgccgcgagccgcgcggcggtcgccgccgccgtctgctctgtgtcggccggagccttccccttctccgccgccgcggacgccatggccgagaagatgggggaagatttgccgatttggtggagactggagagatggcgatggcgaggtcaggaccggagctgtttgcggtttacatttgcgaactggggggcttattgcaaaatgacattatactgtttgctcacctaattgttgcaaaaactaaaaaaccaataatttggggggtttatctgagaaatagccaaactaaggcgaactcgtattggagaaggcacaagcaaatccgccgcagcttcgggctctgcacccaccggcggcaagcaggggagggagaagaggagaagatgggtgggggcatggaggtgcacaagaaccggtggatcgaggagtggaacgccggccgcgagaacctcgagttcaacttccgctggacgcgccgcagcctcgccgtcgtcggcctcttcggcctcgccgtccccatcctcgtctacaagggcatcgtccgtgaattccacatgcaagatgaggatgctggaagaccaccgaggaagttcttgtaagttgtaaccagccagaatcatgctagttttgttttaagaaataaatgcctttaccacacggcacaccctggcgattccaatctgagaaacatggtgacactcagttctgcacttctgcttgtaagcttttagctgctgtgctctgctccaagttttgttctgaggtatacctatgtaaccaccgttatatcaagaactactctcttccgcatttaagccaatccaaacactatcttaatcgtgctgccgtgctggtgagtactggttcttcagaacttggcccaaaatttaccttgcctttggtggttagtaccctatatattgcgcgtcttaaaattcagctattgtttcgttgaacgaagctgcgtttatcctttgccactaaaccgtgttgctctcgcaagatgttataattatgtgaagctgcttatattcatagcattggaaaaacatcgattcactggtaaccagcctttttacgccctttacctcgtcgattcaaagatacaaaccgataaaaaaaatctaggcgaaatttcctaatctttcctattttctttgaaagaaaatatcagggccgtttgattttcgatcggacggctcacacccagccatcttccttccggccccacccaatccactcccagcccagcagagctccagtactccccattccgtccgtgcctccccctaaccccaacccgcctccagcttcgcgccgcctccaaacccccacagtccgccgccggcggccatgctcctccaccaccgcctcctacctcgcctcctcctttccccctcgaccccggtcaccaccaccctgctcgtccaccgcacctccctcttcccgacccgccgcatcctctcgccctgctgctccgcgctctcccaagtggcggcggcgccggaaaccgtcgaccactccgacggcgacgagccccagggggatgtgcaggttcagctacctctcgaccggctcttcgtgccgcccggggcgagcgtgtccgcgggggacgccgaggcggtgaccgcgcgggtcctcaagggctccaacatcgtgctgggcccgtacgcgcgcggcgacgcgaacgtgatcgccgcggacttcgtgaagagcagcgtccgccccgatgactgccccagggacgggctaccggagttcgcccttgttggccggtccaacgtcggcaagtcgtcgctgctcaactcgctcgtccggcgcaagcgcctcgcgctcacttccaagaagcctgggaagacacaatgtatcaaccatttcaaagtaaacgacagttggtaccttgttgatttgcctggttatgggtatgctgctgcaccacaagaagctcgcacgaattgggatgaatttactagaaattacttcctcggcagggagaatttggtatcagtttttctcctagtagatgcaagtattccagctaagaagattgatcttgactatgctagctggcttggtcaaaacaaggtccccatgacgctagtgttcacaaaatgtgacaaacgcaagaagaagaaaaacggtggcaaaagaccggaagaaaatgtagaaaacttccagagcttgatccgtgaatattttgaggcagcacccccttggatcatgacgagcagtgtcaccaatcaaggccgagacgagatacttctgcacatgtctcagctcaggaactattggctcaagcattaagatgaaataaaaatactaatactagaactcaagcagcagcaacgcatgcaaaccctgttgctcattgatgcctcggcaattcagcacctttgcaatcaggccttcaccaactgacttgccttttgagctgttgattgtaaactattgcctctgtacatgattactcaatcaacagattggagaattggggaatacaaacaagctgctacatcaactaccctaggttttctatttgtatatcgtacaatctcagctttttctgtttgttgttttctgattataagctggagcattctgttggttaaaaacaactgctatcagctggtcatgattgggaatcccagtttttgtttgttatgtgctcccttggaccctgcatcacacacatggcaaggagtacatgcatgatgcatttgacatgttaaagaatgatttgtgtgatgtacagagtattgaaaatgccatattattgggatatattatacaatgttttcttttatctaaa

SEQ ID NO: 1136 - DNA, 1017 bp, Eragrostis curvula
  misc_feature (779)..(779): n is a, c, g, or t
  misc_feature (880)..(880): n is a, c, g, or t
gaggggatttggcgcggtcgccggcgcccaggacccccagtttcgcgtctcggcggatcgaagcaagagaggagggccttttgggaggcggcatggaggtgcacaagaaccggtggatcgaagattggaacgccggtcgcgagaacctcgagttcaatttccgctggacccgccggagcctcgccgtcgtcggcctcttcggcctcgccgtccccatcctcgtctacaagggcatcgtccgcgaattccatatgcaggacgaggacgccgggcgtccgtacaggaagttcctctgagcggtgcgcctccgctggacgtcgatctcgtgggcctagctgcaaagagaagggtctccgttcgttttgtgccagtactgttttaatttggatctgatggagcattttcggatgctgaaccgctgcgtgggatcccaatgaataaggtgtaatgactctgttgtcttttaaatttttgaaactcgatatgcttgaattgatttggtcattttgtggtgaatatctgcgtgtgcagtgttgtttatgactatgcctagtgcaaatggaattgacatgggccatgttttattcaaaaaaaaaaaaaaaaaaaaaaaaaaaaagttcctcggcgttgaaccccgggtttaacccctagggaattcccgccccccggccggccccccatttgggaaacccccccacgggtgggagggaaaccttgggttttctaaagggcccccaaaatatttgggcctaaccagggtctaggcggtttccagagtntttccctattgcgcgcgcccccgcgggggggggaagatagccagcgcccctttttcccctaatagtggtttataatctttggcgtgctttaaaaaaaaggnccccgcctagcggaaggaatccaggtaaccctgtcgcaacgacgccccgaacggcggacccgtgtggttgagtggtgctgacgctcgccgtacagacgacccgggctcacacgtcatttatacggcggaagtcgaga

SEQ ID NO: 1137 - DNA, 548 bp, Saccharum officinarum
gagtaatggctgggtagtgccttgcacggccgcacactctgacactcgcaccaccagattcgccaccgccgcatagggctttccacccgtcgccgacgagccgcgcgatccgaggggagaaagggaggagaaggagaagatgggtggcgggatggaggtgcacaagaacaagtggatcgaggagtggaacgccggccgggagaacctcgagttcaacttccgctggacgcgccgcagcctcgccgtcgtcggcctcttcggcctcgccgtccccatcctcgtctacaagggcatcgtccgcgaattccacatgcaagatgaggatgcaggaagaccaccgaggaagttcttgtaacctgcaggttcatactcttttgtttcaagaaataagcaatattgccagatgtggtaatgtcaactcgacaaacataatgctactcggttctttgtaagcacatttaagttgctatatatgctatgttccaggtgtttttcctttgaggaacctatgtaacgtctttatatgagtaactgtaactatggtttat

SEQ ID NO: 1138 - DNA, 660 bp, Sorghum bicolor
tttattgaggtgctcaacgtaatttctcaagccctcgataaactgctactaattgaaaatgaataaaaataataacggaacattcgggggtctattttgaaaaaccgagtaggctggtagtaccttgcacggccgcacactctgacactcgcaccaccagattcgccgccgctgcatagggctatccacccgtcgccgacgagcagcgcgatccggggggagaaagggaggaggagaagatgggtggcgggatggaggtgcacaagaacaagtggatcgaggagtggaacgccggccgggagaacctcgagttcaatttccgctggacgcgccgcagcctcgccgtcgtcggcctcttcggcctcgccgtccccatcctcgtctacaagggcatcgtccgcgatttccacatgcaagatgaggatgcaggaagaccaccgaggaagttcttgtaacctgcaggttcatactcgtttgtttcaagaaataagcaatactgccagatgtggtaatgtcaacctgacaaacataatgctactcggttctttgtaagcactttaagttgctatgtatgctatgttccagatgttcgttcctttgaggaatctatgtaacgtcttttatatgaataactataactatgttttattgacatccgat

SEQ ID NO: 1139 - DNA, 763 bp, Sorghum bicolor
gagtaggctggtagtaccttgcacggccgcacactctgacactcgcaccaccagattcgccgccgctgcatagggctatccacccgtcgccgacgagcagcgcgatccggggggagaaagggaggaggagaagatgggtggcgggatggaggtgcacaagaacaagtggatcgaggagtggaacgccggccgggagaacctcgagttcaatttccgctggacgcgccgcagcctcgccgtcgtcggcctcttcggcctcgccgtccccatcctcgtctacaagggcatcgtccgcgatttccacatgcaagatgaggatgcaggaagaccaccgaggaagttcttgtaacctgcaggttcatactcgtttgtttcaagaaataagcaatactgccagatgtggtaatgtcaacctgacaaacataatgctactcggttctttgtaagcactttaagttgctatgtatgctatgttccagatgttcgttcctttgaggaatctatgtaacgtcttttatatgaataactataactatgttttattgacatccgatatatattttgtataaaccgagagaacacactacattgtactggtggtagttcagtaagctggtgtacctgtggtttgcttgccgaaaagttacgacagaaagtattgttcgctgatttgttatgagagaaaaatattgctgaatctaatttagctgataagctcagtagattccatataaacatatgctatcaatatataatgtgcaag

SEQ ID NO: 1140 - DNA, 1015 bp, Musa acuminata
ctctcccctcttcacggtgatcatatctttgtagcggcagcgatccgagcagcgcaagagatcagctatcgaggagggaaggagaggagagcggagcagaaatggggggcggcatggaggtcaacaagaacaagtacatcgaggactggaacgcagcgagggagaacctcgagttgaacttccgctggacccgccgcaacctcgccctcatcggcatcttcggcctcgccgtccccatcctcgtctacaagggcatcgtccgcgaattccacatgcaagatgaggacgccggaaggcctctgaggaagttcctgtgagagatccgtcaaaggttgtgtgcttccctttcttctgaaataataatagtattactgaaggcgatgtcgtgatgttggtcgtcagagttctgtacgattcagaaacgcggttgcctgatccgtcgttagttactccatcatgttccataattctgcttgagtttgatgtgtgagaaccatgacttgtggtaaatccatggtgaacttgtggtttccctttccttctgattgtgcatcttataatgtttatctaggtcacttggtagtgtatagtaaagatcaaagataaggtaattcatttgaagtaaccattgctgatagttgttatgctgcaattataggtaaggtcctttctcgactagcgagacatgaatttctgacactatctgcaaaccctgtgaatgaaatgtttagtagaataatgagccctcatgtgaattaagcagcttcttgtgatgacagctgagatgttctccacaagcaagcaccattgaaattgataggaatcctgtcctcatcgaccggttatacctgtccatgctgacataaaggttggtcattgttagtgtgtataagatgaattgcatagaaagcagatcaaatattgattgctgggaattcaatcatttggaagatattggtagttgcttgtacccagcctgcactctaaatttatggaattggatactgaattgcct

SEQ ID NO: 1141 - DNA, 616 bp, Musa acuminata
gctcttcacggtgatcatatcattggagcggcagctatccgagcagcgcaagagatcagctatcgaggagggaaggaggagaggagagcggagcagaaatggggggcggcatggaggtcaacaagaacaagtacatcgaggactggaacgcagcgagggagaacctcgagttgaacttccgctggacccgccgcaacctcgccctcatcggcatcttcggcctcgccgttcccatcctcgtctacaagggcatcgtccgcgaattccacatgcaagatgaggacgccggaaggcctctgaggaagttcctgtgagagatccgtcaaaggttgtgtgcttccctttcttctgaaataataatagtattactgaaggcgatgtcgtgatgttggtcgtcagagttctgtacgattcagaaacgcggttgcctgatccgtcgttagttactccatcatgttccataattatgcttgagtttgatgtgtgagaaccatgacttgtggtaaatccatggtgtacttgtggtttccctttccttctgattgtgcatcttataatgtttatctaggtcacttggtagtgtatagtaaagatcaaagataaggtaattcatttg

SEQ ID NO: 1142 - DNA, 531 bp, Panicum virgatum
tcgccgccacgcagcattaaaggctcgccactcgtcgccgacgagcagagctagggaggagaaggagaagatgggtggcgggatggaggtgcacaagaaccggtggatcgaggagtggaacgccggccgcgagaacctcgagttcaacttccgctggacgcgccgcagcctcgccgtcgtcgtcctcttcggcttcgccgtccccatcctcgtctacaagggcatcgttcgcgaattccacatgcaagatgaggttgtaggaagaccgttgaggaagttcttgtaacatgaagaattatgctcactttgtttcaagaaataagtgcttttgccagatcttggcacttttaacttgcttgagaaacataataatactcaattctctgtaagcactttaagttgttgtgtgttgctcccagtgtttctttgaggaacctatgtaccttcaatatgtaattgttgttgtgctggtgggttctggtttttcagtaagctggtgcacccgtgctttggtaaaaatcaaatagcctc

SEQ ID NO: 1143 - DNA, 507 bp, Triticum aestivum
  misc_feature (24)..(24): n is a, c, g, or t
  misc_feature (40)..(40): n is a, c, g, or t
  misc_feature (43)..(43): n is a, c, g, or t
  misc_feature (71)..(71): n is a, c, g, or t
  misc_feature (143)..(143): n is a, c, g, or t
  misc_feature (217)..(217): n is a, c, g, or t
  misc_feature (220)..(220): n is a, c, g, or t
  misc_feature (243)..(243): n is a, c, g, or t
  misc_feature (250)..(250): n is a, c, g, or t
  misc_feature (339)..(339): n is a, c, g, or t
  misc_feature (386)..(387): n is a, c, g, or t
  misc_feature (389)..(389): n is a, c, g, or t
  misc_feature (411)..(411): n is a, c, g, or t
  misc_feature (416)..(416): n is a, c, g, or t
  misc_feature (427)..(427): n is a, c, g, or t
  misc_feature (429)..(429): n is a, c, g, or t
  misc_feature (457)..(457): n is a, c, g, or t
  misc_feature (496)..(496): n is a, c, g, or t
  misc_feature (500)..(500): n is a, c, g, or t
  misc_feature (504)..(504): n is a, c, g, or t
agaggaagcaggaggcggcggatnaaggagaggagactanaanatgggtggcggcatgggaggtgaacaanaaccgctggatcgaggagtggaacgccggccgggagaacctcgagctcaacttccgctttacccgccgcaanctcgccgtcatcggcctcttcggacctcgccgtccccatcctcgtccacaaagggcatcgttcgccaattccanatncaggacgaggacgcccggccggncgtaaangaaagttccctggtggagcggtcgcctccgggtggattgtctgagactccgaagtccgtctggcagggttttcgggtcaggggaagaanggaatctcccattcggttttgttttcccgttactgtttgttagtcannanccgggagtattttggttcctcnacaangttgtgccgantnatggtgtttaaaataacgaatgttaatngaaatgctgtttcttgccaaattgcctgaaaaccctgangaangtcngaa

SEQ ID NO: 1144 - DNA, 449 bp, Elaeis guineensis
gcggagcggcagccaggcgacagaaagagagagatagtcgggaaggagaagaatggggggcgggatggaggtgaacaagaaccggtggatcgaggagtggaacgccgggagggagaacctggaattcaacttccgctggacccgtcgcaacctcgctatcgtcggtatcttcggcatcgccgtccccatcctcatctacaagggcatcgtcaacgaattccacatgcaagatgaggatgctggaaggccgctgaggaaatttctctgaggattatgaaatgggttctgctatcttctttctttcaataatggcatagatcgtgttcttgaccatttggcttttcggaatgattagacaaacgcgataaactacagctactttattttctcgtgttttcccttccagcaaactttgtgatgatggtattttttttttctagtattgaatt

SEQ ID NO: 1145 - DNA, 522 bp, Elaeis guineensis
ccggttatagaaggatcaagaactcaacgccgcctgttctcctgttctctcgttccgacctcacgaagcctttcggcacagcggagcggcagcgagaaggagagtgttcagagtcgggaggaggagaaggatggggggcgggatggaggtgaacaagaaccggtggatcgaggcgtggaacgccgggagagaaaacctggagttcaacttccgctggacacgccgcaacctcgccatcgtcggcatcttcggcgtcgccgtccccatcctcatctacaagggcatcgtcaacgaattccacatgcaagatgaggatgctggaaggccgctgaggaaattcctctgaggaatatgaaaatgggtgctgctttcttctttgtctaataatgtcaaatatcgtgttgttgacgacttggcttttcggaatggttagataagcgtgatagcctattgctactatattttcttgtaccttttattcaagtactgttgatgatgatggtatgttttcagatcggatca

SEQ ID NO: 1146 - DNA, 872 bp, Aristolochia fimbriata
gtagagaaaagccacgagacgcagtcctttcaccgactaaaccccggcgttaatatatagtgttggcgaagcaacctctagcccgaaacagagcttttatgggcttgggcatgacccatcttaaattaggccacaggcccatttcttggtgacggcgggctttggtagcttgtcttttttattactccgtgattcagttcagttatcgcgcgatattcgtgaggttgacgacagagagtgggagaaaccgagggagcgaaaatggccgggggattggaggtgaagaagaacaagtttatcgaagagtggaatgcagggagagagaatttggagttcaatttccggtggacccggcggaattgggcgctcatcggcatatttggcgttgctgtgcctatcctcgtctacaaagggatcgtcagggaatttcatatgcaagatgaggatgctggaagaccctacaggaaatttctttgaaagttcagcaagtctctgtaataaaggtgaaactgagtagaattgggcttgaaaaccagaaggtgtatcatggtgtttctagcacttcttatttctagcattggtttcacttcagttgtgctttgtctaagccattatcgaagaatgacactgtctttagaagttgtggattcctcagatttttgtactgattcaagtttaacattttgatttcttgtttaagagctcgagtcgggactttcttagtgtatattgcttgcctattatgcatatactgttttgttgttttcattccagatacttaagaaatttcatattctttctggaacccagtggaaaggatttatcctttaatgaaatctgtctgataacatttctagtaaaaaaaaaaaaaa

SEQ ID NO: 1147 - DNA, 481 bp, Catharanthus roseus
ccaaagaattcggcacgagggtttgtgaagaaggctgaaattttaacctgcggtgtgtgaaaatgggtggaggcatggaagcacacaagaaccgctggattgaggattggtctacggcgagagaaaatctggagcacaacttcaggtggacccgccgtaaccttgcaatcgtcggccttttcggcatcgccgttcctatcctcgtctacaaaggcatcgtccgcgaatttcatatgcaagatgaggatgcagggaggccataccggaagtttttgtgaacattctgaaagttctttgtaataatggtggtggctgaagtaaactagttgttcttcagaacacaaaagtgtgattttttcccctaagttggaacttaatcttttaatgttctatctataacctcggccaattggtttttaatggacaatatggacaatgttttcggacaaaacactaaattttgcctatcataatttccgga

SEQ ID NO: 1148 - DNA, 384 bp, Secale cereale
gaccaaatcttcggcgagcccatcggcacattctcagagcggagaggaagcaggaggcggcggatcaagcagaggagacgagaagatgggtggcggcatggaggtgaacaagaaccggtggatcgaggagtggaacgccggccgggagaacctcgagctcaacttccgctttacccgccgcagtctcgccgtcatcggcctcttcggcctcgccgtccccatcctcgtctacagggcatcgtccgcgattccatatgcaggacgagacgcccgccggccgtacaggaagttcctgtgagcgtcagctccggtggatgccgagactccgggccgtctgccagggtttcgtcagggagaaggaatctccattcggttgtttcccgt

SEQ ID NO: 1149 - DNA, 523 bp, Zostera marina
tctccgactcagggcgcgtaacacacagagcgaagaagcaatggggggaggaatggaggtgaacaagaacaagttcatagaggattggaacgctgggagggagaatctcgagttaaatttccgattcaccagacgcaaccttgcacttatcggaatcttcgggatcgccgtccctatgcttctttaccgtggcatcgtcaaggatttccatatgcaagatgaagatgcaggaagaccgcacaggaagtttttgtgatcgaggagaattgggaaggatttcaatcccccaaggttgaatctcttttttgcttttgtatcttcgtatattatgcttggatttgtaataaatctatacgattgtgatgatgttcttacttgactgacttctgatcatcatcggaatcttctgctactctctgtgatgattccagtatcaatctcattcatgtttacaaattacagatctacttctcaaaaaaaagtacgaaaatttggtacaaaataaaacatacttttgtataac

SEQ ID NO: 1150 - DNA, 508 bp, Secale cereale
gaaccaaaaccagaccaaatcttcggcgagctcatcggcacattctcagagcggagaggaagcaggaggcggcggatcaagcaggggagacgagaagatgggtggcggcatgggggtgaacaagaaccggtggatcgaggagtggaacgccggccgggagaacctcgagctcaacttccgctttacccgccgcagtctcgccgtcatcggcctcttcggcctcgccgtccccatcctcgtctacaagggcatcgtcgcgaatcatatgcagacgaggacgcgcgcgtacagagtctgtgagcgtcggctccagtggatgtcgagactccgagccgtctgcagggtttcgcaggtgaaggatctccattcggttgttcccgtatgtcgtaatcagaccggagtatttgttctcactatgttgtgcgtcgataaataagtaagttaaaatagctagtaatgaaatgctgttctgcaattggttcaactgagaagtgtgatgtgggtgtgg

SEQ ID NO: 1151 - DNA, 715 bp, Lippia dulcis
agaatgccttaggccgtttaggtcaaaaataaaaaccatattctcttctaataaagcctctttggttatccccaatttccccaatttctgagcttcgtcttatcgttcttcgacgggaatatcatcgtcaccagtatcgggttattcagaattttgataggatttcacctttgagaaagtaaggaaaatgggcggaggaatggaggtgaataagaaccgttgggtggaggaatggggggcggcgagagaaaatctggagttgaacttcaggtggacccgccgcaaccttgccctagtcggaatctttggaatcgccgtcccagtcctcgtctacaaaggcatcgtcaaagattttcacatgcaagacgaggatgccgggaggccatataggaagttctggttttcttaaataaccaaagtggctcaactggaaaggcttgtattctcaaataagaaatgttcacttgcattcaaaatgaaatgcctggaaacgatggggattcttgctacagcatttttcgtttcctttttttttttctgaacgatgttgctagcttcatgcctacttgctgttgattgtactgcgtatcgcgaaaatggagccatttaatagtgtcatttgatatgaacaaatatgtttgtttctttgttgggtagttggggttagggggggggactcccaacttcttgtccccctattatatatgctagatct

SEQ ID NO: 1152 - DNA, 418 bp, Rosa hybrid cultivar
gatcgcaaattatcaaggctacaaagtctagagagcacagagagaagggccagcaagcagtgaaatagaagaagaaaatgggaggaggaatggaggcaaacaagaacaggttcgtggaggagtggggcgcggccagagaaaatctcgagcacaacttccggtggactcgccgcaacttcgccatcatcggaatcttcggcattgctatccccgtcctagtctacaagggcatcgtccgagaattccatatgcaagatgaggatgcaggcagaccatacaggaagtttctgtgagtactgagacggtgcttcacaataactgtgggactagtcatagaaggttctctactggacccacagattttaccatccttgtatggggaaagcatttcctttgttaatgtcaacgttcattaaac

SEQ ID NO: 1153 - DNA, 460 bp, Antirrhinum majus
  misc_feature (27)..(27): n is a, c, g, or t
gtggtaatagtaaaataatatttttangaaaaatgggaggaggaatggaggcgaacaagaaccgttggatcgaggattggggatcagcgagagagaatctggagcacaacttccgatggacacgtcgcaattttgccctaattggaatcttcggcatcgcgatccccgtactcgtctacaagggcatcgtcagagaattccacatgcaagatgaagatgcagggaggccatatagaaaattcctgtgagcacccaaaacaacgatccttaataaacgtcgctaaaatggaagatttggattccgtggaaggaccatcgagcatctcacttttcagtcagagacctttgtttatgttactgccttaacatctccgtattgttaaactcctttacgatggagaccagatttgaatgattttatcgttgctgattgctatataaatttatcggtttttgtttc

SEQ ID NO: 1154 - DNA, 724 bp, Citrus sinensis
gagagagtggagagatcaagaggctgtcaagtgaagtgagcataaaaaaatgggtggaggaatggaggcgaacaagaacaggttcatagaggaatggggggcagcgagagagaatttggagcacaatttcaggtggactcgccgcaacttggcccttgttggcttattcggcatcgctgtccctgttttcatctacaaaggcatcgtcaaagaattccacatgcaagatgaagatgcaggcagaccatacaggaagttcctgtgagtttttcttctaatatttgtttaataataactacgatgaagaaaaactgagtttgtagttttccagcatttgggaactactttcctttgctgttgtagtttgaattctgcttatgcttgaatattccaatgttatttgaagattgttttttttgggtaatgcttcaatccatttgccttggagcttcccatgcttcttatattgtggaatctgcttcactgttactgtaattgttttggattatgttataattgcgtgcacagaagctgcatatagaagtaagatgctctttcacatcttattctagtacgcatgatagaacaaatctaatgtatgagctgattacctgtttcaatgtaataaagaaactgagaagatacatacgtttttgagaattcgtttgttgcgtgcaatgggttcctacaaaatttgacatataaaacttttactgtacaaaaa

SEQ ID NO: 1155 - DNA, 1000 bp, Unknown
  Sequence found in Organisms: Citrus clementina, Citrus sinensis
aaaaaacgacggggattttgattttgaagcggaaggggaagcagagagagtggagagatcaagaggctgtcaagtgaagtgagcataaaaaaatgggtggaggaatggaggcgaacaagaacaggttcatagaggaatggggggcagcgagagagaatttggagcacaatttcaggtggactcgccgcaacttggcccttgttggcttattcggcatcgctgtccctgttttcatctacaaaggcatcgtcaaagaattccacatgcaagatgaagatgcaggcagaccatacaggaagttcctgtgagtttttcttctaatatttgtttaataataactacgatgaagaaaaactgagtttgtagttttccagcatttgggaactactttcctttgctgttgtagtttgaattctgcttatgcttgaatattccaatgttatttgaagattgttttttttgggtaatgcttcaatccatttgccttggagcttcccatgcttcttatattgtggaatctgcttcactgttactgtaattgttttggattatgttataattgcgtgcacagaagctgcatatagaagtaagatgctctttcacatcttattctagtacgcatgatagaacaaatctaatgtatgagctgattacctgtttcaatgtaataaagaaactgagaagatacgtacgttttgagatcgtttgttgctgcaatggctctacaaaattgacatagaaactttactgcacaataatgtacattgtattggcagggatagaggcctctcctttacttttgattgaatggagtcggcctgaggtagaagtgaaatgatgtcctctgattcctcagctgaaaattgcattccatcctaaccatgttttgtgcatgccaaatgccttaagcttggtcattgtcttgttcttagttgaaatttttcattcctttcaatgatcactttttttgaaaatattgtttcttattgattaatttgtt

SEQ ID NO: 1156 - DNA, 366 bp, Cleome spinosa
cttctcgaccgaagaagacgaaggtagagagagaaagcaaagatgggtggaggaatggagacgaacaagaacaggttcatcgaggattggagctcggcgagggagaatctcgagcacaacttccgttggacccgtcgcaacctcgccctcgtcggaatcttcggcatcgctctcccgatcctcgtctataagggaatcgtccgagaattccatatgcaggacgaggacgcgggcagaccgtacaggaagttcctctgaatctgctcgctgagacaggtcgaatccattatcctacagcatctcgatcttccttgaaatgttccctcactgtgattgtttgcaaataaaagccgacttctttagcct

SEQ ID NO: 1157 - DNA, 366 bp, Euphorbia peplus
gtaagaactgtcgaaaccaacaaattgaagaaaaaatggggggaggaatggaggtaaacaagaacaagttcattgaggattggggctctgctcgagagaatctcgaacataatttccggtggactcgtcgcaactttgctctcattggcctttttggcatcgctgttcccatcttggtctacaagggcatcgtcaaagaattcaatatgcaagatgaggatgcaggcagaccttatcgcaagttcctttgagtttcttcattcaattgcccaataaaatgcacctgcactgtaactgatctcttgttccataaggacttttttttcccatattctgggaatttgttgttgattgtgtttgaaagaa

SEQ ID NO: 1158 - DNA, 702 bp, Actinidia deliciosa
  misc_feature (12)..(12): n is a, c, g, or t
  misc_feature (52)..(52): n is a, c, g, or t
gtcggggagagngagcgagactattccagagtagaaagcagagcgagagcgngagagtagagagagaagatcttggaagatggggggaggaatggaagtaaacaagaacaagttcatagaggagtggggcacggtgagggagaatctggagtacaacttcaggtggacccgccgcaactttgccatcatcggtcttttcggcatcgccgtcccgatcttcatctacaagggcatcgtccgcgaattccatatgcaagatgaggatgctgggaggccatacaggaagttcatgtgaaaattctgcaacaatttcgctaataatggtggtgaagttgaactgtgtttcggtcaggaccacaagtgtgactcttttgcattctgaagaactccaagattttctgctccgtagaatctattgcaagtttttcgggtactgtgtgttaatactttgctatcaagaaagctgatatttgacgattataatcagttacatttgaacatatttctgtttcttgcattttctgcttctgttttgcactgatgggaataaccatgctttgtgctatccctctgtctccctccggttatggagtcggtaggtattgcttgacagtgttgttggaacgctcctgtgatgttgtgatttgcttttttgtgtggttaaatccaccttaaccgacccattcgatacaaaaaaaaaaa

SEQ ID NO: 1159 - DNA, 443 bp, Rosa hybrid cultivar
gagagaagggccagcaagcagtgaaaaagaagaagaaaatgggaggaggaatggaggcaaacaagaacaggttcgtggaggagtggggcgcggccagagaaaatctcgagcacaacttccggtggactcgccgcaacttcgccatcattggaatctttggcattgctatccccgtcctagtctacaagggcatcgtcagagaattccatatgcaagatgaggatgcaggcagaccatacaggaagtttctgtgagtactgagacggtgcttcacaataactgtgggactagtcatagaaggttctctactggacccacagattttaccatccttgtatggggaaagcatttcctttgttaatgttaacgttcattaaacataatgttatgcgaatttgccttttattttgcgttgtatttttccgaatactgcaccaatcaat

SEQ ID NO: 1160 - DNA, 622 bp, Silene vulgaris
aaaaaagtagatctcgttctagtcacgagtgacgaccaagcaatccgaaagaagaagaagaagaagaagaaaaaatggggggaggaatggaagcaaacaagaacaaattcattgaagattggggtagtgctcgtgaaaatctggagcttaactttcgttggactcgtcgtaacttcgctctcattggtattttcggcattgctgtccctctcctcgtttacaagggcatcgttcgtgaattccacatgcaagatgaggatgctggaagaccctatagaaagttcctctgaatattcttgtcaccttcacaaataatggtgtttgaagcaaaactagactttgttgccctcaagaatatttgcttttcaatgacgggtatttgtatttcatctgatgccttgttttaagctttgtaagggatgtacatcctgttgaagggttttgaatgttgtctttatggtttcggatgttagaatttaaataagttgtttggtggatatatgacaacctcctttttgcaatcccgcagttttaacctttcacacttgtgtgtttgagctgagctctttgtagaaaaccttgtgtttaggattgtctgtttgtctgcaagtataactacagt

SEQ ID NO: 1161 - DNA, 684 bp, Fragaria vesca
ctactgagagtccagagagaaggccaggaaagcagcgctagaaaagaaaaaatggggggaggaatggaggcaaacaagaacaggttcgtggaggagtggggcgccgccagagaaaatctggagcacaacttccgttggactcgccgcaatttcgccatcatcggtatcttcggcatcgctatccccgtcctagtctacaagggcatcgtccgcgaattccatatgcaagatgaggatgcaggcagaccatataggaagtttctgtgagtgctgagactgcttcagaataactgtgggactagtcacagaaggatctctacaggaccacagattttcctctccttgtacgggaaagtatttcctttgttaatgtcaatgctcatcaaacataatgttatgcgaatttttgttttattttgggttgtatttttctgttaagaatactgtgcaattaatggcaaacttctgcttttactaagattttccctagtttcttctcttaatcctgatttcagagatgcacaaacagattcctactataatcctctggtttaagtttggttacaagttttattaaccaaacaggcatatgataacaggcatatggtttcatttgatgtatcaaaaccagaattataataaagttgtattgcagaatcagtatgaaatcgtattctggtgttt

SEQ ID NO: 1162 - DNA, 348 bp, Tabernaemontana elegans
gagagagcgggtgcctgtgaaggctgaagtgaaacagtgagtgaaaatgggtggaggcatggaagcacacaagaaccgctggattgaggactggtccacggcgagggagaatctggaacacaacttcaggtggacccgccgtaacctcgcaatcgtcggcctcttcggcatcgccgtacccgtcctcatctacaagggcatcgtccgtgaatttcatatgcaagatgaggatgctgggaggccataccggaaatttttgtgagcattctgaaattttatgtaataagtgtggtggctgaagtaaaactggtagttcttcaggacacaaaaattgtggctttccctttc

SEQ ID NO: 1163 - DNA, 560 bp, Juglans hindsii x Juglans regia
tgtgttggtcccggggatcggccttacggccgggggggtggagagaaagagcagtcaaagagaaggaatagagagagagagagagaggagaagaagaagaagatggggggaggaatggaggcgaacaaaaacaagtttatagaggactggggcagtgcccgtgagaacctcgagcacaacttccgctggactcgccgcaacttcgccctcgtcggcatcttcggtctcgccgtccccatcctcgtctacaagggcatcgtccgtgaattccatatgcaagatgaggatgcaggcagaccgtacaggaagtttctgtgagacttaaaaaatgcttgataataattgtggaagtaatagagctaggtgctctattggaccacacaatcatccttttcataacagggaatgtatgcattttctttgaaaacctgtagtatgttttgttcagctagtgcttgttggactttgtatcgcctttgttgtcacttgtcaagaatactaaatctttaacgatcaagctctgtcttttctgatatattcatcatgtttcccttggggcc

SEQ ID NO: 1164 - DNA, 619 bp, Sesamum indicum
ggcacagcgaaattaccaagagctcctcatttcgtctatagctacgcacatccggagcactcctgtgaactcagaactggtagcagtcttacctgaagaagctagagagagaaagtcgtcagtagaaagagagaaagatgggtggaggaatggaggcacacaaaaaccgttggatcgaggactggtcatcagctagggaaaatctggagttgaatttccgatggacacgccgcaaccttgccctcgttggaatcttcggcgtcgccgtccccatcctcgtctacaaaggcatcgtcaaagaattccacatgcaagatgaggatgcaggaaggccatatcggaaattctggatggcataattctgttctctcgaaataataaatgtggctgaactagaagacatgtattcttctggaccatttagtgtcacaatccgagtttgtctatcctttttatgttactttatcttcttgttaaacctcattcggtttttatggcctccaaagttgaaccattatatagtgcaatctgcttgatcaaattttggtttcaatttgtcttgataaaatgtctagttctacgaacaatgaaaggtcatgagtgattgacatgttggtat

SEQ ID NO: 1165 - DNA, 514 bp, Orobanche aegyptiaca
tcaagctagaaagagagagaaaataatcaatagatataacgagaaagatggggggaggaatggaggcaaacaagaaccgttggatcgaggaatgggcatcggcgagagagaatcttgagttcaatttccggtggacccgccgcaactttgccctcgtcggactctttggcatagccgtccccgtgctcgtctacaaaggcatcgtcaaagaattccacatgcaagatgaggatgcagggaggccatatcggaaattctggtggacataagcttatcgtctctaataaaatgtggctgaacttgactgaagactggttttcttctggaccaatcagtgccatttccaagtttgtcaatcccctttatattatgctttttcttgttagaaaaaaaaacaaactcatttccggggtccgttgaagttgaactattttattaatttgatctcttgtatcaacttcttgtctcaattggcttgataaatggctacttgtatgaaaaatgaaaggacatt

SEQ ID NO: 1166 - DNA, 480 bp, Euphorbia esula
  misc_feature (20)..(20): n is a, c, g, or t
  misc_feature (23)..(23): n is a, c, g, or t
cgagagcagagagtaagaantgnagaaaccaacaaattgaagaaaaaatggggggaggaatggaggtaaacaagaacaagttcattgaggattggggctctgctcgagagaatctcgaacataatttccggtggactcgtcgcaactttgctctcattggcctttttggcatcgctgttcccatcttggtctacaagggcatcgtcaaagaattcaatatgcaagatgaggatgcaggcagaccttatcgcaagttcctttgagtttcttcattcaattgcccaataaaatgcacctgcactgtaactgatctcttgttccataaggacttttttttcccatattctgggaatttgttgttgattgtgtttgaaagaattctcgtgtattccagtttgctgaaaatgctcaataggatttatgactattgcttgtactctttatcatagtatatgcatattttctgagagatttaaggcc

SEQ ID NO: 1167 - DNA, 1095 bp, Hordeum vulgare
ggacataatcgcggcgtcggcggctgcggcggaaccctcccggcgatcaccggactcaccccggcaggcaaagcaatgaggaggtacagcccccagtaccggagccccccaaggaggggatatggtggcagaggtagaagtcccccaaggaggggatatggaggacggagggagcagggttcaggaagcctcttggtccgcaacatcccattaagctgcaggccggaggatcttagagttccttttgaaaggtttggtcctgttcgggatgtgtacctgccaaaggattattacaccagggaaccccgagggtttgcatttgtggagtttgttgacccttatgatgcatctgatgcacaatatcacttgaaccgctcattattttttggccgagagataactgttgttgttgctgccgagtcacggaaaaggccagatgatatgcgtaatagagctagagtcagggggtattctggtgaacctgaaaggcgtaattctcgttatgggaggtcccgttcccgttcacgctcctactctcctcgctatcggggccgtcctcggtcaaggtcaaggtcatactctcctgctccaagacggcgagatgattactctgcttccccaccaagatcacatcacacacagtctcctaggcgtctgccaaagggacatgaagaagacgagcggagatcctattctcctgctggtagaggtggcggcgagcgtgatgctgatactaatggaaagagaaggtcgccaccatctgacattgacaggtcgcctccacgctcacgtaggcactcctcggggtcacctgtggggtcgcgctcaaggtcccctgaagcttctcctgcccgcagcgactgataagattggcggtgttacccgtattgccccgtctcccgtggccatgtactcttatctctagcttcattgtctgagtaaaacccatctgggatgtgttggctggtgctgcggtgcctctttagttagcagatgtgacttgttggctgcttggtgttgctgaaccttgtaccattgtagtgttttattgtgaaccgagccacaactaagccacaattgttattgttgattacg

SEQ ID NO: 1168 - DNA, 1243 bp, Triticum aestivum
ttctacatatcgcgtcctcgccacccccacctctctcgccctctctttcccttcgcacaatcgcggcgtcggcggctgcggcggaacctcccggcgatcaccggactcaccccggcaggcaaagcaatgaggaggtacagtccccaataccggagtcccccaaggaggggatatggtggcagaggtagaagtcccccgaggaggggatatggaggacggagggagcagggttcaggaagcctcttggtccgcaacatcccattgagctgcaggccggaggatctgcgggttccttttgaaaggtttggtcctgttcgggatgtgtacctaccaaaggattattacaccagggagccccgagggtttgcatttgtggagtttgttgacccttatgacgcctctgatgcacaatatcacttgaaccacacagtattttgtggccgagagataactgttgttgttgcttccgagtcacggaaaaggccagatgatatgcgtaatagggctagaatcagggggtattctggtgaacctgaaaggcgtcattctcgttatgggaggtctcgttcccgttcacgctcctactctcctcgctatcggggccgtcctcggtcaaggtcaaggtcatactctcctgctccaagacggcgagatgactactctgcttccccaccaagatcacatcacacacagtctcctaggcgtctgccaaaggggcatgaagaagacgagcggagatcctattctcctgctggtagaggtggtggtgagcgtgatgctgatactaatggaaagaggtcaccaccatctgacactgaaggatcacctccacgcacccgtaggtcacccaggcaatcctcaggatcacccgtggggtcgcgctcaaggtcccctgaagcttctcctgcccgcagcgactgataaaattggtgcctcccatattgccgcgtctcccacagcggcgcggccatgtactctatctctagcttcattgtctgagtaaaacccatctgggatgtgttggctagtgttgcggtgcctctttagttagcagatatgactggttggctgttcttttgctgcttggtgttgttgaaccttgtaccatggtagtgttttaatgtgaactgagccacaactgagccacaattgtgtttggatttgtgattttaaatgcattttgaatgcctttaacttgctccatgaataggttctcaaagaaaaaatagattaagttttattt

SEQ ID NO: 1169 - DNA, 1069 bp, Triticum aestivum
gtcggcggctgcggcggaacctccccggcgatcaccggactcaccccggcaggcaaagcaatgaggaggtacagtccccaataccggagtcccccaaggaggggatatggtggcagaggtagaagtcccccaaggaggggatatggaggacggagggagcagggttcaggaagcctcttggtccgcaacatcccattgagctgcaggccggaggatctacgggttccttttgaaaggtttggtcctgttcgggatgtgtacctgccaaaggattattacaccagggagccccgagggtttgcatttgtggagtttgttgacccttatgacgcctctgatgcacaatatcacttgaaccacacagtattttgtggccgagagataactgttgttgttgctgccgagtcacggaaaaggccagatgatatgcgtaatagggctagaatcagggggtattctggtgaacctgaaaggcgtcattcccgttatgggaggtctcgttcccgttcatgttcctactctcctcgctatcggggccgtcctcggtcaaggtcaaggtcaaggtcatactctcctgctccaagacggcgagatgactactctgcttccccaccaagatcacatcacacacagtctcctaggcgtctgccaaaaggacatgaagaagacgagcggagatcctattctcctgctggtagaggtggcggcgagcgtgatgccaatactaatggaaagaggtcaccaccatctgacattgatggatcacctccacgcatccggaggtcacccaggcaatcctcaggatcacccgtggggtcgcgctcaaggtcccctgaagcttctcctgcccgcagcgactgatgaaattggtgcctcccatattgccgcgtctcccacagcggcgcggccatctctagcttcattgtctgagtaaaacccatctgggatgtgttggctagtgttgcggtgcctctttagttagcagatatgactggttggctgttcttttgctgcttggtgttgttgaaccttgtaccatggtagtgttttaatgtgaactgagccacaa

SEQ ID NO: 1170 - DNA, 1041 bp, Triticum aestivum
cccccaaggaggggatatggtggcagaggtagaagtcccccgaggaggggatatggaggacggagggagcagggttcaggaagcctcttggtccgcaacatcccattgagctgcaggccggaggatctgcgggttccttttgaaaggtttggtcctgttcgggatgtgtacctaccaaaggattattacaccagggagccccgagggtttgcatttgtggagtttgttgacccttatgacgcctctgatgcacaatatcacttgaaccacacagtattttgtggccgagagataactgttgttgttgctgccgagtcacggaaaaggccagatgatatgcgtaatagggctagaatcagggggtattctggtgaacctgaaaggcgtcattcccgttatgggaggtctcgttcccgttcacgctcctactctcctcgctatcggggccgtcctcggtcaaggtcaaggtcaaggtcatactctcctgctccaagacggcgagatgactactctgcttccccaccaagatcacatcacacacagtctcctaggcgtctgccaaaagggcatgaagaagacgagcggagatcctattctcctgctggtagaggtggtggtgagcgtgatgctgatactaatggaaagaggtcaccaccatctgacactgaaggatcacctccacgcacccgtaggtcacccaggcaatcctcaggatcacccgtggggtcgcgctcaaggtcccctgaagcttctcctgcccgcagcgactgataaaattggtgcctcccatattgccgcgtctcccacagcggcgcggccatgtactctatctctagcttcattgtctgagtaaaacccatctgggatgtgttggctagtgttgcggtgcctctttagttagcagatatgactggttggctgttcttttgctgcttggtgttgttgaaccttgtaccatggtagtgttttaatgtgaactgagccacaattgtgtttgaatttgtgattttaaatgcattttgaatgcctttaacttgctcc

SEQ ID NO: 1171 - DNA, 1216 bp, Secale cereale
acctctcccctctctttcccttcaccacaatcgcggcgtcggcggcggctgcggcggaacctccccggcgatcaccggactcaccccggcaggcgaagcaatggggaggtacagtccccaataccggagtcccccaaggagggggtatggtggcagaggtagaagtcccccaaggaggggatatggaggacggagggagcagagttcaggaagcctcttggtccgcaacatcccgttgagctgcaggccggaggatctacgggttccttttgaaaggtttggtcctgttcgggatgtgtacctgccaaaggattattacaccagggagccccgagggtttgcatttgtggagtttgttgacccttatgacgcctctgatgcacaatatcacttgaaccacacattattttttggccgagagataactgttgttgttgctgccgagtcacggaaaaggccagatgatatgcgtaatagggctagaatcagggggtattctggtgaacctgaaaggcgccattcccgtcatgggaggtctcgttcccgttcacgctcttactctcctcgctatcgtggccgtcctcaatcaaggtcaaggtcaaggtcaaggtcgtactctcctgctccaagacggcgaggtgactactctgcttccccaccaagatcacatcacacacagtctcctaggcgtctgccaaaagggcatgaagaagataagcggagatcctattctcctgctggtagaggcagcggcgagcgtgatgctgatactaatggaaagaggtcaccaccatctgacattgacggatcacctccacgctcccgtaggtcacccaggcaatcctcaggatcacctccacgcacccgtaggtcacccaggcaatcctcaggatcacctgtggggtcgcgctcaaggtcccccgaagcttcccctgcccgcagcgactgatgaaattggtgccctcccatattgctggcgtggccatgtgctcttatctctagctacattgtctgagtaaaacccatctgggatgtgttggctagtgttgcagtgcctctttagttagcagatatgactctggttggcttcttggtgttgttgaaccttgtaccatggtagtgttttaatgtgaaccgagccacaactgagccacaattgtgattggatttgtgattttaaatgcattttgaatgcctttgacttgccccaaaaaaa

SEQ ID NO: 1172 - DNA, 1338 bp, Oryza sativa
tcgcgtccggccgcggagacctcccgcatccccccaccgatttcgtcccctccggcggcggcggcggcggcggcgcacggcttctccgggagctctacgcgacaaaacaatgaggaggtacagcccaccatatcgcagtccccctaggaggggctatggtggcagaggaagaagtccccctaggaggggatatggaggacggagggagcagggttctggaagtctcttggtccgcaacatcccattaagctgcagaggggaggatcttcgagttccttttgaaaggtttggtcctgttcgggatgtttacctgccaaaggattattacagcggggaaccacggggatttgcatttgtggagttcgttgacccttatgatgcctctgaggctcaatatcacatgaatcgccaggtgtttttcggccgggagataactgttgttcttgctgctgagtcgcggaaaaggccagaggaaatgcgcagtagagctagagtcaggggttactctggaaacgaagggcgccgctcttcatattatgggaggtctcgttcccgttctcgctctccccactatcgaggtcgtccacggtcaaggtcatactctcctgctccaagacggcgagatgactactcagcttccccaccgagaaaggatacgcaccccacaaaatctcctaggcgtcagccaaaagaacatgatgaagagaagaagcggagatcctactctcctgccagtagagatggcgaccctcgcgatgctgataacggttatgagaagaggtcgcccccacctgacagcgatggatcccctccacaccggaggtctcctaggcactcctcagggtcgcctccaggatcccgctctaggtccgccgatgtttcccctgcccgcagcgactgacagaactttgaaccaacgaaatgggatagctgcatgatctccacagcacctccaattctagtcagtctccatcttccttcctggtccaaccaagctgtttcaattaaaccgaagccctaagcggcgtgttgtattattgctaagtgtgcttgccatgagtttggtatggcacatcgcctgtttgtgtgctcatatgttgggagtccaggatgttgtagtcttttgagagctgctttgtttggtggtcatttgctttttgctgaacattaacttgaaacaatgtgacattggtgttgtgtactaccactagtgagccttgaactgggtaaccgcctatttccacatctatctatgcttgtgagtgcttagcccaggggcccatgctgccatgccaatattgccatcgactttgtttgggaaaaagcttttgattggat

SEQ ID NO: 1173 - DNA, 888 bp, Triticum aestivum
ccgccgcctcagttttccctctgttggaagagttcgtgccaaggccagcactcaccctcccatccctcctctccggccgcaaccccaccgccgccgccatggtgaagtactcgagggatccgtccaacccgaccaagtcggccaaggcctgtggcaaggatctcagggtccacttcaagaacacacgcgagacagcgtttgctcttcgcaggatgcctttgggcaaggctaagaggtaccttgaggatgttctcgcccacaagcaagcgattcccttccggagatactgcagaggtgtgggtcgtactgcgcaagtaaagaaccgccagccaaatgggcagggtcgctggcctgcaaagtcggcccagttcgtgttggatttgctgaagaatgctgagagtaacgctgaggttaaaggcttggacgtcgacaacctctacatttcacacatccaggtgaaccaagcccaaaagcagaggcgccgtacataccgtgctcatggacgcatcaatccttacatgtccaacccctgccacattgagctgatcttgtcagagaaggaagagcctgtgaagaaggaggctgacaacgtcgtcgcaccaaggaaagctatctaagctaacggagtggctgcattcgtccaagaatcttagttgtagttcttctcaagtacctttgttggcagtgtttgttgcctccttgatgtttttgttaccaacatggagtaaggatttgttaaggttgatgctatccttgtgatcgcgagtggtctttatatgctaaaacagtttcagatatttgagcattagcccatcagaacttatttctcagagatgctggtcctttcgggatgttcactttgagtattatatccactttttagttgct

SEQ ID NO: 1174 - DNA, 1001 bp, Triticum aestivum
acgcgagacattgggccgtaagcccatgaagagctgtgaagctctagggtttctcgcctcctcatagacctccgccgccgcctcagtttttcccctgttggaagagttcgtgccaaggccagcactcaccctcccatccctcctctccggccgcaaccccaccgccgccgccatggtgaagtactcgagggatccgtccaacccgaccaagtcggccaaggcctgtggcaaggatctcagggtccacttcaagaacacacgcgagacagcgtttgctcttcgcaggatgcctttgggcaaggctaagaggtaccttgaggatgttctcgcccacaagcaagcgattcccttccggagatactgcagaggtgtgggtcgtactgcgcaagtaaagaaccgccagccaaatgggcagggtcgctggcctgcaaagtcggcccagttcgtgttggatttgctgaagaatgctgagagtaacgctgaggttaaaggcttggacgtcgacaacctctacatttcacacatccaggtgaaccaagcccaaaagcagaggcgccgtacataccgtgctcatggacgcatcaatccttacatgtccaacccctgccacattgagctgatcttgtcagagaaggaagagcctgtgaagaaggaggctgacaacgtcgtcgcaccaaggaaagctatctaagctaacggagtggctgcattcgtccaagaatcttagttgtagttcttctcaagtacctttgttggcagtgtttgttgcctccttgatgtttttgttaccaacatggagtaaggatttgttaaggttgatgctatccttgtgattgcgagtggtctttatatgctaaaacagtttcagatatttgagcattagcccaccagaacttatttctcagagatgctggtcctttcgggctcttcactttgagtattatatcctactttttagtgtctattaattatacaaaaagaaaagtacgactgcgtgccgt

SEQ ID NO: 1175 - DNA, 867 bp, Pseudoroegneria spicata
gttcgtgcgaaggccagcactcaccctcccatccctcctctccggccgcaaccccaccgccgcctctatggtgaagtactcgagggatccgtccaacccgaccaagtcggccaaggcctgtggcaaggatctcagggtccacttcaagaacacacgtgagacagcgtttgctcttcgcaagatgcctttgggcaaggctaagaggtaccttgaggatgtccttgcccacaagcaagctattcccttccggagatactgcagaggtgtgggccgtactgcgcaagtaaagaaccgccagccaaatgggcagggtcgctggcctgcaaagtcggcccagttcgtgttggatttgctgaagaatgctgagagtaacgctgaagttaaaggcttggacgtcgacaacctctacatttcacacatccaggtgaaccaagcccaaaagcagaggcgccggacataccgtgctcatggacgcatcaatccttacatgtccaacccctgccacattgagctgatcttgtcagagaaggaagagcctgtgaagaaggaggccgacaacgtcgtcgcaccaaggaaagctatctaagctaacggagtggctgcattcgtccaagaatcttagttgtagttcttttcaagtaccttttgtggcagtgtttgttgcctcgatgtttttggtaccaacatggagtaaggatttgttaaggttgatgctatccttgtgattgtgaatggtctttatatgctaaaacagtttcagatatttgagcattggcccaccagaacttatttcttagagatgctggtcctttcggcctgttaacttcgagtattatatccactttttagttgctttgaaaaaaaaaa

SEQ ID NO: 1176 - DNA, 1028 bp, Secale cereale
gtggggggccgacgtgaagaggtgtgaagcgtctagggttctcgcctcctcatagacctccgccgcctcctcagttttccctgttggaagagttcgtgcaaaggccagcactcaccctcccatccctcctctccggccgcaaccccaccgccgccgccatggtgaagtactcgagggatccgtccaacccgaccaagtcggccaaggcctgtggcaaggatctcagggtccacttcaagaacacacgtgagacagcgtttgctcttcgcaagatggctttgggcaaggctaagaggtaccttgaggatgttcttgcccacaagcaagcgattcccttccggagatactgcagaggtgtgggccgtactgcgcaagtaaagaaccgccagccaaatgggcagggtcgctggcctgcaaagtcggcccagttcgtgttggatttgctgaagaatgctgagagtaacgcggaagttaaaggcttggatgtcgacaacctctacatttcacacatccaggtgaaccaagcccagaagcagaggcgccgtacataccgtgctcacggacgcatcaatccttacatgtccaacccctgccacattgagctgatcttgtcagagaaggaagagcctgtgaagaaggaggccgacaatgtcgtcgcaccaaggaaagctatctaagctaatggagtggctgcagtcgtccaagaatcttagctgtagttcttttcaagtacctttaaaggcagtgtttcttgcctccttgatgtttttggtaccaatatggagtaatgatttgttaaggttgatgctatccttgtgattgctaatggtctttatatgctaaaacagtttcagatatttgagcatttagcccaccagaacttatttctccactgtttggttgttttgaacctattttttagttgttttgatatatacaccctttgttactatatatttaagacgttttggcagttcaatttcaactgccaaaacgtcttgtatctaggaacagagttgatacttcct

SEQ ID NO: 1177 - DNA, 779 bp, Secale cereale
  misc_feature (314)..(314): n is a, c, g, or t
  misc_feature (586)..(586): n is a, c, g, or t
  misc_feature (643)..(643): n is a, c, g, or t
  misc_feature (663)..(663): n is a, c, g, or t
  misc_feature (673)..(673): n is a, c, g, or t
  misc_feature (687)..(687): n is a, c, g, or t
  misc_feature (696)..(696): n is a, c, g, or t
  misc_feature (761)..(761): n is a, c, g, or t
ccagcactcaccctcccatccctcctctccggccgcaaccccaccgccgccgccatggtgaagtactcgaggatccgtccaacccgaccaagtcggccaaggcctgtggcaaggatctcagggtccacttcaagaacacacgtgagacagcgtttgctcttcgcaagatggctttgggcaaggctaagaggtaccttgaggatgttctgcccacaagcaagcgattcccttccggagatactgcagaggtgtgggccgtactgcgcaagtaaagaaccgccagccaaatgggcagggtcgctggcctgcaaagncggcccagttcgtgttggatttgctgaagaatgctgagagtaacgcggaagttaaaggcttggatgtcgacaacctctacatttcacacatccaggtgaaccaagcccagaagcagaggcgccgtacataccgtgctcacggacgcatcaatccttacatgtccaacccctgccacattgagctgatcttgtcagagaaggaagagcctgtgaagaaggaggccgacaatgtcgtcgcaccaaggaaagctatctaagctaatggagtggcngcagtcgtccaagaatcttagctgtagttcttttcaagtacctttaaaggcagtgtntcttgcctccttgatgtttntggtaccaanatggagtaatgatntgttaaggntgatgctatccttgtgattgctaatggtctttatatgctaaaacagtctcagatatttgagcatntagcccaccagaacttat

SEQ ID NO: 1178 - DNA, 943 bp, Brachypodium distachyon
tctcgcgtcctcctcttagacctccgccgccgactcattgagccctctgtttggagagttcgtgccaaggccacccccttccctcctcgctctcctcctctccgtccgccgccgccgccgccgccatggtgaagtactcgcgggacccgtccaacccgaccaagtcggccaaggcatgtggcaaggatctcagggtccacttcaagaacaccagggagacagcgttcgcgcttcgcaagatgcctttggttaaggctaagaggtaccttgaggatgttctcgcccacaaacaagcgattcccttccggaggtactgtaggggtgtgggccgtactgcacaagcaaagaatcgccagtcaaatgggcaaggtcgctggcctgcaaaatcagccaagttcgtgttggatttgctgaagaatgctgagagtaacgctgaggttaaaggtttggatgtcgacaccctttacatttcccacatccaggtgaaccaagcccagaagcagaggcgccgcacataccgtgctcatggacgcattaatccttacatgtccaatccctgccacattgagctgatcttgtcagagaaggaagagcctgtgaagaaagagcctgacaacgtcgtcgcaccgaggaaagctatgtaatcgtgcagtgatattcatccaagaatcgtagctgtagttctttttgagtactttttgtggcagtgttgcccttttcatctttctggtatcgatattgagtcagactttgttaaggttgatgctatccttgtgatgcgaattgtatgctaaaacattttcagatatttggtcagttgtctacttaaatttatttgctgaagatgcttgttcatcagttcacttcaagcatctactttctacattgcttataatgttcttggtaactcctattaatgcacgtctgaaggttggtcattatt

SEQ ID NO: 1179 - DNA, 934 bp, Brachypodium distachyon
gcgtcctcctcttagacctccgccgccgactcattgagccctctgtttggagagttcgtgccaaggccacccccttccctcctcgctctcctcctctccgtccgccgccgccgccgccgccatggtgaagtactcgcgggacccgtccaacccgaccaagtcggccaaggcatgtggcaaggatctcagggtccacttcaagaacaccagggagacagcgttcgcgcttcgcaagatgcctttggttaaggctaagaggtaccttgaggatgttctcgcccacaaacaagcgattcccttccggaggtactgtaggggtgtgggccgtactgcacaagcaaagaatcgccagtcaaatgggcaaggtcgctggcctgcaaaatcagccaagttcgtgttggatttgctgaagaatgctgagagtaacgctgaggttaaaggtttggatgtcgacaccctttacatttcccacatccaggtgaaccaagcccagaagcagaggcgccgcacataccgtgctcatggacgcattaatccttacatgtccaatccctgccacattgagctgatcttgtcagagaaggaagagcctgtgaagaaagagcctgacaacgtcgtcgcaccgaggaaagctatgtaatcgtgcagtgatattcatccaagaatcgtagctgtagttctttttgagtactttttgtggcagtgttgcccttttcatctttctggtatcgatattgagtcagactttgttaaggttgatgctatccttgtgatgcgaattgtatgctaaaacattttcagatatttggtcagttgtctacttaaatttatttgctgaagatgcttgttcatcagttcacttcaagcatctactttctacattgcttataatgttcttggtaactcctattaatgcacgtctgaaggttggtca

SEQ ID NO: 1180 - DNA, 868 bp, Avena sativa
cggcacgagggcattctctgttcggagagttcgtgagaaggccagccctccgtatcccgttcctcctcctctccggccgcacccccaccgccgccgccatggtgaagtactcgagggatccgtccaacccgaccaagtcggccaaggcctgtggcaaggatctcagggtccacttcaagaacacacgcgagacagcgtttgcccttcgcaagatgcctttgaacaaggctaagaggtaccttgaggatgttttggcccacaagcaagctattcccttcaggaggtactgcagaggtgttggccgtacagcacaagcaaagaaccgccagccaaatggtcagggtcgctggcctgcaaagtcagcccagttcgtgctggatttgctgaagaatgctgagagtaatgctgaggttaaaggcttggatgtggacagcctctacatttcacacatccaggtgaaccaagccatgaagcagaggcggcgcacataccgtgctcatggacgcattaatccttacatgtccaatccctgccacatcgagcttatcttgtcagagaaggaagagcccgtgaagaaggagcctgacaacgtcgtcgcacaaaggaaagctgtttaagcccatgggagtgaccttatccaaccaagaatccgtccaagagttgtagctgtagttctttccaagtgcctttatgtcaatgttgcctttccaattgcctttaagttaatccaatgtttgagtcaggatttgttaaggttgatgcgatccttgtgattgcgaatggtcgttatatgctaaaactgtttcatatatttgagcagtgcctattggaacttatagccgaatatgcgtgtcttgttcggctgttc

SEQ ID NO: 1181 - DNA, 889 bp, Avena sativa
ctgttcggagagttcgtgagaaggccagccctccatatccccttcctcctcctctccggcctccgccgccgccgccgccatggtgaagtactcgagggatccgtccaacccgaccaagtcggccaaggcctgtggcaaggatctcagggtccacttcaagaacacccgtgagacagcgtttgcccttcgcaagatgcctttgaacaaggctaagaggtaccttgaggatgttttggcccacaagcaagctattcccttcaggaggtactgcagaggtgttggccgtaccgcacaagcaaagaaccgccagccaaatgggcagggtcgctggcctgcaaagtcagcccagttcgtgttggatttgctgaagaatgctgagagtaacgctgaggttaaaggcttggatgtggacagcctctacatttcacacatccaggtgaaccaagccatgaagcagaggcgccgcacataccgtgctcacggacgcattaatccttacatgtccaatccctgccacattgagctgatcttgtcagagaaggaagagcccgtgaagaaggagcctgacaacgtcgttgcacagaggaaagctgtgtaaggccatggagtgaccgtatccgtccatgaatcgtagctgtagtttctttccaagtgcctttatgtcagtgttgcatccttgatgtatttgataccaatgttttgagtcgggatttgttaaggttgatgcgatccttgtgattgcgaatggtcgttatatgctaaaacagtttcctatatttgagcagtgcctattgaaacttatattggccaaaaatgcatgtcttgtttggctgttcacttcaaagtattctatgcacttactgattgcttaaccaaaaaaaaaaaaaaa

SEQ ID NO: 1182 - DNA, 793 bp, Avena sativa
ctcgctctcgccgccgccgttgccttgccctccgcgccgccgcagccatggtgaagtactcgacggatcccgtcaatcccaccaagtccgccaaggccatgggccgggacctgcgtgttcatttcaagaacaccagggagacagcgttcgccctcaggaagatgccactgaacaaggctaaaaggtacctggaggatgtgctcgcccacaagcaagccatccccttccgtaggtactgtcgtggtgttggacgtactgcccaagctaagaaccgccagcctaatggtcagggacgctggcctgccaagtctgctcagtttgttctggatcttcttaagaacgctgagagcaatgctgaggtgaaaggtctggatgttgacgctctctacatctcacacatccaagtgaaccaggcccagaagcagcggcgtcggacctaccgtgctcatggacgcatcaacccctacatgtctaacccgtgccacatcgagctcatcttgtccgagaaggaagagccagtgaagaaagaggctgagtcccagattgcacccaggaaggcctagaggaagaaagcttggcaaacttgtccgcctattcgttagagcagtttgtagcatctgggtttggctgagtggaaattttggcctgttatcatctgtcatcgtctaaatactgctagctcatactttgttgaaccgttgatgatcgtcttgtgtactcgatcgaatctggttgtgtttcatatttttcatattggcttcctagtgttgaatcgttccagtttgcaggattg

SEQ ID NO: 1183 - DNA, 744 bp, Avena sativa
gccctcgctctcgccgccgccgctgccttgcccttctcgccgccgcagccatggtgaagtactcgacggatcccgtcaatcccaccaagtccgccaaggcaatgggccgggacctgcgtgttcatttcaagaacaccagggagacagcgttcgccctcaggaagatgccactgaacaaggctaaaagatacctggaggatgtgctcgcccacaagcaagccatccccttccgtaggtactgccgtggtgttggacgtactgcccaagctaagaaccgccagccaaatggtcagggacgctggcctgccaagtctgctcagtttgttctggatcttctcaagaatgctgagagcaatgctgaggtgaaaggtctggatgttgatgctctctacatctcacacatccaagtgaaccaggcccagaagcagcggcgtcggacctaccgtgctcatggacgcatcaacccctacatgtctaacccgtgccacattgagctcatcttgtccgagaaggaagagccagtgaagaaagaggctgagtcccagattgcaccaaggaaggcctaagaggaagaagctattcgttagagcagtttgtagcatctctgggtttggctgagtggaaattttggcctgttatcatctgtcatcgtctaaatactgctagctcatactttgtgaaccattgatgatcgtcttgtgtactcgatctattctggttgtgtttgatatttttcatattggc

SEQ ID NO: 1184 - DNA, 929 bp, Avena sativa
gctgccttgccctccgcgccgccgcagccatggtgaagtactcgacggatcccgtcaatcccaccaagtccgccaaggccatgggccgggacctgcgtgttcatttcaagaacaccagggagacagcgtttgccctcaggaagatgccactgaacaaggctaaaaggtacctggaggatgttcttgcccacaagcaagccatccccttccgtaggtactgccgtggtgttggacgtactgcccaagctaagaaccgccagcctaatggtcagggacgctggcctgccaagtctgctcagttcgttctggatcttctcaagaacgctgagagcaatgctgaggtgaaaggtctggatgttgatgctctctacatctcacacatccaggtgaaccaggcccagaaacagcggcgtcggacctaccgtgctcatggacgcatcaacccctacatgtctaacccgtgccacatcgagctcatcttgtccgagaaggaagagccagtgaagaaagaggctgagtcccagattgcacccaggaaggcctagaggaagaaagcttggcatacttgtccgcctattcgttagagcagtttgtagcatctgggtttggctgagtcgaaattttggcctgttatcatctgtcatcgtctaaatactgctagctcatactttgttgaaccgttgatgatcgtcttgtgtactcgatcgattctggttgtgtttgatatttttcatattggcttccaagtgttgaatcgttccagttgcaggattgctcacgtttgaacacttaccatcggaatcccgtagattgaaaatcacagattaaagaatttgtactgctggctttcgtagtagttttgtcgctgaagtaaattggacactcaaatgggcagtttgcaatatattgagttgaacgaagttaactac

SEQ ID NO: 1185 - DNA, 866 bp, Hordeum vulgare
ccgccgctgtgttctctcccgcgccgacgcagccatggtgaagtactcgacggatcccgcgaatcccaccaagtccgccaaggccatgggccgcgacctgcgtgttcatttcaagaacactagggaaacagcgtttgccctgaggaagatgccgctgaacaaggctaagaggtaccttgaggatgtgttggcacacaagcaagccatccccttccggaggtactgccgtggtgttggacgcacggcccaggttaagaaccgtcagccaaatggtcagggacgctggcctgccaagtctgctaagttcgttctggatcttctaaagaacgcagagagcaatgctgaggtgaaaggtcttgatgtggatgctctctacatttcgcacatccaagtgaaccaggcccagaagcagcggcgcaggacctaccgtgctcatggacgcatcaacccctacatgtccaacccatgccacattgagctgatcttgtctgagaaggaagagccggtgaagaaggaggctgagtcccagattgccaggaaggcctagagaaggaagctctacatcatctgtccacctattcgttagagcactttgtagcatctggtttggctgagtggaatttttgccctgttatctgtcgtctaaatactgctagctcatactttgtgaaagtctcttctaatggattcgatctggttgtgttttggaatatttttcatcgtatcttatgggtgttggtttgctgctctcaacacctgcttgattcctcgaatagcccctacgttggatttgaagctgtgtgcattgtagttaattgcggcatgtgatgagtggttatgatattaactacaattttaactgtcca

SEQ ID NO: 1186 - DNA, 974 bp, Hordeum vulgare
cccatcccctcgctctcgccgccgccgctgtgttctctcccgcgccgacgcagccatggtgaagtactcgacggatcccgcgaatcccaccaagtccgccaaggccatgggccgcgacctgcgtgttcatttcaagaacactagggaaacagcgtttgccctgaggaagatgccgctgaacaaggctaagaggtaccttgaggatgtgttggcacacaagcaagccatccccttccggaggtactgccgtggtgttggacgcacggcccaggttaagaaccgtcagccaaatggtcagggacgctggcctgccaagtctgctaagttcgttctggatcttctaaagaacgcagagagcaatgctgaggtgaaaggtcttgatgtggatgctctctacatttcgcacatccaagtgaaccaggcccagaagcagcggcgcaggacctaccgtgctcatggacgcatcaacccctacatgtccaacccatgccacattgagctgatcttgtctgagaaggaagagccggtgaagaaggaggctgagtcccagattgccaggaaggcctagagaaggaagctctacatcatctgtccacctattcgttagagcactttgtagcatctggtttggctgagtggaatttttgccctgttatctgtcgtctaaatactgctagctcatactttgtgaaagtctcttctaatggattcgatctggttgtgttttggaatatttttcatcgtatcttatgggtgttggtttgctgctctcaacacctgcttgattcctcgaatggcccctacgttggatttgaagctgtgtgcattgtagttaattgcggcatgtgatgagtggttatgatattaactacaattttaactgtccatttcaaaaagcatacgtagtggcaaataagtataacacaactgttttgtgataggagtaatccatcataatcttttccctcgcctta

SEQ ID NO: 1187 - DNA, 971 bp, Secale cereale
ataattggctttgctggctgctgctgccactcatcaacaacctctccgctttctccttcccgtctctctcctctcctctggtcccgattcccttctccgagctcctcccctataaataatggcggccagggcggctacggcggccagggccatggtgaagtactcgacggatcccgccaatcccaccaagtccgccaaggccatgggccgggacctgcgtgttcatttcaagaacacgagggaaacagcgttttccctgaggaagatgccactgaacaaggccaagaggtaccttgaggatgtgttggcacacaagcaagctatccccttccggaggtactgccgtggtgttgggcgtacggcccaggttaagaaccgccagccaaatggtcagggacgctggcctgccaagtctgctaagttcgttctggatcttcttaagaacgcagagagcaatgctgaggtgaaaggtcttgatgttgatgctctctacatttcacacattcaagtgaaccaggcccagaagcagcggcgcaggacctaccgtgctcatggacgcatcaacccctacatgtccaacccttgccacatcgagctgatcttgtcggagaaggaagagccagtgaagaaggaggctgagtcgcagattgccaggaaggcctagagaaggaagctctacataacctatccgcctattcgttagaggagtttgtagcatcttgtttggctgagtggaaatttttggcctgttatctgtcttctaaatactgctagctcatactttgtgaaacccttgatgatcgtctcatgtactggattcaatctggttgtgttttggaatatttttcatcgtatgagtggtagtttgctattagcaactcctgttctttccctaaaatgatccttacgttagagcatctctagtggtctatgccaaatttggactcgcatgcaaaaaaaacgtcttctgg

SEQ ID NO: 1188 - DNA, 768 bp, Secale cereale
gccttctctgccccgccgccgcagccatggtgaagtactcgacggatcccgccaatcccaccaagtccgccaaggccatgggccgggacctgcgtgttcatttcaagaacacgagggaaacagcgttttccctgaggaagatgccactgaacaaggccaagaggtaccttgaggatgtgttggcacacaagcaagctatccccttccggaggtactgccgtggtgttgggcgtacggcccaggttaaaaaccgccagccaaatggtcagggacgctggcctgccaagtctgctaagttcgttctggatcttcttaagaatgcagagagcaatgctgaggtgaaaggtcttgatgttgatgctctatacatttcacacattcaagtgaaccaggcccagaagcagcggcgcaggacctaccgtgctcatggacgcatcaacccctacatgtccaacccttgccacatcgagctgatcttgtcggagaaggaagagccggtgaagaaggaggccgagtcgcagattgccaggaaggcctagagaaggaagctctacataacctatccgcctattcgttagagcagtttgtagcatctggtttggctgagtggaaatttttggcctgttatctgtcgtctaaatactgctagctcatactttgtgaaacccttgatgatcgtctcatgtactggattcaatctggttgtgttttggaatatttttcatcctatgagtggtagtttgctattagcaactcctgttcgattcc

SEQ ID NO: 1189 - DNA, 697 bp, Pseudoroegneria spicata
  misc_feature (6)..(6): n is a, c, g, or t
  misc_feature (8)..(9): n is a, c, g, or t
ccgccncnncatggtgaagtactcgacggatcccgccaatcccaccaagtccgccaaggccatgggccgggacctgcgtgttcatttcaagaacactagggaaacagcgtttgccctgaggaagatgtcgctgaacaaggccaagaggtaccttgaggatgtgttggcacacaagcaagccatccccttccggaggtactgccgtggtgttggacgtacggcccaggttaagaaccgtcagccaaatgggcagggacgctggcctgccaagtctgctaagttcgttctggatcttcttaagaatgcagagagcaatgctgaggtgaaaggtcttgatgttgatgctctctacatttcgcacattcaagtgaaccaggcccagaagcagcggcgccggacctaccgtgctcatggacgcatcaacccctacatgtccaacccttgccacatcgagctgatcttgtcggagaaggaggagccggtgaagaaggaggccgagtcccagattgccaggaaggcctagagaaggaagctctacataacctatccgcctattcgttagagcagtttgtagcatctggtttggctgagtggaatttttggcctgttatctgtcgtctaaatactgctagctcatactttgtgaaacccttgatgatcgtctcatgtactggattcaatctggttgtgttctgga

SEQ ID NO: 1190 - DNA, 835 bp, Triticum aestivum
gccgccgccgctgccttctctcccgcgccgccgcagccatggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaagaaccgtcagcccaatggtcagggacgctggcctgccaagtctgctaagttcgttctggatcttctaaagaacgctgagagcaatgctgaggtgaaaggtcttgatgttgatgctctctacatttcacacatccaagtgaaccaggcccagaagcagcggcgccggacctaccgtgcccatggacgcatcaacccctacatgtccaacccatgccacattgagctgatcttgtcggagaaggaagagccggtgaagaaggaggctgagtcccagatcgccaggaaggcctagagaaggaagctctacataacctatccgcctattcgttagagcagtttgtagcatctggtttggctgagtggaaatttttggcctgttatctgtcgtctaaatactgctagctcatactttgtgaaaccctttgatgatcgtctcatgtactggattcaatctggttgtgttttggaatatttttcatcgtatgagtgctagtttgctattagcaactcctgtttgatctgtcaaatgatccctacgttatgctatcccgcatcattatataacttggttgatgg

SEQ ID NO: 1191 - DNA, 897 bp, Triticum aestivum
ccgccgcagccatggtgaagtactcgacggatcccgccaatcccaccaagtccgccaaggccatgggccgggacctgcgtgttcatttcaagaacactagggaaacagcgtttgccctgaggaagatgtcgctcaacaaggccaagaggtaccttgaggatgtgttggcacacaagcaagccatccccttccggaggtactgccgtggtgttggacgcacagcccaggtgaagaaccgtcagcccaatggtcagggacgctggcctgccaagtctgctaagttcgttctggatcttctaaagaatgctgagagcaatgctgaggtgaaaggtcttgatgttgatgctctctacatttcacacatccaagtgaaccaggcccagaagcagcggcgccggacctaccgtgcccatggacgcatcaacccctacatgtccaacccatgccacattgagctgatcttgtcggagaaggaagagccggtgaagaaggaggctgagtcccagatcgccaggaaggcctagagaaggaagctctacataacctatctgcctattcgttagagcagtttgtagcatctggtctggctgagtcgaaatttttggcctgttatctgtcgtctaaatactgctagctcatactttgtgaaaccttttgatgatcgtctcatgtactggattcaatctggttgtgttttggaatatttttcatcgtatgagtgctagtttgctattagcaactcctgtttgatctgtcaaatgatccctacgttatgctatcctgcatcattgtataacttagttgagggaacgcataaattgcttataaaaaatcgcccaaaccatgattttaaatgacctttgcggtgtcctcgacgaacaaaacagattcttacga

SEQ ID NO: 1192 - DNA, 910 bp, Triticum aestivum
gccgccgccgctgccttgtctaccgcgccgccgcagccatggtgaagtactcaacggatcccgccaatcccaccaagtccgccaaggccatgggccgggacctgcgtgtgcatttcaagaacacgagggaaacagcgtttgccctgaggaagatgtcattgaacaaagccaagaggtaccttgaggatgtgttggcacacaagcaagctatccccttccggaggtactgccgtggtgttgggcgtacagcccaggttaagaaccgccagccaaatggtcagggacgctggcctgccaagtctgctaagttcgttctggatcttcttaagaacgcagagagcaatgctgaggtgaaaggtcttgatgtcgatgctctctacatttcacacatccaagtgaaccaggcccagaagcagcggcgccggacctaccgtgcccatggacgcatcaacccctacatgtccaacccttgccacatcgagctgatcttgtcggagaaggaagagccggtgaagaaggaggctgagtcccagatcgccaggaaggcctagagaaggaagctctacataacctatccccctattcgttagagcagcttgtagcatctggtttggctgagtggaaattttggcctgttatctgtcgtctaaatactgctagctcatactttgtgaaacctttgatgatgtctcatgtactggattcaatctggttgtgttttggaatatttttcatcgcatgagttttcctttgctattactgtttgatccctacgttatgctgtcccgcatcagtatgtaacttagttgatgaaacacataaattccttgtaaagaatcgcccacatccaagattttaagcgcccgttatactattttcaactttgcgatgtccttgacgaaaaaaaaaa

SEQ ID NO: 1193 - DNA, 972 bp, Brachypodium distachyon
atataaatgacatcttcctcttcccttcttcatccctcgctgccgccgccgccgctgctcccatcacaccgcaactgctccgctccggccgcagccatggtgaagtactccacggatcccgctaatcccaccaagtccgcgaaggccatgggacgggacttgcgtgtgcactttaagaacacacgggagacagcgtttgccctgaggaagatgccactgggcaaggctaaaaggtaccttgaggatgtgttagcccacaagcaagcgatccctttccgtaggtactgccgtggtgttggacgcactgcccaagctaagaatcgccagtcaaatggtcagggacgctggcctgccaagtccgctaaatttgttctggatcttctcaagaatgctgagagcaatgctgaggtgaagggtctggatgttgatgctctctacatatcacacattcaagtgaaccaagcccagaaacagcggcgtcggacctaccgtgctcatggacgcatcaacccctacatgtctaacccgtgccacattgagctgatcctgtccgagaaggaagagcctgtgaagaaagagccggagtcccagattgcatccaggaaggcttagagaaggaagcttctcatacttctccacctgttagagataattgtagcgtctggtttggctgagtgaaaattttggctggttatctgtcgtctaaatactgctagttcatacttgttgaacctttgatgatcacccacctgtatctcatcgaatctggttctgttcttgaatattttccgtagcatcaaccatctggtatgcaattcagctcgcgtttgagatattcagtagctgtgaaccattctttgtttcctgtggtcatggcgaagcaaaaatgcaaaatagtaaaagtcaacaataatcccagcgtcacgtgacagggcacgtcttctctctgcattactggtgatacttttcccc

SEQ ID NO: 1194 - DNA, 897 bp, Brachypodium distachyon
aaatgacatcttcctcttcccttcttcatccctcgctgccgccgccgccgctgctcccatcacaccgcaactgctccgctccggccgcagccatggtgaagtactccacggatcccgctaatcccaccaagtccgcgaaggccatgggacgggacttgcgtgtgcactttaagaacacacgggagacagcgtttgccctgaggaagatgccactgggcaaggctaaaaggtaccttgaggatgtgttagcccacaagcaagcgatccctttccgtaggtactgccgtggtgttggacgcactgcccaagctaagaatcgccagtcaaatggtcagggacgctggcctgccaagtccgctaaatttgttctggatcttctcaagaatgctgagagcaatgctgaggtgaagggtctggatgttgatgctctctacatatcacacattcaagtgaaccaagcccagaaacagcggcgtcggacctaccgtgctcatggacgcatcaacccctacatgtctaacccgtgccacattgagctgatcctgtccgagaaggaagagcctgtgaagaaagagccggagtcccagattgcatccaggaaggcttagagaaggaagcttctcatacttctccacctgttagagataattgtagcgtctggtttggctgagtgaaaattttggctggttatctgtcgtctaaatactgctagttcatacttgttgaacctttgatgatcacccacctgtatctcatcgaatctggttctgttcttgaatattttccgtagcatcaaccatctggtatgcaattcagctcgcgtttgagatattcagtagctgtgaaccattctttgtttcctgtggtcatggcgaagcaaaaatgcaaaatagtaaa

SEQ ID NO: 1195 - DNA, 749 bp, Secale cereale
  misc_feature (724)..(724): n is a, c, g, or t
ctcgccgccgccgctgccttctctgccccgccgccgcagccatggtgaagtactcgacggatcccgccaatcccaccaagtccgccaaggccatgggccgggacctgcgtgttcatttcaagaacacgagggaaacagcgttttccctgaggaagatgtcactgaacaaggccaagaggtaccttgaggatgtgtggcacacaagcaagctatccccttccggaggtactgccgtggtgttgggcgtacggcccaggttaagaaccgccagccaaatggtcagggacgctggcctgccaagtctgctaagttcgttctggatcttcttaagaacgcagagagcaatgctgaggtgaaaggtcttgatgttgatgctctctacatttcacacattcaagtgaaccaggcccagaagcagcggcgcaggacctaccgtgctcatggacgcatcaacccctacatgtccaacccttgccacatcgagctgatcttgtcggagaaggaagagccagtgaagaaggaggctgagtcgcagattgccaggaaggcctagagaaggaagctctacataacctatccgcctattcgttagaggagtttgtagcatcttgtttggctgagtggaaatttttggcctgttatctgtcttctaaatactgctagctcatactttgtgaaacccttgatgatcgtctcatgtactggattcaatctggttgtgttntggaatatttttcatcgtatgagtg

SEQ ID NO: 1196 - DNA, 925 bp, Pennisetum glaucum
cacctgcagcagcagcggcaggtgccgctcatgacgtcctcgccgcagacgcctgccttccgcctcgcggccgccctctcgccggttgcagccatggtgaagtactcgagggatccgtccaaccccaccaagtccgccaaggccatgggtcgggacctccgtgttcacttcaagaacacccgtgagacagcatttgctctcaggaagatgcccctcactaaggccaagaggtaccttgaggatgtgcttgcccacaagcaggccatccccttccgcaggtactgtggcggtgttggccgtactgctcaggctaagtcgcgccactcaaatggacagggacgctggcctgtcaagtctgctagattcattctagatcttctcaagaatgcagagagcaatgctgaggtcaaaggtcttgatgttgataccctctatatatcgcacattcaagtgaaccaggctcagaagcagcggcgcaggacataccgtgctcatggacgcatcaacccttacatgtcttccccgtgccacattgagctgatcctgtcggaaaaggaagagccagtgaagaaagaggctgagtctcagatcgcaaccaggaaagcttagagaaggaagggagctctgcagtattagagtggatcatagtgtgtctttggctgggtgaaatttttggccgattatctgtcaccacttttattactgtactgctaagctcatacttttgtcaccttgatcactgtctgtactgtgcattcaacacaaagctccggatcaagtgtttgtggattctcttcgcatttgtatcgatggtgacgtctttggttattaattgcctagctagggacgtttgcacagttcctttgttgggttttgatttgttgtttcgtctcgttagtgaaatttccgtaatagtaagttggat

SEQ ID NO: 1197 - DNA, 553 bp, Secale cereale
gttcgtgcaaaggccagcactcaccctcccatccctcctctccggccgcaaccccaccgccgccgccatggtgaagtactcgagggatccgtccaacccgaccaagtcggccaaggcctcgtggcaaggatctcagggtccacttcaagaacacacgtgagacagcgtttgctcttcgcaagatggctttgggcaaggctaagaggtaccttgaggatgttcttgcccacaagcaagcgattcccttccggagatactgcagaggtgtgggccgtactgcgcaagtaaagaaccgccagccaaatgggcagggtcgctggcctgcaaagtcggcccagttcgtgttggatttgctgaagaatgctgagagtaacgcggaagttaaggcttggatgtcgacaacctctacatttcacacatccaggtgaaccaagcccagaagcagaggcgccgtacataccgtgctcacggacgcatcaatccttacatgtccaacccctgcacattgtagctgatcttgttcagagaaggaagagcctcgtgagaaggaggc

SEQ ID NO: 1198 - DNA, 787 bp, Cynodon dactylon
ggggatacgttgctcccgctgcccgccgccgccgcctctccctccgcatcgaggcctcctcgccggctgcagccatggtgaagtactcgacggagccggtcaatcccaccaagtccgccaaggctatgggccgggacctccgtgttcacttcaagaacacccgtgagacagcgtttgccctaaggaagatgccactcaccaaggccaaaaggtatcttgaggatgtgattgcccacaagcaggccattcccttccgcaggtactgcggtggtgttgggcgcacggctcaggctaagaaccgccagccaaatgggcagggacgctggcctgcaaagtctgccaggttcatcctggatcttcttaagaatgccgaaagcaatgctgaggttaaaggcctggatgttgataccctctacatttcacacattcaagtgaaccaagctcagaagcagcgccgcaggacctaccgtgctcatggacgcatcaacccttacatgtcttccccatgccacattgaactcatcgtgtcggagaaggaggaacctgtgaagaaagaggctgagtctcagattgcgaccaggaaggcctagagtaggaggctgttcataccttaggttggagcagatcccatctggcttgtatctggcattggctgagtgaaaattttgactgattatcttgttatctattatctgaatattgttagctcactgtgccaactcttgtcagtgtctgtacttgtgccctatcacaagaattcgaaaccctaaagaagtggttctggatc

SEQ ID NO: 1199 - DNA, 780 bp, Pennisetum glaucum
gccgccgccgccgcagacgcctgcctcccgcctcgcggccgctcgctcgctcgctcgccggttgcagccatggtgaagtactcgagggatccgtccaaccccaccaagtccgccaaggccatgggccgggacctccgtgttcacttcaagaacacccgtgagacagcatttgctctcaggaagatgcccctcactaaggccaagaggtacctcgaggatgtgcttgcccacaagcaggccatccccttccgcaggtactgtggcggtgttgggcgtactgctcaggctaagtcgcgccactcaaatggacagggacgctggcctgtcaagtctgctaggttcattctagatcttctcaagaacgcagagagcaacgctgaggtcaaaggccttgatgttgatgccctctacgtgtcgcacattcaagtgaaccaggctcagaagcagcggcgcaggacataccgtgctcatggacgcatcaacccttacatgtcttccccgtgccacattgagctgatcctgtctgaaaaggaagagccagtgaagaaagaggctgagtctcagattgcaaccaggaaggcttagagaagggaactcttctgcattactagagtggatttgtagcttttctttggttgagtggaaattttggccgattatctgccgtcactttttatcagtgtactgctatgctaagctcatacatttgttaccttgatcactgtctgtactgtgcatgcaactcaaagctctggatcaagtgtttgtggattcttttcg

SEQ ID NO: 1200 - DNA, 824 bp, Eragrostis curvula
  misc_feature (40)..(43): n is a, c, g, or t
  misc_feature (163)..(163): n is a, c, g, or t
aagagagaacccgcccgacgccagagcacgacgaccaagnnnntctcgtgttttgtggcttagcgctcttctgcccgcgcgcgcgctttccctccgcatcgaggtccgtcggcggctgagccatggtgaagtactccacggaaccggtcaatcccaccaagtncgccaaggccatgggccgggacctccgtgttcacttcaagaacacccgtgagacagcgtttgccctaaggaagttgccactcaccaaggcaaaaaggtacttgaggatgtgattgcccacaagcaggccattcccttccgcaggtactgtggtggtgttgggcgcacagctcaggcaaagaaccgccagccaaatgggcagggacgctggcctgcaaagtctgctaggttcattctggatcttctcaagaatgcagagagcaatgcagaggttaaaggtctggatgttgataccctctacatttctcacattcaagtgaaccaggctcagaagcagcgccgcaggacctaccgtgctcatggacgcatcaacccttacatgtcctccccatgccacattgagctgatcttgtcggagaaggaagagcccgtgaagaaagaggctgagtctcagatcgcgaccaggaaggcctagagtaggaagctttgtctaccttctactggagtggatcgtatctggaactgagtgaatttttggctgattgtatatcttgttctgttatctgaatattgctagctctcactttgccaagccttgtcactgtctgtactgtgccctgcacaaaaatcgaaatctaaagaagtcttgtggattgtttaat

SEQ ID NO: 1201 - DNA, 859 bp, Pennisetum glaucum
gggcccatctcagcggcttagcactagggtttccccacgtcttagaccgcagggcagccgccgccgccctcgctgcttcctcagttccgagtgttcgtgcgaactgcgaaggcgacccctccctccgccgccatggtgaagtactcgcaggaggcgggcaacccgaccaaatcggccaaggccatgggcagggatctcagggtccacttcaagaacacaagggagacagcctttgcacttcgcaagatgcctttggccaaggctaagcggtaccttgaggatgttatggctcacaagcaggcaattcccttccggagatactgtgggggtgttggtcgcactgctcaagcaaagtctcgccactcaaatggccagggtcgctggcctgtcaaatcagccaggttcatattggatttgctgaagaatgctgagagtaacgctgatgtgaaaggcttggatgtcgacaacctttatatttcacacatccaggtgaaccaagcccagaagcagaggcgtcgcacgtaccgtgctcatggacgcatcaatccttacatgtcctcaccttgccacattgagttgatcctgtcagagaaagaagagcctgttaagaaagagcctgacaacattgtcgcaccaaggaagcagtgaagtatgttagctagagcgaagctattttgtcgaagaattatagctgtagcttaccttgcagtcatgcctcttgagatgttcgcgattccaatgctttgaatcttgtcttgctaggtttggtgctgtgtaattgtacgggcaatatagtttaaacatacctgggcattttctgcttgatcaacttgatatggttataatgagatttattcat

SEQ ID NO: 1202 - DNA, 943 bp, Setaria italica
ggtttccccacgtcttagaccgccgccgccgccgccgctttcttcgttcgcctcggtgcttcctcagtgcagattgttcgtgcgaaggcgaccgtccctcctgcgccgccgcactcctctctccgccgccatggtgaagtactcgcaggaggcgggcaacccgacgaagtcggccaaggccatgggcagggatctcagggtccacttcaagaacacaagggagacagcctttgcacttcgcaagctgcctttggccaaggctaagcggtaccttgaggatgttatggctcacaagcaagcaattcccttccggagatactgcaggggtgttggtcgcactgctcaagcaaagtctcgccactcaaatggccagggtcgctggcctgtcaaatcagccaggttcatattggatttgctgaagaatgctgagagtaacgctgatgtgaaaggcttggatgtcgacaacctctatgtttcacacatccaggtgaaccaagcccagaagcagaggcgccgcacataccgtgctcatggacgcatcaatccttacatgtcctcaccttgccacattgagttgatcctgtcagagaaggaagagcctgttaagaaagagcctgacaacattgtcgcaccaaggaagcagtgaagtatgttagcttgagcgaggctattttgtcgaagaattatagctgtagctcttatgtgctttttcctggcagccttgcctcttgagatgttcctggttccaatgcttcgaatctggtcttgctaggtttgatgctgtgcttcagattgtacgcacaattcgtaatatattttacaatagtttaaaggtatctgggcactttgtctgcttgatcaacttgaatatggttatcatgagatttattcatccggatttggcgctgaactttgattacaaaagtttgctgtgtttaaagat

SEQ ID NO: 1203 - DNA, 908 bp, Zea mays
gatcagcaagcccatccgggcccctctagagcgcattagcactagggtttcccatctcttaaggctgccaccgccagcgccgccccctcggtgcatcctcagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaagtctcgccactccaatgggcagggtcgctggcctgttaagtcagccaggttcatattggatttgctgaagaatgctgagagtaacgctgatgtgaaaggcttggacgtggacaacctctatgtttcacacatccaggtgaaccaagcccagaagcagaggcgccgcacctaccgtgctcacggacgcattaacccttacatgtcctccccttgccacattgagctgattctgtcagagaaggaagagcctgtgaagaaagaggctgacaacattgtcgcggcaaggaagcagtgaagtatgttagcctgctgataatggcatcctttcgaagcattatagccgtagctcttttatgtaccttttcaggctggtaccgataccgtggatctggatttgctatgttttgtactgtgctcgagtgtaaggtcagttcgtaatacaatcaatctgcgtggaacaatttgatatccttgaatatgttagtgagatcatttcgacaatgaaagttgagaacagaagttacaatgtca

SEQ ID NO: 1204 - DNA, 808 bp, Pennisetum glaucum
ctcggtgcttcgtcagggcgaaattttcgtgcgaaggcagaccctccctaccgccgccgccgccatggtgaagtactcgcaggagtcgggcaaccctaccaagtcggccaaggccatgggcagggatctcagggtccatttcaagaatacaagggagacagcttttgcacttcgcaagatgcctttgaccaaagctaaacggtaccttgaggatgttatggcacacaaacaggcaattcccttccggagatactgcgggggcgttggtcgcactgcacaagcaaagtctcgccactcaaatggacagggacgctggcctgttaaatcagccaggttcattttggatctgctgaagaatgctgagagtaacgctgatgtgaaaggtttggatgtcgacaccctctatatttcacacatccaggtgaaccaagcccagaagcagaggcgccgcacgtaccgtgctcatggacgcatcaatccttacatgtcctcaccttgccacattgagcttatcctttcagagaaggaagagcctgtgaagaaagagcctgacaacattgtcgcaccaaggaagcagtgaagtatgcttaacttgctgagcgagaggcattttgtggaagagattatagttttagctcttttatgtacgttttctggcaagccttgcctaaagatatttcctgtactaatacttctgaatctggatttgttaagattgatgtcctgagggtatggtcaatttgtactcttgatctatctgggcacctgtctttgtgacacattgggtctgcttgaacattgtttgcat

SEQ ID NO: 1205 - DNA, 863 bp, Saccharum officinarum
tcctctcttctctggccattcctcgtctctctcgctcgctcgctcgccgccgccgccttcgggtttgctcgccagctgcagccatggtgaagtactcgagggagccgtccaaccccaccaaatccgccaaggctatgggtcgggacctgcgtgtgcactttaagaacacacgtgagacagcttttgccattaggaagctgcatctcgccaaggctaaaaggtatcttgaggatgtgattgcccacaaacaagccattcccttccgtaggtactgtggcggtgttggacgtacagcacaagctaagtctcgccactccaatggtcagggacgttggcctgccaagtctgctaggttcattttggatctactcaagaatgcagagagcaatgctgaggttaagggactggatgtcgatacactttatgtgtcgcatattcaggtgaatcaagctcagaagcagcggcgccggacttaccgtgcccatgggcgcatcaacccgtacatgtcttccccatgccacattgagctgatgctttcagagaaggaagagccagtgaagaaagaggctgatacccaaattgcacccaggaaggcttagaagatatgaagccttgtctagtatcagttagagtgaaccgatcgcctgtatcttcttttttctgtactggtggtgcatacttcatcgatccccagagtggaacatttctttctgcagttgtgacgacatccccagaatgagatgttgcctcagtagtagatttacttatttataatcctacattcctactaaactaccctggtgctggattttgtacaatcgttaatctccttgactaagagtgatcctttggtcagcacatca

SEQ ID NO: 1206 - DNA, 1008 bp, Saccharum officinarum
cacgaggcccctctagagcgccttatcactagggtttccccatctcttaggccgccgccgccaccgccgccgcctcggtgcttccttgctgcggagtgtccgtgcgaaggcgaccctccctccgctccttccccgcgcgcatcccgaccgccgccgccatggtgaagtactcgcaggagccgggcaaccctaccaagtcggccaaggccatgggcagggatctgagggtccacttcaagaacacaagggagacagcctttgcgcttcgcaagctgcctttgaccaaggctaagcgataccttgaggatgttattgctcacaagcaggcaattcccttccggagatactgtgggggtgttggtcgcaccgcgcaagcaaagtctcgccactccaatgggcagggtcgctggcctgttaaatcagccaggttcatattggatttgctgaagaatgctgagagtaacgctgatgtgaaaggcttggatgtggacaacctctatgtttcacacatccaggtgaaccaagcccagaagcagaggcgccgcacctaccgtgctcatggacgcatcaatccttatatgtcctcaccttgccacattgagctgatcctgtcagagaaggaagagcctgtgaagaaagaggccgacaacattgtcgcagcaaggaagcagtgaagtatattagcctgctgatcgagggcattttgtcgaagtagtatagccgtagctcttttatgtaccttttcaggcagccttgcttcttaagatgtttccggtacccatattttgaatcttgattttctatgttttgtactgtgcttgagtgtaaggtcagttcgtaatacaatagctctaagatatctgggcactcaatcttcgtggactaatttgatttacatgagtacaaacaggcgcggctgcgtgaccgctctgctctgccagagcttgagctgtaaatcatggctccacatgtaaaggttctggctcctcaaacacttcttgcgtggtc

SEQ ID NO: 1207 - DNA, 939 bp, Saccharum officinarum
ccgccgtctcggtgcttccttagtacggagcgttcgtgcgaaggcaaccttcccctccttcgctccttcccggtctcatcccgaccgccgccgccatggtgaagtactcgcaggagccgggcaaccctaccaagtcggccaaggccatgggcagggatctgagggtccacttcaagaacacaagggagacagcttttgcacttcgcaagctgcctttgaccaaggctaagcgataccttgaggatgttattgctcacaagcaggcaattcccttccggagatactgtgggggtgttggtcgcaccgcgcaagcaaagtctcgccactccaatgggcagggtcgctggcctgttaaatcagccaggttcatattggatttgctgaagaatgctgagagtaatgctgatgtgaaaggcttggatgtggacaacctctatgtttcacacatccaggtgaaccaagcccagaagcagaggcgccgcacctaccgtgctcatggacgcatcaatccttacatgtcctcaccttgccacattgagctgatcctgtcagagaaggaagagcctgtgaagaaagaggctgacaacattgtcgcagcaaggaagcagtgaagtattttagcctgctgatcgagggtattttgtcgaagaattatagctgtagctcttttttttttttttaccttttccggcagccttgcctctttaagatttttccagtaccgatattttgaatctggatttgggcactccgtccgcgtggactaatttgattgtgagattattcgagctgttccggtaatggtttctgcggctgataaaccggctgaagctgatttgttagagaaaaaacacattactatccaatattaataaacggggggggcccttttaaaggaatccaagttaccgtcccccggcctggcgacggaataactcc

SEQ ID NO: 1208 - DNA, 1009 bp, Panicum virgatum
ccgccgccgcctcgttgcttcgtcactcagtgcggagagtgttcgtgcgaaggctacccctccctcccctccacctccgcactccgaccgccgacgccatggtgaagtactcgcaggagccgggcaacccgaccaagtcggccaaggccatgggcagggatctcagggtccacttcaagaacacaagggagacagcttttgcacttcgcaagcttcctttggccaaggctaagcggtaccttgaggatgttatggctcacaagcaggcaattcccttccggagatactgcgggggcgttggtcgcactgctcaagcaaagtctcgccactcaaatggccagggtcgctggcctgtgaaatcagccaggttcatattggatttgctgaagaatgctgagagtaacgctgatgtgaaaggattggatgtcgacaacctctatgtttcacacatccaggtgaaccaagctcagaagcagaggcgtcgcacgtaccgtgctcatggacgcatcaatccttacatgtcctcaccttgccacattgagttgatcctgtcagagaaggaagagcctgttaagaaagaggctgacaatattgttgcatcaaggaagcagtgaagtacgttagcttgagcaaggctattttaatttgtcgaagaattatagctgtagctcttatgttctttttctggcagccttgcctcttgagatgttcctggttacaacgcttgaatcaggatttgctgagcttgatgctgtgcttcagattgtacgggggattctcaatatattttacaatagttttaagatatctgagcacatgtctgcttggactcatttgatcaacttgaatatggttatagcgagatttatttggccagactatgcattggaagttaattacaaaatttgcagtgttctaagatatatgggtcaagcagacatgattcttgtgagatttttccccaaccaaattttgcttgaagtgaatatggttaacttgagtgtttttc

SEQ ID NO: 1209 - DNA, 811 bp, Panicum virgatum
gagggtttccccgaccgccgccgcctgcgcctcgttgctttctcagccttcgtgcgaaggcgacccctccctcctccgccggcgcactccgacagccgacgccatggtgaagtactcgcaggagccgggcaacccgaccaagtcggctaaggccatgggcagggatctcagggtccacttcaagaacacaagggagacagcttttgcacttcgcaagctgcctttggccaaggctaagcggtaccttgaggatgttatggctcacaagcaggcaattcccttccggagatactgcgggggtgttggtcgcactgctcaggctaagtctcgccactcaaatgggcagggtcgctggcctgtgaaatcagccaagttcatattggatttgctgaagaatgctgagagtaacgctgatgtgaaaggcttggatgtcgacaacctctatgtttcacacatccaagtgaaccaagctcagaagcagaggcgtcgcacgtaccgtgctcatgggcgcatcaatccttacatgtcctcaccttgccacattgagttgatcctgtcagagaaggaagagcctgttaagaaagaggctgacaatattgtcgcatcaaggaagcagtgaagtatgttagcttgagcaaggctattttgtcgatgaattatagctgtagctcttatgttgtttttctggcagccttgcctcttgagatgttcctggttacaacgcttgaatcaggatttgctgagcttgatgttgtgcttcagattgtacgagcaattcgtaatatatttgaatttggttatagcgagattt

SEQ ID NO: 1210 - DNA, 803 bp, Allium cepa
atcgctccgcagcagccatggtgaagtattcaagagatccatcaaacccaacgaaatcatccaaggctatggggcagaatctgagggttcattttaagaatacccgggaaactgcatttgctctaaaaaagcttcctttggagaaggccaagaggtatcttgaagatgtgattgcgcacaagcaggctattccatttagaaggtactgtcgaggtgtaggtcgaactgcccaggcaaagaatcaccacccaaatggtcaggggcgatggcctgcaaagtctgcccagtttattcttgacctactcaagaacgctgagagcaatgctgatgttaaaggattggatgttgatgctttatatatttcccacattcaagtgaatcaggcccaaaagcagaggcgtaggacataccgagcccatggaagaatcaatccttacatgtcaaatccttgccacatcgaattgatcttgtcggagaaggaagaacctgttaagaaagagcgggaaacacaaatagcgacaacaaagccaaagaactaagcataagagttttcacatacaactcttttggattcccttctttgttttcgatttgtgggtgttgttgaagctagcagttttaagaattttgaatttgtttttggcatactatgagacttttttgttgtattctatgttagctatttgagtatttttacaaatatttccggttactttaagtttgtaatggtttatctgattttccaatggattagtggtttggaacttggtataagtatggtattattttaagagaactatgct

SEQ ID NO: 1211 - DNA, 772 bp, Cenchrus ciliaris
ctcgccgccgccgcagacgccacccttccgccttgcggcagcccgctcgccggttgcagccatggtgaagtactcgagggatccgaccaaccccaccaagtccgccaaggccatgggccgggacctccgtgttcacttcaagaacacccgtgagacagcatttgctctcaggaagttgtccctcactaaggccaagaggtaccttgaggatgtgattgcccacaagcaggccatccccttccgcaggtactgtggtggtgttgggcgtactgctcaggctaagtcgcgccactccaatggtcagggacgctggcctgttaagtctgctagattcattctagatcttctcaagaatgccgagagcaacgctgaggtcaaaggtcttgatgtcgataccctctacgtgtcgcacattcaagtgaaccaggctcagaaacagcggcgcaggacctaccgtgctcatggacgcatcaacccttacatgtcttccccgtgccacattgagctgatcttgtcggagaaggaagagccagtgaagaaagaggctgagtctcagatcgcaaccaggaaggcttagagaagggagctctgcagtattagcttatctttggctgagtgaaaattttggctgattatctgtcgtcagtgtactgctaagctcatacttttgtcaccttgatcactgtttgtactgtgcatgcaactcaatggtctggatcaagtgtttgtggattattttcgtatttgtatcgatggtgacgtctgcttatta

SEQ ID NO: 1212 - DNA, 1033 bp, Setaria italica
ttcccgtgccacctacataatctctctcgctcctgccgccgccgcttccttccccgcccctcgccgccgccgcagacgcctcccatccccctcgaggccgcccgctcgccggttgcagccatggtgaagtactcgagggagccgaccaaccccaccaagtccgccaaggccatgggccgggacctccgtgttcacttcaagaacacccgtgagacagcgtttgccctcaggaagttgtcactcaccaaggccaaaaggtaccttgaggatgtgattgctcacaagcaggccatccccttccggaggtactgcggcggtgttgggcgtactgctcaggttaagtcgcgccactccaatggacagggacgctggcccgttaagtctgctagattcattctagatcttctcaagaatgcagagagcaatgctgaggtcaaaggtcttgatgtcgataccctctatgtgtcgcacattcaagtgaaccaggctcagaagcagcggcgcaggacctaccgtgctcatggacgcatcaatccttacatgtcctccccatgccacattgagctgatcttgtcggagaaggaagagccagtgaagaaagaggctgagtctcagatcgcaaccaggaaggcttagagaagggagctctgcagtattagaatggattgtagcttgtctttggctgagtgaaaattttggccggttatctggtgtcacttttatcagtgtactgctggctcatacatttgtcaccttgatcactatctgtactgtgcatgcaactcaaagctctggatcgagtgtctgtggattcttttcatatttgtatcgatggtgacatcaatgcttgttaattgcctggtctaggggcgtttgcacagatcctttgtttggttgtggtttgttctatctcgtgagtaaaatttcagaaacttcacacatggttggagattgatacagactactctctcaatcctgagatacaggtattttggttccctccgtcttgaaatacaaggcattttggtttgtc

SEQ ID NO: 1213 - DNA, 969 bp, Zea mays
cacccggctttgtcctttaaaacccggtgtgacagtagcatacatgggcttctgagacacttgggccgtgcatatttcagcccgttcttttagctagcccatcagcccatttagagcgcgttagcactagggtttcaccagctcttaaggccgccgccgcctcggtgcctcctcgcttcgaagtgttcgtgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgtcgcagcaaggaagcagtgaagtatatcagcatgctgatcgaggccattttgtcgaagtattatagccgtagctcttttatgtaccttttcaggcagccttgcctctcgagacgtttccggcaccgatgttttaaatctggattatctatgttctgtactgaactactgtgttggactgtaagttcagctcgtaatacaatagctcttaagatatctgggcactta

SEQ ID NO: 1214 - DNA, 883 bp, Sorghum bicolor
ttctctcttctctggccattcctcgtctcgctcgctcgtcgccgccgccgccgccttcttcgggttcgctcgccagcggcagccatggtgaagtactcgagggaaccgtccaatcccaccaaatccgctaaggctatgggtcgggacctgcgtgtgcactttaagaacacacgtgagaccgcttttgccatcaggaagctgcagttgagcaaggctaaaaggtatcttgaggatgtgattgcccacaagcaagccattcccttccgaaggtactgtggcggtgttggacgtacagcacaagctaagtcccgccactcgaatggtcagggacgttggcctgccaagtctgctaaattcattttggatcttctcaagaatgcagagagcaatgctgaagttaagggattggatgtcgatacgctgtatgtgtcgcatattcaggtgaaccaagctcagaagcagcggcgccggacttaccgtgctcatgggcgcatcaacccttacatgtcttccccatgccacattgagctgatgctttcagagaaggaagagccagtgaagaaagaggctgagacccaaattgcacccaggaaggcctagaagatatgaagccttgtttagtatcagttagagtgaaccgatcgcctgtatctcgttttttctgtactgttgatgcatacttcatcgatacccagaatggaacatttatttctgcagttgtgaccacatccccagaatgagaatgttgcctcagtagatttcctcatttataatccaactaaactacctcggtgctggattttgtacaatcgttatctccttgactaagagcgatcattaggtcagcacatcatatacatgagagtctgacatattctccata

SEQ ID NO: 1215 - DNA, 1338 bp, Sorghum bicolor
ctctcttctctggccattcctcgtctcgctcgctcgtcgccgccgccgccgccttcttcgggttcgctcgccagcggcagccatggtgaagtactcgagggaaccgtccaatcccaccaaatccgctaaggctatgggtcgggacctgcgtgtgcactttaagaacacacgtgagaccgcttttgccatcaggaagctgcagttgagcaaggctaaaaggtatcttgaggatgtgattgcccacaagcaagccattcccttccgaaggtactgtggcggtgttggacgtacagcacaagctaagtcccgccactcgaatggtcagggacgttggcctgccaagtctgctaaattcattttggatcttctcaagaatgcagagagcaatgctgaagttaagggattggatgtcgatacgctgtatgtgtcgcatattcaggtgaaccaagctcagaagcagcggcgccggacttaccgtgctcatgggcgcatcaacccttacatgtcttccccatgccacattgagctgatgctttcagagaaggaagagccagtgaagaaagaggctgagacccaaattgcacccaggaaggcctagaagatatgaagccttgtttagtatcagttagagtgaaccgatcgcctgtatctcgttttttctgtactgttgatgcatacttcatcgatacccagaatggaacatttatttctgcagttgtgaccacatccccagaatgagaatgttgcctcagtagatttcctcatttataatccaactaaactacctcggtgctggattttgtacaatcgttatctccttgactaagagcgatcattaggtcagcacatcatatacatgagagtctgacatattctccatactgtgcctacatcatacagttaggtgaatttcacttatacgtggctatgaggatatctcatcctgaaggtgagctagatatgtgttcccatgcccaagcctcagggggactgttttgacgatgcagttgaagcataatttcagatgcacgtgtcaagtgtcaacaccatccaaaccttaaacattagtcctatctttaacaaaaatgttgtttgcatcttcagagtctggagaaagaatcccgacttgagttccagtctcggtacctgatctggccattttaccagaaagagtgatactatatgctattttatgctcatcgcctcatttttaaattctaaaatacgactgaagaactgttgttcatattacttaatttccatgctagagttatgtccattgtgattctgaatttttaatggttttgctgatttcgggtggtagagaaatgaccaaac

SEQ ID NO: 1216 - DNA, 817 bp, Panicum virgatum
cgcgtccggccgccgccgctttcttgcccacccctcgccgccgcgcagacgcctccctccgcctcgaggcttccgctcgccggtcgcagccatggtgaagtactcgagggagccgaacaaccccaccaagtccgccaaggccatgggccgggacctccgtgttcacttcaagaacacccgtgagacagcttttgccctcaggaagttgcctctcactaaggccaaaaggtaccttgaggatgtgattgcccacaagcaggccatccccttccgcaggtactgtggcggtgttgggcgtactgctcaggctaagtcacgccactcaaatggacagggacgctggcctgtcaagtctgctagattcattcttgatcttctaaagaatgcggagagcaatgctgaggtcaaaggtcttgatgtcgataccctgtatgtgtcgcacattcaagtaaatcaggctcagaagcagcggcggaggacctaccgtgctcatggacgcatcaacccttacatgtcctccccgtgccacattgagctgatcttgtcggagaaggaagagccagtgaagaaagaggcggagtctcagattgcgaccaggaaggcttaaacaagggagctctgcggtgttagagtggattgtaggtcgtcgttgcctaagtgaaaattttggctggttatctgtcgcctcctttatcagtgtactgctagctcgtactgtcaccttgatcagtgtctgtactgcctatacaattcgaaactatgaatgaagtgtttgtggattctttccatatttatattgatgatgatgtcaatgctc

SEQ ID NO: 1217 - DNA, 817 bp, Panicum virgatum
ggcccacccctcgccgccgccgcagcagcagacgcatccctacgccggtcgcagccatggtgaagtactcaagggagccgaacaaccccaccaagtccgccaaggccatgggccgggacctccgtgttcacttcaagaacacccgtgagacagcttttgccctcaggaagttgcctctcactaaggccaaaaggtaccttgaggatgtgattgcccacaagcaggccatccccttccgcaggtactgtggcggtgttgggcgtactgctcaggctaagtcacgccactcaaatggacagggacgctggcccgtcaagtctgctagattcattcttgatcttctaaagaatgctgagagcaatgctgaggtcaaaggtcttgatgtcgataccctgtatgtgtcgcacattcaagtaaaccaggctcagaagcagcgtcgcaggacctaccgtgctcatggacgcatcaacccttacatgtcctccccgtgccacattgagctgatcttgtcggagaaggaagagccagtgaagaaagaggcggagtctcagattgcgaccaggaaggcttaaacaagggagctctgcagtgttagagtggattgtaggtcgtcattgcctaagtgaaaattttggctggttatttgtcgcctcctttatcagtgtactgctagctcgtactgtcaccgtgatcagtgtctgtactgcctatacaattcgaagctatgaatgaagtgtttgtggattatttccatatttatattgatggtgatgtcaatgctcgttaacatcttaattaatatgggcatttggttgtg

SEQ ID NO: 1218 - DNA, 806 bp, Panicum virgatum
ccacccctcgccgccgccgcagacgcatccctccgcctcgaggcttccgctcgctggtcgcagccatggtgaagtactcgagggagccgaccaaccccaccaagtccgccaaggccatgggccgggacctccgtgttcacttcaagaacacgcgtgagacagcttttgccctcaggaagttgccactcactaaggccaaaaggtaccttgaggatgtgattgcccacaagcaggccatccccttccgcaggtactgtggcggtgttgggcgtactgctcaggctaagtcgcgccactcaaatggacagggacgctggcccgtcaagtctgctagattcattcttgatcttctaaagaatgctgagagcaatgctgaggtcaaaggtcttgatgtcgataccctgtatgtgtcgcacattcaagtaaaccaggctcagaagcagcggcgcaggacctaccgtgctcatggacgcatcaacccttacatgtcctctccgtgccacatcgagctgatcttgtctgagaaggaagagccagtgaagaaagaggcggagtctcagattgcaaccaggaaggcttaaagaagggagctctacggtgttagagtgggttagagtggattgtaggttgtcgttgcctaagtgaaaattttggctggttatctgtcgcctcctttatcagtgtactgctagctcgttctgtcaccttgatcagtgtctgtactgcctatacaattcgaagctatgaatgaagtgtttgtggattctttccatatttatattgatggtgatgtcaatgctcgttaa

SEQ ID NO: 1219 - DNA, 794 bp, Panicum virgatum
gccacccctcgccgccgccgcagacgcctcccatccgcctcgaggcttccgctcgccggtcccagccatggtgaagtactcgagggagccgaccaaccccaccaagtccgccaaggccatgggccgggacctccgtgttcacttcaagaacacccgtgagacagcttttgccctcaggaaattgccactcactaaggccaaaaggtaccttgaggatgtgattgcccacaagcaggccatccccttccgcaggtactgtggcggtgttgggcgtactgctcaggctaagtcgcgccactcaaatggacagggacgctggcccgtcaagtctgctagattcattcttgatcttctaaagaatgctgagagcaatgctgaggtcaaaggtcttgatgtcgataccctgtatgtgtctcacattcaagtgaaccaggctcagaagcagcggcgcaggacctaccgtgcccatggacgcatcaacccttacatgtcctccccgtgccacattgagctgatcttgtcggagaaggaagagccagtgaagaaagaggcggagtctcagattgcgaccaggaaggcttaaggaagggagctccgcagttttagagtgggttgtaggttgtcgttgcctaattgaaaattttggctggttatctgtcgcctcctttatcagtgtactgctagctcgttctgtcaccttgatcagtgtctgtactgcctatgcaattcgaagctatgaatgaagtgtttgtggattctttccatatttatattgatggtgatgtcaatgctcg

SEQ ID NO: 1220 - DNA, 860 bp, Panicum virgatum
tgcttcatcggctcgccgtgttcgtacgaaggcgaccctccccctccttccccgtcgcactccctaccgccgccgacgccgacgccatggtgaagtactcgcaggagccgggcaaccctaccaagtcggccaaggccatgggcagggatctcagggtccatttcaagaacacaagggagacagcttttgcacttcgcaagctgcctttgaccaaggctaagcggtaccttgaggatgttatggcacacaagcaggcgattcccttccggagatactgtgggggtgttggtcgtaccgcacaagcaaagtctcgccactcaaatggacagggacgctggcctgttaaatcagccaggttcatattggatttgctcaagaatgctgagagtaatgctgatgtgaaaggtttggatgtggacaacctctatgtttcacacatccaggtgaaccaagcccagaagcagaggcgccgcacctaccgtgctcatggacgcatcaatccttacatgtcctcaccttgccacattgagctgatcctttcagagaaggaagagcctgtgaagaaagagcctgacaacatcgtcgcatcaaggaaacagtgaagtatgtaggcttgctgagcgaggctattctgtggaagaaattgtagctgtagcacttttatgtacgttttccagcagcctttcctaagatatttctactgccaatattttgaatcttgtttgttgcctagtctgattctgtattgagtgattgcggtgtgccgcatcgacttcccgaatcacatgatgtcaatgtcctgaaacaaaacatcagaatcgggcaaagtgaccggtgatctgcactggtggtggttccct

SEQ ID NO: 1221 - DNA, 762 bp, Panicum virgatum
gccacccctcgccgccgccgcagacgcctccctccgcctcgaggcttccgctcgccggtcgcagccatggtgaagtactcgacggagccgtccaaccccaccaagtccgccaaggccatgggccgggacctccgtgttcacttcaagaacacccgtgagacagcgtttgccctcaggaagttgtcactcactaaggccaagaggtaccttgaggatgtgattgcccacaagcaggccatccccttccgcaggtactgtggcggtgttgggcgtactgctcaggctaagtcgcgccactcaaatggacaggggcgctggcctgccaagtctgctagattcattcttgatcttcttaagaatgctgagagcaatgctgaggtcaaaggtcttgatgtcgataccctctatgtgtcgcacattcaagtgaaccaggctcagaagcagcggcgcaggacctaccgggctcacggccgcatcaacccttacatgtcctccccgtgccacattgagctgatcttgtcagagaaggaagagccagtgaagaaagaggcggagtctcagattgcgaccaggaaggcttagagaagggagctctgcggtgttagagtggattgtaggttgtctttgcctaagtggaaattttggctggttatctgttgcctcctttatcagtgtactgctagctcgtactgtcaccttgatcagtgtctgtactgcctatacaattcgaagctacgaatgaagtttttgtggatgtttttc

SEQ ID NO: 1222 - DNA, 850 bp, Cenchrus ciliaris
  misc_feature (752)..(752): n is a, c, g, or t
  misc_feature (773)..(774): n is a, c, g, or t
gccgccgcagtttccttcctcacccctcgccgccgccgccgcagacgcctcccatccgcctcccggccgcccgctcgccggttgcagccatggtgaagtactcgagggagccgaccaaccccaccaagtccgccaaggccatgggccgggacctccgtgttcacttcaagaacacccgtgagacagcgtttgctctcaggaagttgtccctcactaaggccaagaggtaccttgaggatgtgattgcccataagcaggccatccccttccgcaggtactgtggcggtgttgggcgtactgctcaggctaagtctcgccactcaaatgggcagggacgctggccagtcaagtctgctcgattcattcttgatcttctcaaaaatgcagagagcaatgctgaggtcaaaggtcttgatgtcgataccctttatgtgtcgcacattcaggtgaaccaggctcagaagcagcggcgcaggacctaccgtgcgcatggacgcatcaacccttacatgtcttccccatgccacattgagctgatcctgtcggaaaaggaagagccagtgaagaaagaggctgagtctcagattgcaacaaggaaggcttagagaaaggagccctgcagtattagagtggattgtagcttgtctttggctgagtgaaaattttcactgattatctgtccgcacttttatcagtgtactgctggctcatacttttgtcaccttggtcactgtctgtactgtgcatgcaantcaaaagctctggatctagtnntttgtggattcttttcgtatttgtatcgatggtgacgccactgcttattaattgcctggctagggacgtttgcaca

SEQ ID NO: 1223 - DNA, 1012 bp, Setaria italica
atgggcttctgagctacttgggctgtctacatttcacccatctaaatcatcgactcgcacgtcggcccgtctacctagagcgcttagcactagggtttccctcaccgcttagaccgccgccgcctcggtgcttcgtcagtgcggagtgttcgtgcgaaggcgatcctccctcctccgccgccgcactccctaccgccgccgccgccatggtgaagtactcgcaggagtcgggcaaccctaccaagtcggccaaggccatgggcagggatcttagggtgcatttcaagaatacaagggagacagcttttgcacttcgcaagctgtctttgaccaaagctaagcggtaccttgaggatgttatggcacacaagcaggcaattcccttccggagatactgtgggggtgttggtcgcactgcacaagcaaagtctcgccactcaaatggacagggacgctggcctgttaaatcagccaggttcattttggatttgctgaagaatgctgagagtaacgctgatgtgaaaggcttggatgtcgacaacctctatgtttcacacatccaggtgaaccaagcccagaagcagaggcgccgcacataccgtgctcatggacgcatcaatccttacatgtcctcaccttgccacattgagctgatcctgtcagagaaggaagagcctgtgaagaaagagcctgacaacattgtcgcaccaaggaagcagtgaagtatgctaacttgctgagcgagagggtattttgtggaagaaattaaatagctttagctcgtttatgtactttttatggcagccttgcctaaagatatttgcggtaccaatatttttgaatctggatttgctcagcttgatgctgtcctgagtgtacgatcaattcccaatacaataggtttgatatatctgggcacctgtctttgtgacccattggatctactagaatattatttgcacgcttattttgaccaggcaagtcgataacagaagttgccgttgcattgtgt

SEQ ID NO: 1224 - DNA, 878 bp, Sorghum bicolor
ttctctcttccctggccattcctcatctcgctcgctcgtcgtcgcagccgccttctttgggttcgctcgccagcggcagccatggtgaagtactcgagggaaccttccaaccccaccaaatccgctaaggctatgggtcgggacctgcgtgtgcactttaagaacacacgtgagacagcttttgccatcaggaagctgcagcttagcaaggctaaaaggtatcttgaggatgtgattgcccacaagcaagccattcccttccgtaggtactgtggtggtgttggacgtacagcgcaagctaagtctcgccactcgaatggtcagggacgttggcctgccaagtctgctaaattcattttggatcttctcaagaatgcagagagcaatgctgaagttaagggcttggatgtcgatacgctctatgtgtcgcatattcaggtgaaccaagctcagaagcagcggcgccggacttaccgtgctcatgggcgcatcaacccttacatgtcttccccatgccacattgagctgatgctttcagagaaggaagagccagtgaagaaagaggctgagacccaaattgcagcaaggaaggcctagaagatatgaagacttgtttagtatcagttaagagtggaccgattgtatctcctttttttttctgtactgttggtgcatacttaatcgatccccggaatggaacctttctttctgcagttgtgatgacatcccaagaatgagaatgttgcctcagtagtttttcttatttataatccaactaaactaccttggtgctggattttgtacatcgttatctccttgactaagagcgatcatttggtcagcacatcataaacatgagagtctgacatattttccat

SEQ ID NO: 1225 - DNA, 1137 bp, Sorghum bicolor
tgcaggaaaaatggccatgaactgttaacgacacgagcatttcaagaaaaaaaattcaaagagatttggaacgttcagtgttcaagcgcccacgacaggtaaaaaagaaaagaaaaaagagagaggccttcctgggttgaatttgttttgtggcccatgtgaaagcggcccgttgtgctccggcctgctagctgcctggccggcatcaggttagggttcctcccttcccgtataaaagccttcctccgcgccgccacgccgttctctcttccctggccattcctcatctcgctcgctcgtcgtcgcagccgccttctttgggttcgctcgccagcggcagccatggtgaagtactcgagggaaccttccaaccccaccaaatccgctaaggctatgggtcgggacctgcgtgtgcactttaagaacacacgtgagacagcttttgccatcaggaagctgcagcttagcaaggctaaaaggtatcttgaggatgtgattgcccacaagcaagccattcccttccgtaggtactgtggtggtgttggacgtacagcgcaagctaagtctcgccactcgaatggtcagggacgttggcctgccaagtctgctaaattcattttggatcttctcaagaatgcagagagcaatgctgaagttaagggcttggatgtcgatacgctctatgtgtcgcatattcaggtgaaccaagctcagaagcagcggcgccggacttaccgtgctcatgggcgcatcaacccttacatgtcttccccatgccacattgagctgatgctttcagagaaggaagagccagtgaagaaagaggctgagacccaaattgcagcaaggaaggcctagaagatatgaagacttgtttagtatcagttaagagtggaccgattgtatctcctttttttttctgtactgttggtgcatacttaatcgatccccggaatggaacctttctttctgcagttgtgatgacatcccaagaatgagaatgttgcctcagtagtttttcttatttataatccaactaaactaccttggtgctggattttgtacatcgttatctccttgactaagagcgatcatttggtcagcacatcataaacatgagagtctgacatattttcc

SEQ ID NO: 1226 - DNA, 978 bp, Sorghum bicolor
cctaccgccttctccacctcgtgccgccgccgccgcaggagcatctcaactccgcctcgagccccaccagctcgccggtctcagccatggtgaagtactcgagggagccgaccaaccccaccaagtccgccaaggccatgggtcgtgacctccgtgttcacttcaagaacacccgcgagacagcttttgccctcaggaagctgtcactcaccaaggccaaaaggtaccttgaggatgtgattgcccacaagcaggccatcccgttccgcaggtattgtggtggtgttgggcgaactgctcaggctaagtctcgccactcaaatgggcagggacgctggcctgtcaagtctgctaaattcattctggaccttctcaagaatgcagagagcaatgctgaggtaaaaggtcttgatgtggataccctctatgtgtcgcacattcaagtgaaccaggctcagaagcagaggcgcaggacctaccgcgctcatggacgcatcaacccttacatgtcctccccgtgccacatcgagctcatcttgtcagagaaggaagagcctgtgaagaaagaggctgagtctcagattgcaaccaggaaggcttagagaagggatcatcttctgtgattggctgagtgaaaattttggctgattatttgtcatcttatattgtatctgagtattgttcgctagtgctttgttactttgatcactacctgaactgcacatacaattcaccagtcttgagaattgtctcgggttttcatattttgtgctgatggtgatgtcactgatcgtgttaatttgcaattttgctggtagatgtttgtcccaatgctgtgcatcctttgaacgaactagaatagtatgcacgatctggagcgggcgcgcctggtcatcgtgatatattcgacactatatttgtatcctcgtgtattgcacgcgtgttttagcttttttctatggataaagtctacttttc

SEQ ID NO: 1227 - DNA, 1066 bp, Sorghum bicolor
cccttgtcacgcgctcctaccgccttctccacctcgtgccgccgccgccgcaggagcatctcaactccgcctcgagccccaccagctcgccggtctcagccatggtgaagtactcgagggagccgaccaaccccaccaagtccgccaaggccatgggtcgtgacctccgtgttcacttcaagaacacccgcgagacagcttttgccctcaggaagctgtcactcaccaaggccaaaaggtaccttgaggatgtgattgcccacaagcaggccatcccgttccgcaggtattgtggtggtgttgggcgaactgctcaggctaagtctcgccactcaaatgggcagggacgctggcctgtcaagtctgctaaattcattctggaccttctcaagaatgcagagagcaatgctgaggtaaaaggtcttgatgtggataccctctatgtgtcgcacattcaagtgaaccaggctcagaagcagaggcgcaggacctaccgcgctcatggacgcatcaacccttacatgtcctccccgtgccacatcgagctcatcttgtcagagaaggaagagcctgtgaagaaagaggctgagtctcagattgcaaccaggaaggcttagagaagggatcatcttctgtgattggctgagtgaaaattttggctgattatttgtcatcttatattgtatctgagtattgttcgctagtgctttgttactttgatcactacctgaactgcacatacaattcaccagtcttgagaattgtctcgggttttcatattttgtgctgatggtgatgtcactgatcgtgttaatttgcaattttgctggtagatgtttgtcccaatgctgtgcatcctttgaacgaactagaatagtatgcacgatctggagcgggcgcgcctggtcatcgtgatatattcgacactatatttgtatcctcgtgtattgcacgcgtgttttagcttttttctatggataaagtctacttttcctgctccatgaaaatctgcttttcgtcaacttcaaaactatggtaaaccgaggggttttaaaggcagttttgc

SEQ ID NO: 1228 - DNA, 872 bp, Saccharum officinarum
gtccacccgctcgcgccgccgccgccgcaggagcatctcaactccgcctcgagccctccagctcgccggttgcagccatggtgaaatactcgagggagccgaccaacccaaccaagtccgccaaggccatgggccgtgacctccgtgttcacttcaagaacacccgtgagacagcttttgccctcaggaagttgtcacttaccaaggccaagaggtaccttgaggatgtgattgcccacaagcaggccatcccgttccgcaggtattgtggtggtgttgggcgtactgctcaggctaagtctcgccactcaaatgggcagggacgctggcctgtcaagtctgctagattcattctggaccttctcaagaatgcagagagcaatgctgaggtaaaaggtcttgatgtggataccctctatgtgtcgcacattcaagtgaaccaggctcagaagcagaggcgcaggacctaccgcgctcatggacgcatcaacccttacatgtcctccccatgccacatcgagctcatcttgtcggagaaggaagagcccgtgaagaaagaggctgagtcccagatcgcaaccaggaaggcttagagaagggggtcatcttctgtgattggctgagtggaaattttggctgattatttgtcgtctcatattgtacctgaaagtattgtttgcaagtgctttgtcactttgatcactgcctgaactgcacatacaattcaccagtcttgagaattgtctgtgggttgttttcatatttgtgctgatggtgatgtcaatggtcgtgttaatttgcaattttgctggtagatgacatttgtcccaatgctatgcatcctttgaactagaatggtatgcacgatctgc

SEQ ID NO: 1229 - DNA, 771 bp, Panicum virgatum
tcgccgccgccgcagacgcatccctccgcctcgaggcttccgctcgctggtcgcagccatggtgaagtactcgagggagccgaccaaccccaccaagtccgccaaggccatgggccgggacctccgtgttcacttcaagaacacgcgtgagacagcttttgcactcaggaagttgccactcactaaggccaaaaggtaccttgaggatgtgattgcccacaagcaggccatccccttccgcaggtactgtggcggtgttgggcgtactgctcaggctaagtcgcgccactcaaatggacagggacgctggcccgtcaagtcttctagattcattcttgatcttctaaagaatgctgagagcaatgctgaggtcaaaggtcttgatgtcgataccctgtatgtgtcacacattcaagtaaaccaggctcagaagcagcggcgcaggacctaccgtgctcatggacgcatcaacccttacatgtcctctccgtgccacatcgagctgatcttgtctgagaaggaagagccagtgaagaaagaggcggagtctcagattgcaaccaggaaggcttaaagaagggagctctacggtgttagagtgggttagaacttagagtggattgtaggttgtcgttgcctaagtgaaaattttggctggttatctgtcgcctcctttatcagtgtactgctagctcgttctgtcaccttgatcagtgtctgtactgcctatacaattcgaagctatgaatgaagtgtttgtggattctttcc

SEQ ID NO: 1230 - DNA, 814 bp, Chelidonium majus
agaaggaatagcatccgtatcagatcaaaaaatggtgaagtattcgaaggaacccgataatccgaccaagtcctgcaaggccagggggtcagatcttcgagttcatttcaagaacaccagggaaaccgcgttttcacttagaaaaatgtctttggtcaaggctaagaggtatttggaggatgttttggctcacaaacaagccattcctttcagacgtttttgtcgtggtgttggtaggactgctcaagcaaagaaccgtcattcaaatgggcaaggacgctggcctgccaaatctgccaaatttatccttgatttgcttaaaaatgcagagagcaacgctgatgtgaaaggtttggacgtggattctctatacatttcacacatccaagttaaccaagcccaaaagcaaaggcgtagaacataccgtgctcacggaagaatcaatccttatatgtcgtctccttgccatattgagttgaccttgtcggagaaggaagaagctgtgaagaaagaggctgatactcaattggccccaaggaaatcaaagaagggcggtcaagttcttcgcagtggcgcttcctcttaagcatagagaagtagagatggtaaccctggaagtattgaagtctttcagttactattttcttttttggccttggaaagacctttgcttttagtagtttttttctattatataaagatattggattatggtttgctgccatgtttcattggatttagtagtttagtgagtgtttgttttgagggattggcaccgtataattaatctaattaaaaccctttgttttgttat

SEQ ID NO: 1231 - DNA, 914 bp, Eschscholzia californica
tcaccgctccgtctccctctctttaaaatagaagcaaacagcaattactcgatcctttcgcgcctgaagatcaaggaggaggaggagaagcagcagtcatggtgaagtattcgaaggaaccggataatccgaccaagtcttgcaaagctaggggttcggatcttcgagttcatttcaagaacacaagggagaccgctttctcaatcagaaagttgcccttagtcaaggccaaaagatatctagaggatgttcttgcacacaagcaagcaattcctttcagacgttattgtggtggggttggacgaactgctcaagcaaagaaccgtcactcaaatggacaaggacgatggcctgctaagtctgccaagttcattcttgatttgctcaagaacgccgaaagcaatgctgatgttaaaggcttggatgtagattcactttacatttctcacattcaagtaaaccaagcccagaagcaaagacgtagaacttatcgtgcccatggaagaattaacccatatatgtcttctccatgtcacattgaactaaccttgtctgagaaggaagaacctgtcaagaaggaggtcgacactcagttggctccaaggaaggcgaagaagtctcatgtactacgcagtggtgcgtcctcttaaacaagtccgaagaaagggtgccgtgaccttgaagcagctggtgaagtggtaatactttctttttctcgtctcagaagacagtttgaaagtgcatttgagttcagaaccattcgtgtctggctggatcggttttattttcaattttgaagcttgttttggagttttaagtagttttattcaaactttggcagttgttagatgttcactatgcaaatagagtagtgtctttgatactctcttcaattggcccatgaaatttgaatc

SEQ ID NO: 1232 - DNA, 990 bp, Papaver somniferum
cttctgtgccgcattactgtcggctcaccagacaaagaagaagaagaaatcaccaaaaacctaaatcaacaatggtgaagtattcaaaggagcccgataatcccaccaagtcctgcaaggctagggggtctgatcttcgtgttcatttcaagaacactagggaaacagcattctctttaaggaagatgcctttggttaaagccaagaggtatttggaggatgtgttggcacacaagcaagccattcccttcagacgtttctgtggtggtgttggtaggactgctcaagccaagaaccgtcactcaaatggacaaggacgttggcccgctaagtccgccaagttcatccttgatctgcttaaaaatgctgagagcaatgctgatgtaaaaggtttggacgtggattcactatacatttctcatatccaagttaaccaagctcagaagcagaggcgtaggacataccgtgctcacggaagaattaacccttacatgtcatctccttgtcacatcgagctgaccttgtcagagaaggaagaagcagttaagaaagaggctgacactcaattggcaccaaggaagtcaaagaaatctcaagttctccgtagtggtgcctcatcttaagcagtagacagagatgagtactcagaaatgtattgggttccgttttactattttgacattagaaaccattttggttgcttttatatatgtttcgacttttttgtgtttctatcatatgaagattttggctactattagtgaatgtttgttttgagagattttcgtacaagcaggttgtgctagattaaaatcctttttctctgatgctgtcctagagttgaaacatttgttctgatagaaatcctcttatccaactgaaatgacagtacttactgagattctgatccagttttgatttagaggtaatgctagttaacaacgttcactgttgaatggtggttatgtagccatatctactatttgtttt

SEQ ID NO: 1233 - DNA, 1043 bp, Papaver somniferum
ttaacctacttctgtgccgcattactgattcggctcaccagacgaagaagaagaagaaatcaccaaaaacctaaatcaacaatggtgaagtattcaaaggagcccgataatcccaccaagtcctgcaaggctagggggtctgatcttcgtgttcatttcaagaacactagggaaacagcattctctttaaggaagatgcctttggtgaaagccaagaggtatttggaggatgtgttggcacacaagcaagccattcccttcagacgtttctgtggtggtgttggtaggactgctcaagccaagaaccgtcactcaaatggacaaggacgttggcctgctaagtccgccaagttcatccttgatctgcttaaaaatgccgagagcaatgctgatgtaaaagggttggacgtggattcactatacatttctcatatccaagttaaccaagctcagaagcagaggcgtaggacataccgtgctcacggaagaatcaacccttacatgtcatctccttgtcacatcgagctgaccttgtcagagaaggaagaagcagttaagaaagaggctgacactcagttggcaccaaggaagtcaaagaaatctcaagttctccgtagtggtgcctcatcttaagcagtagacagagatgagtactcagaaatgtattgggttccgttttagccttactattttgacattagaaaccattttggttgcttttatatatgtttctacttttttgtctttctatcatatgaagattttggcttatggcctgtggccatatctactattagtgaatgtttgttttgagagattttcgtacaagcaggttgtgctaagattaaaatcctttttctctgatgctgtcctagttaaaacatttgttctgatagaaatcctcttatccaactgaaatgacggagattcggatccagttttgatttagaggtaatgctagttaataatgttctactgttagaatggtgttatgtgcatatccactattagtctaattgtttgttttagaaaagtaaaaaaaa

SEQ ID NO: 1234 - DNA, 963 bp, Papaver somniferum
tatttctgattcggctctccaaacaaaggaagaagaaataatcgccagaaacccaaatcaacaatggtgaagtactcaaaggagcccgataatcccaccaagtcctgcaaggctagggggtctgatcttcgtgttcatttcaagaacactagggaaacagcgttctctttaaggaagatgcctttggtcaaagccaagaggtatttggaggatgtcttagctcacaagcaagccattcccttcagacgtttctgtggtggtgttggtaggactgctcaagccaagaaccgtcactcaaatggacaaggacgttggcccgctaagtccgccaagttcatccttgatctgcttaaaaatgctgagagcaatgctgatgtaaaaggtttggatgtggattcactatacatttctcatatccaagttaaccaagctcagaagcagaggcgtaggacataccgtgctcacggaagaatcaacccttacatgtcatctccttgtcacatcgagttgaccttatcagagaaggaagaagcagtgaagaaagaggctgacactcagttggcaccaaggaagtcaaagaaatctcaagttcttcgtagtggtgcctcatcttaagcagtagagagagatgagtcctcagaaatgtattgagttctctttgtgccttgttatttttacattagaaaccatttttgttgcttttagatatgtttcgactctcaatcatatgaagattttggcttatggccgtggccatctttttattgcaattagctcagtgaatgtttgttttgagtgattttagtagaagtaggatctactaaattgaaatattttctctgatgctgtgctagctgctagttaaacatttgttttgatggatatcttgtagtgtgcatcgttgaatggttgcatgaaatggttaatccagttccttaggttgttatagtaaaaaaaaaaaaa

SEQ ID NO: 1235 - DNA, 1047 bp, Papaver somniferum
ttcggctctccaaacaaaggaagaagaaagaatcaccagaaacccaaatcaacaatggtgaagtactcaaaggagcccgataatcccaccaagtcctgcaaagctagggggtctgatcttcgtgttcatttcaagaacactagggaaacagccttctctttaaggaagatgcctttggtcaaagccaagaggtatttggaggatgtcttagctcacaagcaagccattcccttcagacgtttctgtggtggtgttggtaggactgctcaagccaagaaccgtcactcaaatggacaaggacgttggcccgctaagtccgccaagttcatccttgatctgcttaaaaatgctgagagcaatgctgatgtaaaaggtttggacgtggattcactatacatttctcatatccaagttaaccaagctcagaagcagaggcgtaggacataccgtgctcacggaagaatcaacccttacatgtcatctccttgtcacattgagttgaccttatcagagaaggaagaagcagtgaagaaagaggctgacactcagttggcaccaaggaagtcaaagaaatctcaagttcttcgtagtggtgcctcatcttaagcagtagagagagatgagtcctcagaaatgcattgagttctctttgggccttgttatttttacattagaaaccatttttgttgcttttagatatgtttcgactctcaatcatatgaagattttggcttatggcctgtggccatctcttttattgcaattagctcagtgaatgtttgtttcgagtgattttggtaaaagtaggatctactaaattgaaatcttttctctatgctgtgctagctgctagttaaacatttgatttgatggatatcttgtagtgtgcattgttgaatggttgttgcatgaaatggttaatccagttcctcagcttgttaagtcactctattgtttcggtggtctagtctttagttaaacacctgttgatgacagtacatgtaatgtacaaaaataccgggcagagtcaatttttttaccaaaaaa

SEQ ID NO: 1236 - DNA, 789 bp, Plantago ovata
taggttactctcctcttcggccgccgtgaagatttagctacaatggtgaagtactcgagagagccggacaatgccaccaaatcctgtaaagctcggggatccgatctgagagttcacttcaagaacacgagagaaaccgcacacgctctcaggaagatgcctctggtcaaggccaagaggtacttggaagatgtgcttgcccacaagcaggccatcccattcactcgcttctgcagaggtgttggacgcactgcccaggccaagaacaggcactctaatgggcagggtcgctggcctgtcaaatccgccaactttatcctggatttgctgaagaatgctgagagcaacgctgaggttaaaggtttggatgtggatgcactctacatctctcacatccaggttaaccaagctcagaaacaaaggcgccgcacttaccgtgctcatggacgtatcaacccttacatgtcctcaccctgccacattgagttgattttgtctgagaaggaagagccagtcaagaaagaagcggagactcaaattgcaccaaccaaaactaggaaggcctgaagtacaatatagattttgactagtccgtcctttttatttggagacaaattttgttatgatatttaaagattctgattctagagaattattgtggtatcagtcagtttacaatctttctgcgtatacttttgaagaagtttttattaatgttttggaattctgaagcgcgtacctcctgctgtttgttgtcatgtttgttttttgaattttgattgatctgct

SEQ ID NO: 1237 - DNA, 1722 bp, Zingiber officinale
aaaggaacaagtagaggcatggaagccgattgtcagtgctgttcatgccaagggagcactgttcttctgccagatttggcatgcgggcaggagttccattactgatttccagcctaatggtcaagctccaatctccagcactgataaaccagtgccgactcaatatctgcacgatggcagtgttcaggagtaccctgcgcctcgaagattgacgacagaggaaatccctcagatcgtgaatgacttcaggctcgcggcaaggaatgccatcgatgccggattcgacggagtggaaatccacggcgcaaatggctacctgatcgagcaattcatgaaagacagcaccaacgaccgaggcgacgagtacggcggcggcatcgacaaccgctgccgcttcgcgttggatgtggtggaagccgtggcggaagaggtgggaggccaccgagtggggatgcggctgtcgccgttcttggacttgatggactgctgggattccgatccggaggcgctgggtctccacatggcggcgaagctgaacgagttggggattctgtactgccacatgctggagccgagaatggtgaaggtggagggtaggtaccagattccgcaccggctgctgccgatgaggaaggcgttcagggggacgttcatggtggccggcgggtacgatcgggaggaggggaacaaggttgtggcggaggggtacgcggatctagtggtgtacggacggctgttcttggcgaatccggacttgccccggagatttgaggtcggtgcggcgctgaacaagtacaaccggctcaccttctacacgccggatccggttgttggatacaccgactacccgttcctggaaacctcaaacttcactcaagataatctcgacttgtaaaatttctagttgatagattttatcaacctgaaataccctttcattttttttcaatagatttatcggtcacttgcatccgaatttttttttggcggtccaaatccaacaaagttctcgttaaaaaaaaacgtaacagaaagtaactgatgaagcaaattgatagagtgccaaaacaattgagtaatatgagcttccataaactattatgcctacgttgatgcctcactaactcacttgctcaagctttcctgggcttgctggtggcaagttgggtctccggctctttcttgacagactcttccttctcagacagtatcagttcaatatggcaaggagaggacatatagggattgattcttccatgagctcggtaagtcctgcgcctctgtttttgggcttggttcacttggatgtgtgagatgtagagtatgtcaacatccaagcccttcacttcagcattgctttcagcatttttaagcagatccaaaatgaatctagctgatttcataggccatcgaccctgcccattcggatgcctgttctttgcctgagcagttcgaccaacaccgccacaaaaccttcggaagggaatagcctgcttgtgggcaattacgtcctcaaggtaccttttggccttggataaaggtagctttctaattgcatgagcagtctcgcgagtgttcttgaagtgaaccctcaggtcgcgacccatggctttggcagacttggtagggttggaaggatctctcgagtacttcaccatgattgcagagagttctcagcgacctccaactctgagcgcctgcggcggaagtagagagagacgt

SEQ ID NO: 1238 - DNA, 771 bp, Allium cepa
ctaaaatctagggttagggtattgctccgcagcagccatggtgaagtattcaagagatccatcgaacccaacgaaatcatccaaggcgatggggcagaatctcagggttcattttaagaatacccgggaaaccgcatttgctctaaaaaagcttcctttggaaaaggccaagaggtatcttgaagatgtgattgctcacaagcaggctattccatttaggaggtattgtcgaggtgtaggtcgaactgcccaggcaaagaatcaccactcaaatggtcagggacgatggcctgcaaagtctgcccgctttattcttgacctactcaaaaatgctgagagcaatgctgatgttaaaggattggatgttgatgctctatatatttcccacatccaagtgaatcaggcccaaaagcagaggcgtaggacataccgagcccatggaagaatcaatccttacatgtcaaatccttgccatattgaattgatcttgtcggagaaggaagaacctgttaagaaagagcgggaaacacaaatagcgacaacaaagccaaagaactaggcatgagagttttcacatacaactcttttggattcccttctttgttttcgatttgtgggtgttgttgaagctaccagctagcagttttaagaattttgaatttgtttttggcatactatgagacttttttgttgtattctatgttagctatttgagtatttttacaaatatttctggttactttaagtttgcaatggtttatctgattttcc

SEQ ID NO: 1239 - DNA, 754 bp, Epimedium sagittatum
gcagacatggtgaagtattcgagagaaccagacaatcccaccaagtcatgcaaggccaaggggtcggatctccgagttcatttcaagaacacgagggaaaccgcgttctccattaggaagatgcctttgatcaaagctaaaaggtacttggaggatgttttggcacacaagcaagctattcccttccgccgtttctgtcgtggagttggtcgaactgctcaggcaaagaatgctggtcactctaatggacagggacgctggcctgccaaatcagcaaagttcattttggatttgctgaagaatgctgaaagcaatgctgatgttaaaggtttggatgtggattccctttacatctcccatatccaagtcaaccaagcccaaaagcagaggcgcaggacctaccgtgctcatggaaggatcaatccttacatgtcatctccttgccacattgagttgatattgtctgaaaaggaagaaccagtcaagaaggaggcggagacacagttggcccccagaagatcaaagaaggcagctctacgcagtggagcctcctcttgagtggtagagatatacaggcggggtatctagtagaatctttttaaggctgttttgtttttcgtcccatgtttttgttagaacttcgtgagaggtttcatgctttattttccgatcagaatttgcttcgttttcactttgttaagtattttgttctgagatttttttttagtttttgtgaactgaaggcatatggaaa

SEQ ID NO: 1240 - DNA, 771 bp, Papaver somniferum
aaacaaaggaagaagaaataatcgccagaaacccaaatcaacaatggtgaagtactcaaaggagcccgataatcccaccaagtcctgcaaggctagggggtctgatcttcgtgttcatttcaagaacactagggaaacagcgttctctttaaggaagatgcctttggtcaaagccaagaggtatttggaggatgtcttagctcacaagcaagccattcccttcagacgttttctgtggtggtgttggtaggactgctcaagccaagaaccgtcactcaaatggacaaggacgttggcccgctaagtccgccaagttcatccttgatctgcttaaaatgctgagagcaatgctgatgtaaaagggttggatgtggattcactatacatttctcatatccaagttaaccaagctcagaagcagaggcgtaggacataccgtgctcacggaagaatcaacccttacatgtcatctccttgtcacatcgagctgaccttgtcagagaaggaagaagcagttaagaaagaggctgacactcagttggcaccaaggaagtcaaagaaatctcaagttctccatagtggtgcctcatcttaagcagtagagatagatgagtactcagaaatgtattgagtttcgtttgtgccttactattttgacattagaaaccattttcgttgcttttatatatgtttagacttttttgttctttcttatcatatgaagatttggtcgttatggcctgtggccatatctgttattgtctgtttagt

SEQ ID NO: 1241 - DNA, 869 bp, Malus domestica
attcacctctgaccgcccagactcctccttccgccgccgatcaacagcaatggtgaagtactcgagggagcccaataatcccaccaagtcctgcaaggcccagggcgagggtctaagagttcatttcaagaacacgagagagactgcccatgccatcaggaagatgcatttggcaaaggccaaaaggtacttggaagatgttttagcccacaagcaagccattcccttccgccgcttttgccgcggtgttggtcgaactgcgcaggcgaagaaccgccagtccaatggtcaggggcgttggccggttaagtctgctaatttcattcttgatttgctcaagaatgccgagagcaatgctgaggtgaaagggcttgatgtggattcgttgtacgtctctcacatccaggtcaaccaggctcagaaacagagacgccgcacatatcgtgctcatgggagaataaatccttatatgtcatctccctgccatatcgagctgattttgtcagagaaagaagaggcagtaaagaaagagcctgatactcagttggctcccaggaagtcgaggaaaggtcaagcactgcagagcggtgcttcctcttgagatctgttatttgtagtttaaagagtttatggtcgtcattcgtatcctagatcatccactctatatctttcccagaatatctctgttttcagatatcttttatttgtagttgagaaatctatcaccgaatttttgttcagcagttgtgcttttcagtgtctggacgagactttaagccttttggttttcaagtacaactactttcaagttgaaatttgtggtgtttccatattttgaagctaatagtttggttttatgttttactcaa

SEQ ID NO: 1242 - DNA, 904 bp, Malus domestica
gtgtcttccattttcgccccaattcacctctgaccgcccagactcctccttccgccgccgatcaacagcgatggtgaagtactcgagggagcccgataatcccaccaagtcctgcaaggcccagggcgagggtctaagagttcatttcaagaacacgagagagactgcccatgccatcaggaagatgcatttggtaaaggccaaaaggtacttggaagatgttttagcccacaagcaagccattccctttcgccgcttttgccgcggtgttggtcgaactgctcaggcgaagaaccgccagtccaatggtcagggacgttggccggttaagtctgctaatttcattcttgatttgctcaagaatgctgagagcaatgctgaggtaaaagggcttgatgtggattcgctctacgtctctcacatccaggtcaaccaggctcagaaacagagacgccgcacatatcgtgctcatgggagaataaatccttatatgtcatctccctgccatatcgagttgattttgtcagagaaagaagaggcagtaaagaaagaggccgaaactcagttggctcccaggaaatcgaggaaaggtcaagcactgcagagcggtgcttcttcttgagatgtgcacttcaaagagtttgtggtcgtcattcgtattcctagactatccactccattatctttcccagaatatctcagtttacggtatctgttatttgtagttgagaattgtgtcgctgaatgtttgttcggcaattttacttttcaatgtctggacgagtttttaagcgtttttgctttctaagtgaactaattgcaagtggaaatttgtggtgattccatattttgaagctaattagcatgtactagtcaaaagcagttcatctttactaatacttta

SEQ ID NO: 1243 - DNA, 858 bp, Chelidonium majus
ggaaaccacatttccttctactatcccagccgcaggaggaggagcagcaggaacatcagcagtcatggtgaagtattcgaaagagccggataaccccaccaaatcctgcaaggccaggggttcggatcttcgtgttcattttaagaacacaagagagacagcgttttcacttaggaagatgtccttagtcaaagccaagcggtatcttgaggatgttttggctcacaagcaagcaattcccttcagacgcttttgtagaggtgttggacgaactgctcaagcaaagaatcgtcattcgaatggacaaggacgttggcccgcaaaatctgctaagttcattcttgatttgctcaagaatgccgaaagcaatgctgatgtgaaaggtctagatgtggattcactctatatctcacatatccaagtaaaccaagcccagaagcaaaggcgtagaacttaccgtgctcatggaagaatcaacccctatatgtcatctccttgccacatcgagttgactttgtcagagaaggaagaagcagtcaagaaggaggttgacacccaattggctcccaggaaatcgaggaagtctcaagttttacgcagtggtgcttcatcttaagaagtgtagagaaaagataccggtgaactcaaagttttgaagcccgttgttcctatttcacattttcttacttcggaagacagtttaaatgcttttagttcaaacttgatatgtttagagagttgaatatggtgtttctagcaaagtattgttggttttataattttggagattttctttggagtattcatactggaaagcttttgagttctatcattcttaacctaagttttgccgttttg

SEQ ID NO: 1244 - DNA, 892 bp, Setaria italica
agccccgtttcctttcccaccccttgccgccgccgcagacgccccccatccgcctcgaggccgcccgctcgccggttgcagccatggtgaagtactcgagggagccgaccaaccccaccaagtccaccaaggccatgggccgggacctccgtgttcacttcaagaacacccgtgagacagcttttgccctcaggaagttgtcactcaccaaggccaaaaggtaccttgaggatgtgattgcccacaagcaggccatccccttccgcaggtactgcggcggtgttgggcgtactgctcaggctaagtcgcgccactccaatggacagggacgctggcccgttaagtctgctagattcattctagatcttctcaagaatgcagagagcaatgctgaggtcaaaggtcttgacgtcgataccctctacgtgtcgcacattcaagtgaaccaagctcagaagcagcggcgcaggacctaccgtgctcatggacgcatcaatccttacatgtcctccccatgccacattgagctgatcttgtcggagaaggaagagccagtgaagaaagaggctgagtcccagatcgcaaccaggaaggcttagagaagggagctctgcagtattagagtggattgtagcttgtctttggctgagtgaaaattttggctgattatctgtcgtcacttttatcagtgtactgctagctcatacttttgtcaccttgatcactgtctgtactgtgcatgcaactcaaagctctggatcaagtgttcgtggattcttttcatatttctatcgatggtgacgtcaatgcttgttaattgcctggctagggacgtttcacagatcctttgtttggttgtggtttgttctttcgcctcgtgagtgaaaatttc

SEQ ID NO: 1245 - DNA, 776 bp, Glycyrrhiza uralensis
gcctaatcttcttccttgctccctccctccctcagccgtgctcgtgcggaagaagtactagccaatagccatggtgaagtactccagagaacccgacaatcccaccaagtcttgcaaggctagaggcgctgacctcagagtgcatttcaagaacactagggagactgcctttgccatcaggaagttgcccctgggaaaagccaaaagatacttggaagatgttttggcccacaaacaggccattcctttccgacgcttctgcggcggtgttgggaggacagcccaggctaagaatagacattccaatgggcaaggtcgctggcctgtcaaatcagcgaaattcatcctagatctgcttaagaatgctgagagcaatgctgaagtgaaaggtttggatgtcgatgctctttacatttcacatattcaggttaatcaagctcaaaagcaaaggcgtcgtacctacagagctcatggaagaatcaatccctacatgtcatctccctgccacatagagctgatattgtctgaaaaggaagagcctgtgaagaaagagcccgagacccagttggcaacaagtaagaagaagtctcaagctcttcgaagtggtgcttcatcataaattgctgttcaagctaatagttgaggccctgcatttctagattatgtcagtttacttttatatttgttatgagacgtttttgaagcttgaacagcactttttgtttcacatactatggtttaagctaattgagttacccggaaaattttatgatggc

SEQ ID NO: 1246 - DNA, 847 bp, Prunus persica
gactgctcctccttctgccgccgatcaacagcaatggtgaagtactcgagggagcctgataatccaaccaagtcctgcaaggccaggggctcggatctaagagttcatttcaagaacacgagagagacagcccatgccatccggaaaatgcagttgggaaaggccaaaagttacttggaagatgttttggctcacaagcaagccattcccttccgccgcttttgccgtggtgttggtcgtactgctcaggcgaagaaccgccagtcgaatggtcaaggacgctggccggttaagtctgctaatttcattcttgatttgctcaagaatgctgagagcaatgctgaagtgaaagggctggatgtggattcactttatgtctctcacatccaggtcaaccaggctcagaaacagagacgccgcacatatcgtgctcatggaagaataaatccttatatgtcatctccctgccatatcgagttggttttgtcagagaaagaagagccagtgaagaaagagcctgaaactcaattggctcccaggaaatcaaggaaaggccaagcactacacagcggtgcttcttcttgaattgtttggtttaaagagtttatggtcattctgatcctagatcatccactctatcttttcctagaatgtctcagttttcagatatctgttatttgtagttgagaattctgtcaccgaatatttgttcaacaattttgcttttcagtgtctgggtgagactttaagcctttctttttctgagtagaataattttctattgggaatttgtagtgatttcgaaaattgaagctaattaattaatgagaagtttggttttcttgag

SEQ ID NO: 1247 - DNA, 1141 bp, Oryza sativa
gctccctaggtttcgtctcccccctatataaatgcttctcctgcgccgtcgtttccctcttccatccttcgctcgctccgccgccgccgccgccgcctcctcctcctcggcgcctctccgccgccgcctcagccatggtgaagtactcgagggaggcgaacaaccccaccaagtcctccaaggccatgggccgggacttgcgtgtgcacttcaagaacacccgtgagacagcttttgctatcaggaagttgcctctgggcaaggccaagaggtaccttgaggatgtgattgcccacaagcaagctatccccttccgtaggtactgcggtggtgttggccgcactgctcaagctaagtcacgccattcaaacggtcagggacgctggcctgccaagtctgctagattcattctggatcttcttaagaatgcagagagcaatgctgaggtgaaaggtctggatgttgatactctttatgtgtcccacattcaagttaaccaggcccagaagcagaggcgccgtacctaccgtgctcatggacgcatcaacccttacatgtcctccccgtgccacattgagcttatcctgtcagagaaggaagaaccagtgaagaaagagcctgagtctcagatcgcagccaggaaggcctagagaaggaagctttgccccccttctgcctgtttgttagatcagattattatatagcctgtggcttttggctgagtgaaaattttggctggttgtccgcttgtttggcctatcggaaattcggaatactactagctcatacttcgtcaaaaccgttatctctgtgtactgaatctattactatgttctcaaaacgcaaatcttggaggtgtttggattttctttaacctgattcggtcgtgaactgatggtttttcttgtcgtaagtatgctgttgcacctggtgttgaacaactaatctctgtttttgaaatggttttcggaaaacagcattatggctcgatgcaggattacagtcactttgttaattgcaactgaatacgcttagtcctcggcctatttcttgccttgtattccgtattttggtttgtaacttgggctcaaacggttttaacgaagtatgaatctcgcaacgcatgcatcttgtaactggc

SEQ ID NO: 1248 - DNA, 799 bp, Petunia hybrida
gggcacgagccagcagaggtatccagcagccatggtgaagtattcaagagaacctgagaaccccactaaatcttgtaaagctagaggctcagatctcagagttcatttcaagaatactagagagacagcgcatgcccttaggaagatgcctttgggcaaggcaaagagatacttggaggatgttcttgcccacaaacaagccattcctttcacacgcttttgtcgtggggttggccgtactgcccaagcaaagaatcgtcactcaaatggacaaggacgttggcctgtcaaatctgcaaattttattctagacttgctcaaaaatgctgagagcaatgctgaagttaaaggtttggatgtggattcactttatataagtcacatccaagtaaaccaagcacagaaacagaggcgccggacataccgtgctcatggaagaatcaatccctacatgtctaatccctgccatattgagttgatattgtctgaaaaggaagaatctgtaagaaaggagcccgagactcaattggctcccagaaagacaaaggcatcagcttgaggggaggagtaaatctttgctttatggaagtataattttgacgtcccaatagcattattatcgtcagaagaattttgtgccattagtagcattttccatagaaacttgtggttgtgttatttttactttttcggagcttgtacttggtgtactttgaagcatgtttccttggaaattttgggagctagattttgcaagatcttgcttatttcaaatatttaaattgtgatggttatgggg

SEQ ID NO: 1249 - DNA, 789 bp, Lotus japonicus
accaaactccgataccttttcctctggtttgcagtgcaggtgccaccagaagccgtcgcaatggtgaagtactcaagagagcctgacaatcccaccaaatcttgcaaggccagaggctctgaccttagagttcatttcaagaacactagggaaacagcgcatgccctccgtaagttgcccttggctaaggccaagaggtatttggaggatgttctggcccacaaacaggccattccattcagacgcttctgccgtggtgttgggaggacagcccaggctaagaacagacactccaatggacaaggacgctggcctgccaagtcagctaaattcatcctagatttgctcaagaatgctgagagcaatgctgaagttaagggtttggatgttgatgctctccacatttctcatatccaagtcaatcaggcacagaagcaaaggcgccgaacataccgagcacatgggagaatcaacccttatatgtcatctccttgtcacattgaattgatactatctgaaaaggaagagcctgtgaagaaagagcctgaggcccagttggcaaccagcaagagggtggcttagtgaaacgagtgctgcattttattttgctatttaactgaattgccttgaggccccattttcctagactatatcaagaggatagttttgctgctacttttctttattatttgtatttgtatgagctgttcgtagaaaatgcttaaacctctgctttgtttcatactgtgtttcaaattatattttctttatcattagcgtgtttgagaa

SEQ ID NO: 1250 - DNA, 853 bp, Musa acuminata
cctgcggcagagaggcggggagcggacagtgggtggagatctcgaaggagtctgcctgcgagcagccatggtgaagtattcgagagagcccgcgaatcctaccaagtctgccaaggccatgggccaggacttgagggttcacttcaagaatacacgcgagaccgcccatgcccttagaaagctaccattatcaaaggccaaaagatatcttgaagatgtaattgctcacaagcaggcgattccttttcgaaggttctgtggaggtgttgggcgtacagctcaagccaagggccgtcacccaaatgggcagggacgttggcctgcgaaatcagctggtttcattttggatctgcttaagaatgcagaaagtaatgctgaggtgaaagggctggatgttgatgctctctacatatcacacatccaggtgaaccaagctccaaagcagagacgtagaacctatcgtgctcatggacgaatcaacccttacatgtcctccccatgtcatattgaattgattctgtcagagaaggaagagtcagtcaagaaggagccggagacccaaattgctcccagcaagcccaagaaaggtcaagcccttcgaagtggagcctcctcttaagcaatattcttgagaaagctacggattcctttttctttattgttgaactagatgccgattaattgtcatgaaatagtactgttactctcaaagattttgttgctttttgttctgcttcatgaatgtttgtttgcccttgcgtttgtgttatgtagaatagttatatggttgaattcgattgaacaacacgatggaccgcacataatccatttttcttatagaataattaacaag

SEQ ID NO: 1251 - DNA, 691 bp, Epimedium sagittatum
ggccaggggtctcagcggcaggagtagaccacagccatggtgaagtactcaaggaacccgataaccctaccaaatcttgcaaggccaagggggctgatcttcgtgttcacttcaagaacacgagagaaaccgcgttctcaatcaggaaatgcctttggtcaaggcaaaaagatatctggaggatgtgcttgctcacaagcaagcaattcctttcagacgattctgtagaggtgttggtcggactgctcaagtaaagaaccgccattctaatggacaggggcgttggcctgctaagtctgccagatttgtacttgatctactacagaacgcagagagtaatgctgatatgaaaggtttagatgtggatgctctttatgtttcacacatccaagtgaaccaggctcagaagcaaaggcgtagaacataccgtgcccatggaagaatcaacccctatatgtcttccccttgccatattgagttgattttgtccgagaaggaagaatccgtgaaaaagaggctgaaactcagttggctccaagaagactgaagaagactcaggcactccgtagtggaactccttgaacttttaaaagattagtcaccttagctggtattattaggtgagacgttttgaatgcggttgagtttctaccaacgtttttgttctggcaatacaatacatcattttagt

SEQ ID NO: 1252 - DNA, 959 bp, Amorphophallus konjac
agcaccggcgcctgcaccccgctgtcgccatggtgaagtactcgagggagccgggcaacccgaccaagtccgccaaggccatggggcgggacctgagagttcattttaagaacaccagggaaactgcccatgccatccggaaattgcctttgggcaaggctaagaggtaccttgaggatgttatagctcataagcaagcaatccccttcacaaggttttgtagaggtgtaggtcgcactgctcaagcaaaaaaccgccatccaaatggacagggacgttggcctatgaaatctgcaaggttcatccttgacttgctaaaaaatgctgaaagcaatgcggaggtgaagggattggatgtggatactctctatatttctcatgtccaggttaaccaagcacagaagcagaggcggcgtacataccgtgctcatggacgaattaacccatatatgtcatcaccttgtcatattgaattaatcttgtccgagaaggaggaagccgttaagaaagagcccgagacacagttggctaccaggaaaccaaagaaaagtcaggctttgcgcagtggtgcctcatcatgatctatctacagccgaaggatgccacttcaaatgcatttgttctttttactcttttaagtgggttgcacatttttgttacgttagtgagatcaaatcaccgattgggaagtcttatccgtggtgtagtacatgcttttgaagcacaatacacaatcttctttcctcccaactaggttgctccgccttcaaccgccgctttgcatggatatcatcttttagtttaaattctatgattactctgtttcaacttatttgtgagcattcagctctattgggatttatgtcgcctttagttgtgctttgccatttgtttcaatagttaggaaatttcaaatgtcacgtcccaaaattaatgaatagttgcataatactttgcac

SEQ ID NO: 1253 - DNA, 736 bp, Musa acuminata
agagaggcggggagcggacattggagatctcgaagcagtctgcctgcgagcagccatggtgaagtattcgagagagcccgcgaatcctaccaagtctgccaaggccatgggccgggacttgagggttcacttcaagaatacacgcgagactgcccatgcccttagaaagctaccattatcaaaggcgaaaagatatcttgaagatgtaattgctcacaagcaggcgattccttttcgaaggttctgtagaggtgttgggcgtacagctcaagccaagggccgtcacccaaatgggcagggacgttggcctatgaaatccgcaagtttcattttggatctgcttaagaatgcagaaagtaatgctgaggtaaaagggctggatgttgatgctctctacatatcacacatccaggtgaaccaagctccaaagcagagacgtagaacctatcgtgctcatggacgaatcaacccttacatgtcctccccatgtcatattgaattgattctgtcagagaaggaagagtcagtcaagaaggagccggagacccaaattgctcccagcaagcccaagaaagctcaagcccttcgaagtggagcctcctcttaagcaatattcttgagaaagctacggattcctttttctttatcgttgaactagatgccgattaattgtgtcatgaaatagtactgttacactccaagattttgttgctctttgttctgcttcatgaatgtt

SEQ ID NO: 1254 - DNA, 825 bp, Vigna unguiculata
gggagccatttcgtgttcgaactgtgaaggtgccgaattaagccgcaatggtgaagtactcaagggagccaaacaatcccactaagtcatgcaaggctagaggcgccgaccttagggttcatttcaagaacactagggaaactgccttcgcaatcaggaagttgcccctggtcaaggccaaaaggtatttggaggatgttcttgcccacaaacaggccattccattcaggcgtttctgccgtggtgttggcaggacagcccaagcaaagaatagacactctaatggccaaggaaggtggcctgtcaaatcagcaaaatttatccttgatttgcttaaaaatgccgagagcaatgctgaagtgaaaggtttggatgttgatgcactctacatttcccatatccaagtcaatcaagcgcagaagcaaagacgccgaacataccgagcccatggaagaatcaatccttatatgtcatccccgtgccacatagagttgatattgtcggaaaaggaagaacctgttaggaaggagcccgagacaaagttggcgacaagcaagaaatcccaagctcttcgaagtggtgcctcttcttagattttgttgcttttgttcttatattgcttggtgaagttttgaactttgtttcaatttaatgtggtttatctgtaaaacttcatttagtgtttttagactggtttttcacttgaatggaaagtttctaatgatgtactaaatattgaaaccacggtactgtagttttattttttgttacattgcctccaccttttattctcgataaatatattaatgaatttgcaaaacttct

SEQ ID NO: 1255 - DNA, 834 bp, Vigna unguiculata
gggctgtgagccatttcgtgttcgaactgtgaaggtgccgaattaagccgcaatggtgaagtactcaagggagccaaacaatcccactaagtcatgcaaggctagaggcgccgaccttagggttcatttcaagaacactagggaaactgccttcgcaatcaggaagttgcccctggtcaaggccaaaaggtatttggaggatgttcttgcccacaaacaggccattccattcaggcgtttctgccgtggtgttggcaggacagcccaagcaaagaatagacactctaatggccaaggaaggtggcctgtcaaatcagcaaaatttatccttgatttgcttaaaaatgccgagagcaatgctgaagtgaaaggtttggatgttgatgcactctacatttcccatatccaagtcaatcaagcgcagaagcaaagacgccgaacataccgagcccatggaagaatcaatccttatatgtcatccccgtgccacatagagttgatattgtcggaaaaggaagaacctgttaggaaggagcccgagacaaagttggcgacaagcaagaaatcccaagctcttcgaagtggtgcctcttcttagattttgttgcttttgttctttatattgcttggtgaagttttgaactttgtttcaatttaatgtggtttatctgtaaaacttcatttagtgtttttagactggtttttcacttgaatggaaagtttctaatgatgtactaaatattgaaaccacggtactgtagttttattttttgttacattgcctccaccttttattctcgataaatatattaatgaatttgcaaaacttctaag

SEQ ID NO: 1256 - DNA, 840 bp, Cyamopsis tetragonoloba
cacgagggtcactgtgaaggtgccagagttagccatcatggtgaagtattcgagagagcctgataatcccaccaagtcctgcaaggccagaggtgctgatcttagggttcatttcaagaacactagggaaactgcctttgcaatcaggaagttgcccttggccaaggctaaaaggtacttggaggatgttcttgctcacaaacaggccattccattcagacgtttctgtggtggtgttgggaggacagcccaagcaaagaacagacacagtaatggacaaggacgttggcctgtcaaatctgctaaattcattctagatttgcttaaaaatgctgagagtaatgccgaagtgaaaggtttggatgttgatgctctatacatttctcacatccaagtcaatcaagcacagaaacaaagacgccgaacataccgagcccatggaagaatcaacccctatatgtcatctccttgccacattgagttgatattgtctgaaaaggaagagccagtgaagaaggagcccgagacgcagttggcaacaagcaagaagaagtcccaagctcttcgaagtggtgcttcatcttaatttgcaagttataactaaaattgtttgaagcccaatattcctagattgtgtcaaaaggagaattttgtttgttttgtttttcttttaatattatgcatgagctattcgcagaagggcttaaacaccatgtttgtttcgatactgtcaaattaatttgagataattagaaaacttttcggttattctgatgtgcggacttgggtagtacgcggtagcctaaaggaggacaaggtttttgctatctgatcctcgtg

SEQ ID NO: 1257 - DNA, 927 bp, Eschscholzia californica
tcaactctttgccgcattttcaatttaactcaccagaagaaagaggaagaaaccagaagaagcaaatcaacaatggtgaagtattcgaaggaacctgataatcccaccaagtcttgcaaggctagaggggcagatcttcgtgttcattttaagaatacaagagagacagcgttttcaattagaaaattgcctcttgtcaaagctaagaggtatttggaggatgtgttagctcacaaacaagccattcctttccgacgtttctgtggtggtgttggtaggactgcccaagcgaagaaccgtcattccaatggtcaaggtcgctggcccgctaaatctgcaaaatttatccttgatttgctcaaaaacgctgagagcaatgctgatgtgaaaggtttggatgtggattcgctatacatttctcacattcaagttaaccaagctcaaaagcagagacgaaggacataccgtgctcacggaagaattaacccttatatgtcatcaccttgccatattgagctcaccttgtctgagaaggaagaacccgtgaagaaagaggctgatactcaattggcatcaaggaaaccaaagaaagttcttcgaagcggtgcttcctcttagaccaggaacacagagagtagagccggccctcgacagaagtatcaaagtcttttagttgctgcatttccttttttggtaccgagaaaccatttctttgctttttaaggtctatttattcatcatattaaggttttcagcttatggtttttgaccaagcacttgatttagtttagaagaaatcacttcttttgaaagattactatggcaaaagtagttaaagttcaacctattttgttttctttgttataacgttgaagaattttgcagattttatcatctttaatatcttcttagctgttcaaaaaaaaa

SEQ ID NO: 1258 - DNA, 692 bp, Carpinus betulus
ggtgaagtattctagggagccagacaaccccaccaagtcctgcaaagcaagaggatccgatctccgagttcattttaagaacacgagggagacagcctttgcaattcgaaagttgcctctgatcaaggccaaaaggtatttggaggatgttttggcccacaagcaagccattccattccggcgcttttgtcgtggagttgggcgaacggcacaagctaagaaccgccattccaatggacaagggcgctggccagcaaagtctgcaaagtttattctggatttgcttaagaatgctgagagtaatgcagaggtgaaagggctggatgtggattcacttcacatatctcacatccaggtaaatcaagcccagaagcaaaggcgtcgcacataccgtgctcatggaagaattaacccctacatgtcgtctccatgccacattgaattgactttgtcagaaaaggaagaacctgtcaaaaaagagcctgagactcagttggctcctaagaaatcaaagacccaagccctacgtagtggtgcttcttcttgaggtgcagagttgtagaccgtatttcagtgttcttctttcttagttatttcatgagaacatttttgtgtgtcttatttaatggagtgctatcaactcagtttgtcttgagagattcttatattttgtttttggagcttaatgcaaa

SEQ ID NO: 1259 - DNA, 792 bp, Carpinus betulus
gtggggtagggtttcacgtcggccctctttatatctctgacgaccctctctaaccttatttttcctttgctgggatttgggaaggcagcgtcgaacagaggcagaagccatggtgaagtattcaagggagccagataaccccaccaagtcctgcaaagcaagaggatccgatctccgagttcattttaagaacacgagggagacagcctttgcaattcgaaagttgcctctgatcaaggccaaaaggtatttggaggatgttttggcccacaagcaagccattccattccggcgcttttgtcgtggagttgggcgaacggcacaagctaagaaccgccattccaatggacaagggcgctggccagcaaagtctgcaaagtttattctggatttgcttaagaatgctgagagtaatgcagaggtgaaagggctggatgtggattcacttcacatatctcacatccaggtaaatcaagcccagaagcaaaggcgtcgcacataccgtgctcatggaagaattaacccctacatgtcgtctccatgccacattgaattgactttgtcagaaaaggaagaacctgtcaaaaaagagcctgagactcagttggctgctaagaaatcaaagacccaagccctacgtagtggtgcttcttcttgaggtgcagagttgtagaccgtatttcggtgttcttctttcttagttatttcatgagaacattttggtgtgtcttatttaatggagtgctataaactcagtttgtcttgagagattcttatattttgtttttggag

SEQ ID NO: 1260 - DNA, 1088 bp, Carpinus betulus
ccctttataaaactactctaccgcttctcctctctgctacgtaaagagcaaatcaagcttcaccgaggcagctgaaccatcctcatctcatcagccgccagccatggtgaagtactccagagagccagacaaccccaccaaatcctgcaaggccaggggctccgacctcagggttcatttcaagaacacaagggagactgcctttgctatcagaaagttgccattggtcaaagctaagaggtatttggaggatgttctggcccacaaacaggcgatccccttccgacgcttctgccgtggtgttggccggactgctcaggcgaagaacaggcattcgaatggtcaagggcgctggcctgctaaatctgctaaattcatcctggatttgctcaagaatgctgagagtaatgctgaggtgaagggtttggatgtcgatgctctccacatatctcacatccaggtgaaccaagcacagaagcaaaggcgccgtacctaccgtgctcatggaagaattaatccctatatgtcatctccttgccatattgagttggttttgtccgagaaggaagaacctgtcaagaaagagcctgagactcagttggcaactagcaaatctaagaagtctcaagctctacggagcggtgcttcctcttaagttgcagtcggagaacaaacaattgaaacggtgtcccgaatttcttgctgctactcttttgccttttgatgagatttttgtttcttgtcatatagaatgagctgttgtttagatgacttgaatgacttggtttttttcattcaaactatgtttagttcgaacgtcattgagattttaattggagatttgttgttggcctatgaatgcaggagttttatacacataatcctattagagattgcatcatttttgccatctgtacttttcccttggttctctactacattcttatgatacttgttgggttactcataaagggtgatgaacattttccttatttgatgtttcattccttgtcccgtacacattttgtggcccaagaaaaatggaagttatagtggggcttttcacctaattaattggttgcttattc

SEQ ID NO: 1261 - DNA, 640 bp, Actinidia deliciosa
caaagcactcgagagagcaagcatggtgaagtactcaagagagccagacaaccccaccaagtcctgcaaagccaggggctcagatctcagagttcattttaagaacacgcgggagacagcccatgccatcaggaagatgcctttgactaaggctaagaggtatttagaagatgtgctggctcacaagcaggccatacccttcacacgtttttgtaggggtgtaggacgcactgctcaggcgaagaacaggcattcaaacggacaaggacgctggcccgtcaaatctgcgggattcatacttgatttactaaaaaatgcagagagtaatgctgaggtgaagggtttggatgtagatacactttacatatctcacattcaggtgaaccaggcacagaagcagagacgccgcacataccgtgctcatggaagaataaacccctacatgtcttccccgtgccatatcgagttgatcttgtccgagaaggaagagccagtcaaaaaggagcccgagtctcagttggctaccagcaaatcgagaaagtctcaagctctacgaagtggtgtatcctcttgaacagctttgatacgacgagtagtttaagaaattttcggagtattctctgtcttgtctctcagttct

SEQ ID NO: 1262 - DNA, 647 bp, Glycyrrhiza uralensis
ggccgagagccctcgatcgattttgtgctggtgccaccataacccgtcgtcatggtgaagtactcaagagaacctgataatccaaccaagtcctgcaaggctagaggagctgatcttagagttcatttcaagaatactagagaaactgcctttgccatcaggaagttgcccttggcaaaggctaaaaggtacttggaggatgttctcgcccacaaacaggccattccattcagacgtttctgtggtggtgttgggaggacagcacaggccaagaatagacactctaatggacaaggacgttggccggtcaaatcagctaaattcatcctagatttgcttaagaatgctgagagtaatgctgaagtgaaaggtttggatgttgatgctctatacatttctcatatccaagtcaatcaagcacagaaacaaagacgccgaacataccgagcccacggaagaatcaacccttacatgtcatctccctgccatattgagctgatattatctgaaaaggaagagcctgtcaagaaagagcctgagacccagttggcaacaagcaagaagaagtcacaagctcttcgaagtggcgcttcatcctaaattgctatttaacaaaattgaggtcccatattcctagattgtcaaga

SEQ ID NO: 1263 - DNA, 902 bp, Elaeis guineensis
tttgagaccgccctcctctctgttgcagtgcgagagcgaagagaagaggagggaagcggagaccggtccttctccccgttcctctgcagccatggtgaagtattcgagagaacccaacaaccccaccaagtccgctaaggccatgggccaggatttgagggttcactttaagaacactcgtgaaacagctcacgcgatcaggaagctgcctttgggcaaggctaggaggtacctggaggatgtgattgctcacaagcaagctattcccttccggaggttttgtggaggtgtagggcgtacagctcaagcaaaatcccgccatgcaaatggacaggggcgttggcctgtgaaatctgccagattcattttggatctgctcaaaaatgctgaaagcaatgctgaagtaaaaggtttggatgtcgatgctctctacatatctcacatccaggtgaaccaagcccaaaagcagaggcggcggacctaccgtgctcatggacgaattaacccttatatgtcctctccatgtcacattgagctgatcctgtcagagaaggaagaacctgtcaagaaagagcctgagtcacagattgcccccaggaagcccaagaaagttgctttgcgcagtggaacctcatcttgagtagtaacattagcagttttgagtcggattttgggatcagttttggtccactttggttctaatttagatgatgctggttgttttggcatgtttccgaacattttttttttgatggaatttacttgcacttattgttatttgtctttggtggctgtgttaatggagatctctctaaggatatcacctctattaaaattttgaaaggatgaatccagctactaggtacttagcaaaatatgtcacgtttttgacactttgatca

SEQ ID NO: 1264 - DNA, 743 bp, Allium cepa
gcggccagtctctgcaatcgtaaaaatggtgaagtattccagggaacccgacaacatcacgaaatccgcaaaggcgatgggtcgggatttgagggttcattttaagaacaccagggaaaccgctttctctattagaaagatgcctttggcaaaagctaaaaggtacttagaagatgttgttgctcacaagcaagctatcccatttagaaggtactgccgtggagttggccgtacagctcaagctaagaatcgtcattctaatggtcaaggtcgttggccaatgaaatctgcaaagttcattctcgacttgcttaagaatgctgagagcaatgcagaagtgaaaggtttagatgtggatgcactttacatctcccacattcaagtgaaccaagctcagaagcagaggcgaagaacttaccgtgctcacggacgaatcaatccttacatgtcatcgccctgtcacattgaacttattctctcggagaaagaagagcctgtgaagaaagagcctgaaactcagttggcgactaaatcaaagaatcctcttaagagtggtggaattgtgctgtctttttgttccgagatattttggaccaaagtttaaatcttgttatcctagttaagtttccttttgtttcggtctattttgttccttttattttatcttgggccgctagttgtgtactctatcttaaaagatggttggacaaaagcattcattcaaaaattcaaaatttgctttt

SEQ ID NO: 1265 - DNA, 850 bp, Arachis hypogaea
atatataatgaaagtaaaaccctaatttgagaacccttctgtgtagcctccgcgaagaggaagaacaagctgcaatcgccgacatggtgaagtactccagagaacccgaaaatcccaccaagtcttgcaaggctagaggctctgatttgagggttcatttcaagaacactagggagactgcctttgctatcaggaagttgccgcttgttaaggcaaagaggtatttggaggacgttttggcccacaaacaggccattccattccgacgcttctgtggtggtgttgggaggactgcccaggcaaagaacagacattccaatggacaaggacgctggcctgtaaaatcagctaaattcatccttgatttgctcaagaatgctgagagcaatgctgaggtgaaaggtttggatgtggatgctctttacatttcccacatccaagtcaaccaagcacagaaacaaagacgccgcacctaccgtgctcacggaagaatcaatccctacatgtcatctccctgccacatagagttgatcttatccgagaaggaagagcctgttaagaaagagccggagtcccagttggcaacaagcaagaagtctcaaggccttcgtagtggtgcttcatcctaaattgctgtcgatgcagaagattgagttactaaattcctaggttgttagttttgttactctgtttgccctatatttgtcatggatcagtttttttagaatgaacagcaattttgttcatatattctgccaagttaatttgagattatgggaaatttgttatggaaatcttttgattattatcaagttttagttaaatgagagtgagttaccttatgttaagt

SEQ ID NO: 1266 - DNA, 838 bp, Arachis hypogaea
ggggatctgtcctttgttagcctcgcgaagaagaagaaaaaacaagctgcagtcgccatggttaagtactccagagaacccgaaaatcctactaagtcttgcaaggctagaggctctgatttgagggttcatttcaagaacactagggagactgcctttgctatcaggaagttgccgcttgttaaggcaaagaggtatctggaggacgttttggcccacaaacaggccattccattccgacgcttctgtggtggtgttgggaggactgcccaggcgaagaacagacattccaatggacaaggacgctggcctgtaaaatcagctaaattcattcttgatttgctcaagaatgctgagagcaatgctgaggtgaaaggtttggatgtggatgctctttacatttcccacatccaagtcaaccaagcacagaaacaaagacgccgcacctaccgtgctcacggaagaatcaatccctacatgtcatctccctgccacatagagttgatcttatccgagaaggaagagcctgttaagaaagagccggagtcccagttggcaacaagcaagaagtctcaaggtcttcgcagtggtgcttcatcctaaattgctttcgaggcagatgattgagttactaaattcctagggtgttagttttgttactctgtttgccaccctatatttgtcatggatcgttttttagaatgaacaacaattttgtttcacatatattctgcgaagttaatttgagattatgggaaatttgttatggaaatctactgattattaagttttagttaaacgagagtgagttaccttatgttaatttgcttctattcct

SEQ ID NO: 1267 - DNA, 1080 bp, Arachis hypogaea
atggtgaagtactccagagaacccgaaaatcccactaagtcttgcaaggctagaggctctgatcttagggttcatttcaagaatacaagggagactgcctttgcaatcaggaagctgccccttgttaaggcaaagaggtacctggaggatgttctggcccacaaacaggctattccattccgacgcttctgcggtggtgttgggaggactgcccaggccaagaacagacattccaatggacaaggacgctggcccgtgaaatcagctaaattcattcttgatttgctcaagaatgctgagagcaatgctgaggtgaaaggtttggatgtggatgctctttacatttctcatatccaggttaatcaagcacagaaacaaaggcgccgcacctaccgagctcacggaagaatcaatccttacatgtcatcaccatgccacatagagttgattttatctgagaaggaagagcctgtcaagaaagagccggagacccagctggcaacaagcaaaaagaagtctcaagctattcgtagtggtgcttcatcctaaattgttgttgaagcagattgtcgaaagtcctaagttgtcagttttgttgctcgttatttgtcatggatttctcttgtagaagaatgaacagcacttctgcttcacatagacgctgtcaagttaattttgagattcttggaaattttgttttggaaatgtactatttgttgggtattacctagtgtctttagttaagcattaaaaatggttgattcaggatctatgattttgttccttttctagcttttgcctaaagaattttcatacgcaagcatgttatcgtggtaacttttttgggacagttctagaagaataaaagataataataggctaataacgtttatatagagagggttcattttcacaagtgaaatcactttgtgaaagaagttcttgaaagggaagttagactaagagcaccagcaaggaagccttgtcccactaggtggagttgactgtatgaatcaaatgacgccattgagttctataatatattatgtctacggagagattgttacatataaatctcgt

SEQ ID NO: 1268 - DNA, 756 bp, Cajanus cajan
tagttgccgagagccattgtttgttgaaggtgcccaattaagccgcaatggtgaagtattcaagggaacctgacaatcccaccaagtcttgcaaggctagaggcgccgaccttagggttcatttcaagaacactagggaaactgcctttgcaatcaggaagctgcccttggttaaggctaaaagatacttggaagatgttcttgcacataaacaggccattccattcagacgtttctgccgtggcgttggaaggacagcccaagctaagaatagacactctaatggccaaggacggtggccagttaaatcagcgaaattcatcctcgatttgcttaagaatgctgagagcaatgctgaagtgaaaggtttggatgttgatgcgctgtacatttctcacattcaagtcaatcaagcacagaagcaaagacgccgaacataccgagcccatggaagaatcaatccttatatgtcatctccatgccacatagagttgatattatctgaaaaggaagaacctgtcaagaaggagcccgagactaagttgacaacaagcaagaagtcccaagctctccgaagtggtgcttcgtcttaagtttctacttaattgtttgaggcacaatattcctagataatctcaagagatttttgtttattttattttcctgttattgtttggaacaagtttcatactgtgtttcgaattaatttgagttaattggaatattttatttagtctttttggacttcttattgcc

SEQ ID NO: 1269 - DNA, 737 bp, Papaver somniferum
ggtgaagtactcaaaggagcccgataatcccaccaagtcctgcaaggctagggggtctgatcttcgtgttcatttcaagaacaccagggaaacagcgttctctttaaggaagatgtctttggtcaaagccaaaaggtatttggaggatgtcttagctcacaagcaagccattcccttcagacgtttctgtggtggtgttggtaggactgctcaagccaagaaccgtcactcaaatggacaaggacgttggcctgctaagtccgccaagttcatccttgatctgcttaaaaatgctgagagcaatgctgatgtaaaaggtttggacgtggattcactatacatttctcatatccaagttaaccaagctcagaagcagaggcgtaggacataccgtgctcacggaagaatcaacccttacatgtcatctccttgtcacatcgagttgaccttatcagagaaggaagaagcagtgaagaaagaggctgacactcagttggcaccaaggaagtcaaagaaatctcaagttcttcgtagtggtgcctcatcttaagcagtagagagagatgagccctcatcaatgtattgagttctctttgagccttgttatttttacgttagaaaccatttttgttgctttcagatatgtttaggctttcaatcatctctattattgcaatttagctcagtgaatgtttgttttgagtgtattttggtacaagtaggatctactaaattag

SEQ ID NO: 1270 - DNA, 762 bp, Papaver somniferum
ccaaaaacccaaactacaacaataggtgaagtattcgaaggagcccgataatcccactaagtcctgcaaggctagggggtctgaccttcgtgttcatttcaagaacactagagaaacagcattctctttaaggaagatgtctttggttaaggccaagaggtatttggaggatgtattggctcacaagcaagccattcccttcagacgtttctgtggtggtgttggtaggactgctcaagccaagaaccgtcactcaaatggacaaggacgttggcccgccaagtctgccaagtttatccttgatctgcttaaaaatgctgagagcaatgctgatgtaaaaggtttggatgtggattcactatacatttctcatatccaagttaaccaagctcagaagcagaggcgtaggacataccgtgctcacggaagaatcaacccttacatgtcatctccttgtcacatcgagctgaccttgtcagagaaggaagaagcagttaagaaagaggctgacactcagttggcaccaaggaagtcaaagaaatctcaagttctccatagtggtgcctcatcttaagcagtagagatagatgagtactcagaaatgtattgagtttcgtttgtgccttactattttgacattagaaaccattttcgttgcttttatatatgtttagacttttttgttctttcttatcatatgaagtaattttggtctatatggtcccgtcggccgactatctgttattgtctgtttagtcatag

SEQ ID NO: 1271 - DNA, 848 bp, Glycine max
aaaattctattatataaagttggtcattcctcctccggtgttgctgacaagccaatcctttgtgtaggtgctcaaccctagtaagccgcaatggtgaagtactcaagggagcctgacaatccaactaagtcttgcaaggctagaggcgccgaccttagggttcattttaagaacacaagggaaactgcctttgcaatcaggaagttgcccttggtcaaggctaaaaggtacttggaagatgttcttgcccacaagcaggcaattccattcagacgtttttgtcgaggtgttggaaggacagcccaggctaagaatagacactctaatggccaaggacggtggcctgtcaagtcagcaaaattcattcttgatttgctcaaaaatgctgagagcaatgctgaagtgaaaggtttggatgttgatgcactgtacatttcgcatatccaagtcaatcaagcacagaagcaaagacgccgaacataccgagcccatggaagaatcaatccttatatgtcatctccgtgccacatagagttaatattatctgaaaaagaagaacctgtgaagaaggagcccgagactaagttaacaacaagcaagaaatcccaagctcttcgaagtggcgcttcgtcatagaatacaacttaattgtttgaggcacaatattcctagattatgtcaagaggagagttttgtttgtttaatttttgttatggtttggtatgagttttatactatgcttcaaattaatttaagttattcgaaaaacttagtttggatttctttcggtgtttcctttggatggatatttaaaagtagtttcaaaagaaatactaagtattagaaga

SEQ ID NO: 1272 - DNA, 840 bp, Tripterygium wilfordii
ttattctttggctgggaggcgaaaatttgcagaggcggcagtcatggtgaagtattcgagagagccaagcaaccctaccaagtcctgcaaagccaggggcagtgatcttcgggttcattttaagaatactagggagactgcctttgctattaggaagttggctttggtcaaggctaaaaggtacttggaggatgtgattgcccataagcaagctattccatttaggcgtttctgtcgcggtgtgggacgaactgcccaggctaagaaccgtcactctaatggacaaggtcgctggcctatgaagtctgcaacgtttattcttgatttgcttaagaatgctgagagcaatgctgaggtgaaaggtttggatgtggatgctctttatgtttctcacatccaagtaaatcaagcacagaagcaaaggcgacggacatacagagcacatgggaggatcaacccatacatgtcttccccttgccacattgaattaattctgtcggagaaggaagaacctgttcagaaagagcctgagactcagttggctccaaggaagcctaaaggtaaagctctccggagtggtgcatcctcttaatgccgagttctagactgattcaagagtagtagtccacaccttcagaaatttccaggttttctgctttgttagaatactataaacttgagttttcatcatgggatgctcatggattttggatgttgtgctatataactattaatttagattcgtaatgctctgttaaacttgggaagcttgttaatgcgatgataagtttagattatgcccctgcctagactgtggtagtggtaggacagcatggtgac

SEQ ID NO: 1273 - DNA, 906 bp, Setaria italica
gctccaacccgttctcttggccattcctcgttcgctcgctcgccgccgccgccgtcgccgccgcttcctcgggtacgctcggcagctgcagccatggtgaagtactcgagggagccatccaaccccaccaagtccgccaaggccatgggccgggacttgcgtgtgcactttaagaacacacgcgagacagcttttgccatcaggaagctgcagctgaccaaggctaaaagatatcttgaggatgtgattgcccacaagcaagcgattcccttccataggtactgtggtggtgttggacgtacggcacaagccaagtctcgccactcaaatggtcagggacggtggcctgtcaagtctgctagattcattttggatcttctgaagaatgcagagagcaacgctgaagttaagggtttggatgtcgatacgctctatgtctcgcatgttcaggtgaaccaagctcagaagcagcggcgccggacttaccgcgctcatgggcgcatcaacccttacatgtcctccccgtgccacatcgaactgatcctgtctgagaaggaagagccagtcaagaaagaggctgagacccaaattgcaaccaggaaggcgtagaagacagggagctttgcatggtttcgctaatgttggttagggagtgaacttatccctgtatctcctttttctgtgctgttggcgcacacttaatcgaacctattttgaagttgaagtatctcaagtggttcttgttcatactgagcaaaagtatctccagtttttgcctgtcatggctgcttgaactacgaagtgcataccttatcgtagtttgtcctggttgaaatgcttgtgtcgtcgttgctagttcatgtccacgtttactgcctgagactgttcttttttgtgtactttttt

SEQ ID NO: 1274 - DNA, 727 bp, Fraxinus spp
cgccatggtgaagtattccagggagcccgacaacccgaccaagtcatgcaaagccaggggatctgatctcagagttcacttcaagaatacaagagagacagcccacgctctgaggaaaatgcctttgtccaaggccaaaagatacttggaggatgttcttgcccacaaacaagctattcctttcacaagattctgtggtggggttggccgcactgctcaggcaaagaatcgccattcaaatggacaaggacgttggcctgttaaatcagcaaattttattcttgacttgctcaagaatgctgagagcaatgcagaagtcaaaggcttggatgtagattcactctacatatctcacatccaggtgaaccaagcaaggaaacagaggcgtcggacataccgtgcccacgggagaatcaacccttacatgtcatctccctgccatattgagttgatcttgtcagaaaaagaagagccagttaaaaaggagcctgaaacccagctggctcccaagaagacaaaatagacttcgagttctaaagagtgatgcctctttataaatgctagactggagatagtcttcaatttcgggaaggcggaagaatttcagttacattctctactgtccactagaacatttttatattatccgaattttgtttaaccagatttatatgtttcttgtgtcttcgactgagtttggtctttaattagaacacaagcattcaag

SEQ ID NO: 1275 - DNA, 741 bp, Fraxinus spp
ggggtctccttttcgggtattgatttctgcagtgccgccgacttcgcctttgccttttcgccatggtgaagtattccagggagcccgaaaacccgaccaagtcatgcaaagccaggggatctgatctcagagttcacttcaagaatacaagagagaccgcccatgctctcaggaaaatgcctctgtccaaggccaaaagatacttggaggatgttcttgcccacaaacaagctattccattcacacgattctgtggtggggttggccgcactgctcaggcaaagaatcgccattcaaatggacaaggacgttggcctgttaagtcagcaaattttattcttgacctactcaagaatgctgagagtaatgctgaagtcaaaggcttggatgtagattcactttacatatctcacatccaggtgaaccaggcaaggaagcagaggcgtcggacataccgtgcccatggaagaatcaacccttacatgtcatctccctgccatattgagttgatcttgtcagaaaaagaagaaccggttaaaaaggagcctgaaacccagctggctcccaagaagacaaaatagacttcgagttctacagagggatgcttaatgacatggtagacttgaggtggtctttgatttcaggaaggcagaagaatttatgtttcagtctctactgtccatgagaacattttatattatctgaattagtaggatacgagcattcaagttttgaataatt

SEQ ID NO: 1276 - DNA, 1128 bp, Zea mays
tgggcctgtagtggccgtgcgggcggctcggcccataacgaaggcgttagggtttcccctcgcagttgccgtgcggccgtgcctcatatacacaatctttcgcgctcctaccggctaccgccgcggcttccttctctacccttcttcctcgcgccgccgccaccgcaagagtatctcaactccgcctcgagacctcccccctcgctggtctcagccatggtgaaatattcgacggagccgaccaaccccaccaagtccgccaaggccatgggccgtgacctacgtgttcacttcaagaacacacgtgagacagcttttgcccttaggaagttgtcactcaccaaggccaaaagttaccttgaggatgtgatcgcccacaagcaggccatcccgttccgcaggtattgtggtggtgttgggcgtactgctcaggctaagtctcgccactcaaatggtcagggacgctggcctgtcaagtctgctaaattcattctagaccttctcaagaatgcagagagcaatgctgaggtgaaaggacttgatgtggataccctctatgtgtcgcacattcaagttaatcaggctcagaagcagcgacgcaggacataccgtgctcatggacgcatcaacccttacatgtcctccccatgccacatagagctcatcttgtcggagaaggaagagccagtgaagaaagaggctgagtctcagatcgcaaccaggaaggcttagagaaggggctctatcttctgtgattggcttagtacaagttttggctgattatttgttgtctcatactgtttacctgagtattgtttgcaagtgctttatcactgtccgaactgtgcatgcaattcactggtctagagaattgttcgtggattgtttcatatttgtgcgtatggctcatgtctgttgctttgctttaatctgtaccgaacattaagtgtagcattaacaatctgaagcgaacatcaagagtagggctgtccttagcatatggtttgtggttgttgcatccttataactatctccgaacccatccttgcatcccatctatttctaaccccattgtgaacagtgtaaaaagtaaagttttttgagtgactgtaacctactggtcgccct

SEQ ID NO: 1277 - DNA, 893 bp, Oryza sativa
ctagggtttcttccctcctcttagaccgccgccgccaccgagccactgcttcttctgtgcggagagagagagagagagagagctacccttcccttcccttctcctcctcctgctccgccgccgccatgggcaagtactcgacggagccgtccaacccgaccaagtcggccaaggccatggggagggatctcagggtccacttcaagaacacaagggagacagcgttcgctcttcgcaagctgcctttggtcaaggcaaagcggtaccttgaggatgttattgctcacaagcaggcaattcccttcagaaggtactgtggaggcgtgggccgtactgcacaagtgaagtctcgccaatcaaatgggcagggcaggtggcctgccaaatcagccaggttcattttggatctgctgaagaatgctgagagtaacgctgatgttaaaggcttggatgtcgacaacctcttcgtttcacacatccaggtgaaccaagcccagaagcagagacgccggacataccgtgctcatggacgcatcaatccttacatgtcctcaccctgccacgtcgagcttatcttgtcagagaaggaagaggccgtgaagaaagagcctgaaaccaccatcgccccgaggaggcagtgagcttatccgcccagagtcgcaactttagttcattttctagtactttgttatggcattgtgtgctatttatgtttctggtaccattgtttagtcggaacttgttaagtttgatgctatcctttcgtttgtgtatgttcaaatggtaacaattacttgccaacttatctgccaaaattttactgccttacaaaagcgtcatcatcaaactgccttgattgcttacagtgattcaaattaaatcttattttcgtc

SEQ ID NO: 1278 - DNA, 810 bp, Ipomoea batatas
ccctttggcagagaggagagccgacctaagcacttcctggaagaggatcatcaacagccatggtgaagtactcaagagagcccgacaatcccacaaaatcctgcaaagccaggggttctgatcttagagttcattttaagaacacaagggaaacagcgcatgctatcaggaagctgcctttaacaaaggctaaaaggtacttggaggatgttttggcccacaagcaagccattcccttcactcgcttctgcagaggtgttggaagaactgctcaggcgaagaacaggcatccaaatggacaaggacgttggcctgtgaaatcagctaggtttattctggatttgctcaagaatgctgagagcaatgctgaagttaaaggcttggatgtggatacacttttcatatcccacattcaggtaaaccaagctcagaagcaacgacgccgcacataccgtgctcatggaagaattaacccctatatgtcatccccctgccatatcgagttaattttgtctgaaaaagaagagcctgtcaagaaggagcctgaatcacaattggcaaccagcaagcctaggaaggcataaggcatctgtgctctcttcacttgtcagtaatatattgaaccagtgatttacgccttcaagaattgaacgattctgatactatcttttgattccttgtgtttggacactagtttatttgcagcagtatgaacaagttttgttttaggagatatatttcctttgctgtattgtttgatactctctgagcttttccttttttgatagtagttttggggttattatgctg

SEQ ID NO: 1279 - DNA, 763 bp, Ocimum basilicum
ggacccatgtaagcagcagcagcagcaacagcaatcgccggaagccatggtgaagtattccagggaacccgataaccccactaaatcttgcaaatccaggggttcaagtctccgagttcatttcaagaatacacgagagactgcacatgctcttaggaagatgccattggacaaggccaagagatatctagaggatgttcttgcacacaaacaagccattcccttcactcgattttgtcgtggggttggtcgcactgctcaggcaaagaatcgccattcaaatggtcaaggacgttggcctgtcaaatcagcagggtttattctagatttactcaaaaatgctgaaagcaatgctgaggtgaaagggcttgatgtggattcactttatatatctcacatccaagtgaatgaagctcaaaaacagaggcgtcgtacttaccgtgcacacggaagaattaacccctatatgtctcacccctgccatattgagttgattttatccgagaaggaagagtctgtcaagaaagagccggagactcagttggctcctaggaaggcaaaggcgtgagcgttgaatcttctgcaatgccaaagctgtttgaagtttagtgtccttagtctctgttatgaaacaattttggcagcttgaaccatttttctgttttaatttgtcgcattgttctgcatactctttactattgctaaagttgagttgaatgtttactttctttagggggcttagacttttagaaaattttcatca

SEQ ID NO: 1280 - DNA, 723 bp, Trifolium pratense
gagccctccatcgtttttttgcaggttccgctacaatccgccgtcatggttaagtactcaagagaacctgataatcccaccaagtctactaaggcacgaggtgcagatcttagagttcatttcaagaacactagggaaactgcgtttgcaatcaggaagttgcccttgatcaaggccaaaaggtacctggaagacgttcttgcacacaaacaggccattccattcagacgtttctgtcgtggtgtaggaaggactgcccaggccaagaataggcactctaatggacaaggaaggtggcctgccaagtctgcaaagttcatccttgacttactcaagaatgctgagagcaacgcagaagtgaaaggtttggatgttgatgccctatatgtttcacatatccaagtcaatcaagcacagaagcaaagacgccgaacatacagagcccatggaagaatcaacccttacatgtcatctccatgccacattgagttgattttatctgaaaaggaagaggctgtcaggaaggagcctgagtcccagttggcaaccagcaagaaggcttaaactcaaattgacccagtttatgttaagagaacagttttgttgccatgtttagttttcttctgttatttgtatgagatatttttagtctttctaaatttttgttttattatactgattaaattatcgaggcaatttgaaaccttgtgttttcaacttttt

SEQ ID NO: 1281 - DNA, 717 bp, Solanum melongena
ctctctcgttgggttaacgaaggaagtagcagcagcaatcgccggaagccatggtgaagtattccagggaacccgacaacccgaccaaatcttgcaaagccaggggttcaaatctccgagttcatttcaagaatacacgagagactgcccatgcacttaggaagatgccattggacaaggccaagagatatctagaggatgttcttgcccacaaacaagccattcccttcacacgcttttgtcgtggggttggtcgtactgcccaggcaaagaaccgccattcaaatggtcaaggacgttggcctgtcaaatctgcagggtttatcctagatttactcaaaaatgctgagagcaatgctgaggttaaaggcttggatgtggattcgctttatatatctcacatccaagtaaatgaagcgcaaaaacagaggcgccgcacataccgagcacatggaagaatcaacccctacatgtctcacccctgccatattgagttgattttatctgagaaggaagagtctgtcaagaaagagcctgagactcagttggctcctaggaagacaaaggcttgagcattgaatttccaggaatgcagaagccgtttaagttttattttgcccttggtctctgatgaaacaattttggcagcctttgaaccaattttctctattaatttgtcgcactgttgtgcttactctttactgtttctaaagtctt

SEQ ID NO: 1282 - DNA, 889 bp, Solanum melongena
cttctctgttggggtaaccaggaaggaagcagcagcagcagcagcaatagccagaagccatggtgaagtattcgagggaacccgataaccccaccaaatcttgcaaagccaggggttcaaatctccgagttcatttcaagaacacacgagagaccgcccatgcacttaggaagatgccgttggacaaggccaagagatatctggaggatgttcttgcccacaaacaagccattcccttcacacgcttttgtcgtggggttggtcgtactgctcaggcgaagaatcgtcattcaaatggccaaggacgttggcccgtcaaatctgctgggtttatcctagatttactcaaaaatgctgagagcaatgctgaggttaaaggcttggatgtggattcactttatatatctcacatccaagtgaatgaagcgcaaaaacagaggcgccgcacataccgagcacatggaagaatcaacccctacatgtctcacccctgccatattgagttgattttatctgagaaggaagagtctgtcaagaaagagcctgagactcaattggctcctaggaagacaaaggcgtgagcattgaatttcctagaatgcagaagctgttttaagttttattttgcccttggtctctgtgatgaaacaattttggcagcctttgaaccatttttctctattaatttgtcgcactggtctgcataactctttgctgtttctaaagtcttctcattatctatgcttactgatgatcgagttacaggtagttatgatgcgatttttgcttaaggtggtctaaaagaagatcattattagcgtttaaagagagatctaaattgaccattttatggacttgcacgaaaaacttaatcaacagagaattttcc

SEQ ID NO: 1283 - DNA, 777 bp, Solanum tuberosum
cttgttgggttaacgaagaaggaagcagcagcagcaacagctatcgccggaagccatggtgaagtattcaagggaacccgataaccccaccaaatcttgcaaatccaggggttcaagtctccgagttcatttcaagaatacacgagagactgcccatgctcttaggaagatgccattggacaaggccaagagatatctagaggatgttcttgcccacaaacaagccattcccttcactcgcttttgtcgtggagttggtcgcactgctcaggcaaagaatcgccattcaaatggtcaaggacgttggcctgtcaaatcagcagggtttattctagatttgctcaaaaatgctgagagcaacgctgaggtgaaaggtttggatgtggattcactttatatatctcacatccaagtgaatgaagctcaaaaacagaggcgtcgtacctaccgtgcacacggaagaattaacccctatatgtctcacccctgccatattgagttgattttatctgagaaggaagagtctgtcaagaaagagccggagactcagttggctcctaggaaggcaaaggcgtgagcattgaaatcttctgcaatgccaaagctgttttaagtttaatgtccttagtctctgttatgaaacaattttggcagcttgaaccatttttctcctttaatttgtcgcattgttctgcatactctttactatttctaaagttgagttgaatgtttaccttattttggtggcttagacttctggaaaattttcgtctgatc

SEQ ID NO: 1284 - DNA, 861 bp, Solanum phureja
aatctatcctctcccaatataagtcgtaaaccctatttttcatctcctttcttgttgggttaacgaagaaggaagcagcagcagcagcaatcgccggaagccatggtgaagtattcaagggaacccgataaccccaccaaatcttgcaaatccaggggttcaagtctccgagttcatttcaagaatacacgagagactgcccatgctctcaggaagatgccattggacaaggccaagagatatcttgaggatgttcttgcccacaaacaagccattcccttcactcgcttttgtcgtggggttggtcgcactgctcaggcaaagaatcgccattcaaatggtcaaggacgttggcctgtcaaatcagcagggtttattctagatttactcaaaaatgctgagagcaacgctgaggtgaaaggtttggatgtggattcactttatatatctcacatccaagtgaatgaagctcaaaagcagaggcgtcgtacctaccgtgcacacggaagaattaacccctatatgtctcacccctgccatattgagttgattttatccgagaaggaagagtctgtcaagaaagagccggagactcagttggctcctaggaaggcaaaggcgtgagcattgaatcttctgcaatgccaaagctgttttaagtttaatgtccttagtctctgttatgaaacaattttggcagcttgaaccatttttctcctttaatttgtcgcattgttctgcatactctttactatttctatatttgagttgaatgtttaccttattttggtggcttagacttctggaaaattttcatcggatcacaatgtctttcattttctatgcataatgtctgtgttg

SEQ ID NO: 1285 - DNA, 981 bp, Solanum lycopersicum
aatctatcatctcccaatataagtcgtaaaccctatttttcatcttctttcttgttgggttaacgaagaaggaagcagcagcagcagcagcagcaacagcaacagcaatcgccggaagccatggtgaagtattccagggaacccgataaccccactaaatcttgcaaatccaggggttcaagtctccgagttcatttcaagaatacacgagagactgcacatgctcttaggaagatgccattggacaaggccaagagatatctagaggatgttcttgcacacaaacaagccattcccttcactcgattttgtcgtggggttggtcgcactgctcaggcaaagaatcgccattcaaatggtcaaggacgttggcctgtcaaatcagcagggtttattctagatttactcaaaaatgctgaaagcaatgctgaggtgaaaggtcttgatgtggattcactttatatatctcacatccaagtgaatgaagctcaaaaacagaggcgtcgtacttaccgtgcacacggaagaattaacccctatatgtctcacccctgccatattgagttgattttatccgagaaggaagagtctgtcaagaaagagccggagactcagttggctcctaggaaggcaaaggcgtgagcgttgaatcttctgcaatgccaaagctgtttgaagtttagtgtccccttagtctctgttatgaaacaattttggcagcttgaaccatttttctcttttaatttgtcgcattgttctgcatactctttactattgctaaagttgagttgaatgtttactttattttggtggcttagacttctagaaaattttcatcagatcacaagtttcattttctatgcatattgtttgtgttgcttcttgtgattttctttacggggtttgtggggattccaatgatattatcatatatgtttaattttgcaaaacacagattgtttaagaaaattgtatttttat

SEQ ID NO: 1286 - DNA, 1201 bp, Musa acuminata
cttgattttgagcccggccgacgtcgggttcggaccgcgattgaaacgtggaccggatcgatcacaatcaaatcggagcatgatctcccttggtttagggtttcgtttcccctatctataagagtcatctctctgccgcgccggccgagagaagcgtgcgctaaacggagtggggtgcagtggagagccgaacgccatggtgaagtattcgagagagcccaccaacccgaccaagtcctccaaggccatgggccgggacttgagggttcacttcaagaatactcgcgagacagctcatgcaattagaaagctacctttagcgaaggctaaaaggtaccttgaagatgtaattgctcataagcaagccattccattccgaaggttttgtgggggcgtaggacgtacagctcaagtgaagggtcgtcatccaaatgggcaaggacgctggcctctgaaatcagccagattcattttggatttgctcaagaatgctgagagtaatgcagaggtgaaaggtttggatgttgatgctctctacatctcacacatccaggtgaaccaagctcagaggcagcggcgtaggacttaccgtgctcatggacgaattaacccgtatatgtcctctccatgtcatattgaattgattttatcggagaaggaagagccagtcaagaaagagccggagacccagattgcaccaagcaagcccaagaaatctcaagctattcgaagtggtgcgtcttcttaaagatcagtggttacagctttgaggaaagcattgatcttgggctgatttgaaatagatgcaggctatcttatttttggtaacaaaagatattctggagattactagtgcttctggaacattatctttttctacctttgtttttgattgggaaatttgtgggattccatagctactttgaaatggaagcaatgtgacaccttaatcgttgagtatttgatctgttttcccctagagcacagacatttgctttgaaatcatcatcttggatcgtggattaagatctatcagtataatctccttgaggaattattttatcttgttgaaatggaaatactgaacagtagtgctggttatcagaactgatgctatcctgttcatgtcttctcggatctcaactgtggatccaataattgtgtagttgttcttctcatgtgccacaatggcgaaaacttg

SEQ ID NO: 1287 - DNA, 1388 bp, Musa acuminata
atgcaaacttgtatcttgaagcattccagttttgttggttccgttatattcgtggagccgcctcatcttgaggcaactgcctcccccttcgctccctcgctcctcctgcagagtgtgcaagtcggagacagcgacgactcttctgcagccatggtgaagtactcgagagagccttccaatcctaccaagtccgccaaagccatgggtcgggacttgagggttcacttcaagaatacccgtgagacagctcatgccattagaaagctgcctttgtcaaaggccaaaagataccttgaagatgtaattgctcacaagcaggctattcccttccgaaggttttgtggtggtgtaggacgcacagctcaagcgaagggccggcacccaaatgggcagggccggtggcctctgaaatcagccagattcatattggatctgcttaagaatgctgaaagcaacgctgaagtgaaaggtttggatgttgatgcactcttcatatcacacatccaagtgaaccaagcgcaaaggcagaggcgcaggacttaccgtgctcatgggcgaatcaacccttatatgtcctccccctgtcatattgaactgattttgtcagaaaaggaagagcccgttaagaaagagccggagacccagattgctcccagtaagcccaagaaagctcaagcaattagaagtggggcttcttcttaggcggcagcagtagttgcatttttcaagaagatatccacccctttctaattagcaggtttcattgtggtatcaaacatatcttcatgagctctatgcactttataaactctattacagttgctttatttaatggagttctgaaggatttgatggacccaacaccactgtgcgctaagttacaggtgaagaattacgctttacatactggattgaaaaggtatttgtgagactcctagattatacagaatattttatcattagctctagtagttggacctgaggatgacctacccttagaggccatagaaaccacaatttgttagcaatctgaatataacaagactgattggggattgtagcaaaatgataacccacgtttcattctacaagccaagaaatactatagcatagcaatctttcccaaccacctgatcatatctgaggatgtatcatgtcattagatgagagaatggagatgattcccatgtctaaagcaagtcatccttcaccattggctgtgatattgaaatgagtgcaaggttaaactgcaaaagatttctttttctttagattctccagttatatataatggttagatgcaaagaaatcaatatgaagaaaaagtagttgttgtgcctgactagttagcaggtgtaatatcactggggaattccatcggacggcca

SEQ ID NO: 1288 - DNA, 939 bp, Phaseolus coccineus
gttggacctcatcgctcccaccttacatgatatggcgacggaactagggttttaaaccctactatataaactccctggtacctcattcttctcctgccgtgagccaattctttgtttgaattgtgaaggtgtcgaattaagcagcaatggtgaagtattcaagggagccaaacaatcctactaagtcgtgcaaggctagaggcgccgaccttagggttcatttcaagaacactagggaaactgcgtttgcaattaggaagttgcccttggttaaggctaaaaggtacttggaagatgttcttgcccacaaacaggccattccattcagacgtttctgtcgtggtgttggaaggacagcccaagcaaagagtagacactctaatggccaaggaaggtggcctgtcaaatcagcaaaattcatccttgatttgcttaaaaatgccgagagcaatgctgaagtgaaaggtttggatgttgatgcgctttacatttcccatatccaagtcaatcaagcgcaaaagcaaagacgccgaacataccgagcccatggaagaatcaatccttatatgtcatccccgtgccacatagaattgatattgtcggaaaaggaagaacccgtaaggaaggagcccgagacaaatttggcaacaagcaagaagtcccaagctctacgaagtggtgcctcttcttaggtttcattggttttatttttctgctattgcttgatgaagtttcatacactctgtttcaaattaattgtttaattggaaaacttcgtttagtatagactgcgttttttcactcgaatggctacttgttgtttctaaagaaatactaaatattgaaaaacaatgtggtattatattttttcttcttactattatactttgcgattaatgaaacgatgaatcttcaaaacatctaaagtaatttaattat

SEQ ID NO: 1289 - DNA, 1006 bp, Phaseolus coccineus
accctagtttgcttcctccttcagcagttgctcttcctcaaccgcgtggaagaagtagaagaagaagaagccgccatggtgaaatactccagagaacccgataatcctaccaagtcctgcaaggcaagaggcgcggacctcagagtgcatttcaagaacactagggagactgcgtttgccatcaggaagttgccccttgttaaagccaaaaggtacttggaggatgtattggcccacaaacaagccatccctttccgtcgcttctgccgtggtgttgggaggactgctcaggcaaagagcagacactccaatggacaaggacgctggcccgtcaaatcagctaaattcatcctggatttgctgaagaatgctgagagtaatgctgaagttaaaggtttggacgtagatgctctttacatttcccatgtccaggttaatcaagcacagaagcaaagacgccgtacctacagagcccatggaagaatcaacccttacatgtcatctccctgccatattgagctgatattatctgagaaggaagagcctgtgaagaaagagcccgagacccaattggcaacaagcaagaagaagggtgctctccgtagtggggcttcatcttaaattgctcttgaagctttattgtgggattcaccttcttagattatgtcagttttgacgatcgttttccttttaaatttgaatttttgttatgagccgcttttgaaggttgaacaacacctttttgtttcgcatgctatgtttttagttaattgagttactgggaaattattcatatggttcgtttctgttttcatttactcggtgtatccctgtgtgcttgttatttttattgagtgagatgaacaaatggctcatttatggaaatcgggactaattacgttttactaagctattattgttgttttattcggaaccttgtaaaaattgagaacttaaaattctaaaggtattttgggtgttttttcaatgcactatttcttagtaa

SEQ ID NO: 1290 - DNA, 1011 bp, Vaccinium corymbosum
aggtaggcgctaccaacctcgtcttctgtagggggagaagggaaactgcaaaggggagcattccattcacttccctcgtcgatagttccgacgcagcagcaatggtgaagtactcgagagagccagacaatcccactaagtcctgcaaagccaggggctccgatctcagagttcatttcaagaacacgagggagactgcgcatgccatcaggaagctgcctttgaccaaggctaagaggtatttagaagatgttctggctcacaagcaggccatacccttcacccgcttttgccgtggtgtaggacgaactgctcaggctaagaacaggcattccaatggacaagggcgttggcctgtcaaatctgcaaaatttgtacttgacttgctaaagaatgctgagagtaatgctgaggttaaaggtttggatgtggattcactttacatatctcacattcaagtaaaccaggcacagaagcagagacgtcgcacataccgtgcccatggaagaataaacccatacatgtcctctccttgccatattgagttgactttgtctgagaaggaagagcctgtcaaaaaggagcctgaatctcagttggcaactggcaaatccagaaagtctcaatctctaagaagtggtgcatcctcttgaatggctttgatatatcttgctgttcagaagttttggggtctccgctcttcttctctaagttatttggaagacgttttattccttttttctattatgaagagaagatgtatgaatacttttgttacaaagaaatatttgttattcagaatgctttggtttgatgaactattttgacataacactgtagtttcatttttcaaaaaatatcctggattttcgacagtcttgatggatgcatgagtggaaagtagattttgaaagatgatgaccggcttcacctatctagttttgacaggcacagttttgatggatgcttgaatgggaaatgaattttggcgacgatggatggcttatacct

SEQ ID NO: 1291 - DNA, 915 bp, Persea americana
agagtggtcatcacggccgggggcccttccgctcgactccgaaggagaaactgagtgtcatctcttgcagccgcaggagccatggtgaaatactcgagggaaccggacaattccaccaagtcctgcaaggccagaggatctgatctgagggtccatttcaagaatacacgagaaactgcttttgcaattagaaagttgcctttgggcaaggctaagaggtatcttgaggatgtcattgctcacaagcaagccatcccgttccgtcggttttgccgaggtgtaggacgtacagctcaagcaaagaacagacattcaaatgggcagggacgctggcctatgaaatctgccaagtacattttggacttgcttaaaaatgcagagagcaatgcagaggtgaaaggtctggatgtggatactctgtttatttctcatatccaggtgaaccaagcacagaagcagaggcgccggacgtaccgtgctcatggaaggattaacccctatatgtcatcaccatgtcatattgagttgatcttgtccgagaaggaagagtccgtcaagaaagagcctgagacacaattggcgcctaggaagaccaagaaatctcaagcacttcgcagcggcacctcttcttgaatgcattgcagaggagttttttgcttttagatgttattgtgaggtttattttgaattgttcgtctattttaagaatgctactaaggggtagatgttatatcagagaccattgcttttaatgttttctttgagtgcatgtatttttggatgttacctttgggcgtctgttgggtctgttgggtcctcatctaactttaattggcaatgtgtcttcatttaactattagtagaatattgtgggaataaagtgtccacatttacgctcaaaacaaaaaaaaaaaa

SEQ ID NO: 1292 - DNA, 822 bp, Phaseolus coccineus
attatggccgggggccgtgagccaattctttgtttgaattgtgaaggtgccgaattaagaagcaatggtgaagtactcaagggagccaaacaatcctactaagtcttgcaaggctagaggcgccgaccttagggttcatttcaagaacactagggaaactgcgtttgcaattaggaagttgcccctggttaaggctaaaaggtacttggaagatgttcttgcccacaaacaggccattccattcagacgtttctgtcgtggtgttggaaggacagcccaagcaaagagtagacactctaatggccaaggaaggtggcctgtcaaatcagcaaaattcatccttgatttgcttaaaaaatgccgagagcaatgctgaagtgaaaggtttggatgttgatgcactttacatttcccatatccaagtcaatcaagcgcaaaagcaaagacgccgaacataccgagcccatggaagaatcaatccttatatgtcatccccgtgccacatagaattgatattgtcggaaaaggaagaacccgtaaggaaggagcccgagacaaatttggcaacaagcaagaagtcccaagctctacgaagtggtgcctcttcttaggtttcattggtttttatttttctgctattgcttgatgaagtttcatacactctgtttcaaattaattttgtttaattggaaaacttcgtttagtatagactgcggttttgtcgaatggctacttgttgtttctaaagaaatactaaatattgaaaaacaatgtggtattatatttttttaattagtaaatattaaactaaggagattattg

SEQ ID NO: 1293 - DNA, 818 bp, Phaseolus coccineus
tggccggggagtttgcttcctccttcagcagttgctcttcctcaaccgcctggaagaagtagaagaagaagaagccgccatggtgaaatactccagagaacccgataatcctaccaagtcctgcaaggcaagaggcgcggacctcagagtgcatttcaagaacactagggagactgcgtttgccatcaggaagttgccccttgttaaagccaaaaggtacttggaggatgtattggcccacaaacaagccatccctttccgtcgcttttgccgtggtgttggtaggactgctcaggccaagagcagacactccaatggacaaggacgctggcccgtcaaatcagctaaattcatcctggatttgctgaagaatgctgagagtaatgctgaagttaaaggtttggacgtagatgctctttacatctcccatgtccaggttaatcaagcacagaagcaaagacgccgtacctacagagcccatggaagaatcaacccttacatgtcatctccctgccatattgagctgatattatctgagaaagaagagcctgtgaagaaagagcccgagacccaattggcaaccagcaagaagaagggtgctctccgtagtggtgcttcatcttaaattgctcttgaagctttattgtgggattcaccttcttagattatgtcagttttgacgatcgttttccttttaaatttgaatttttgtttatgagccgcttttgaaggttgaacaacacctttttgtttcgcatactatgtttttagttaattgagttactgggaaattattcatatggttcgtttctgttttc

SEQ ID NO: 1294 - DNA, 861 bp, Phaseolus coccineus
cttcagcagttgctcttcctcaaccgcgtggaagaagtagaagaagaagaagccgccatggtgaaatactccagagaacccgataatcctaccaagtcctgcaaggcaagaggcgcggacctcagagtgcatttcaagaacactagggagactgcgtttgccatcaggaagttgccccttgttaaagccaaaaggtacttggaggatgtattggcccacaaacaagccatccctttccgtcgcttctgccgtggtgttgggaggactgctcaggcaaagagcagacactccaatggacaaggacgctggcccgtcaaatcagctaaattcatcctggatttgctgaagaatgctgagagtaatgctgaagttaaaggtttggacgtagatgctctttacatttcccatgtccaggttaatcaagcacagaagcaaagacgccgtacctacagagcccatggaagaatcaacccttacatgtcatctccctgccatattgagctgatattatctgagaaggaagagcctgtgaagaaagagcccgagacccaattggcaacaagcaagaagaagggtgctctccgtagtggggcttcatcttaaattgctcttgaagctttattgtgggattcaccttcttagattatgtcagttttgacgatcgttttccttttaaatttgaatttttgttatgagccgcttttgaaggttgaacaacacctttttgtttcgcatgctatgtttttagttaattgagttactgggaaattattcatatggttcgtttctgttttcatttactcggtgtatccctgtgtgcttgttattttttattgagtgagatgaacaaatggctcattt

SEQ ID NO: 1295 - DNA, 3465 bp, Theobroma cacao
cacccttggggacctctctatctcttaaactgtttcttgcttttatttgttttacttttcctttcaaaacttggaaaagaaagaaaaagaaaatactgttagatcgaggtttcggattcctttgttagataatggcgttaaggtttcacgccggagatgtttccggtttcaaattcttgttttccttggcgatcatgtatggtctcatgtcggtcctggttcactccgtgctttacatgaagttcatccagccgttggggatcgacgcgcctctcgatcgcttctccgaggccagagctatcgagcatgttcgagtattgtcacatgaaatcgacggtcgacaagaagggcgtccgggtttgagagaagcagctcggtatattaaggcacagttggaaacgctgaaggagagagctggatctaatattagaattgaggtcgaagagaatgttgttgctggatcattcaatatgatgtttttaggccacagcatatcattgggttacagaaatcataccaatattgtaatgaggctatcttcaatagattcacaggacactgatccatcagttttattgaatgctcattttgatagtccacttggttcccctggtgctggtgattgtggttcatgtgttgcatcattgctggaaattgcgagactaaccatagactctggctgggtcccacctaggcctattattttactatttaatggagcagaagaagtttttatgttgggtgcacatggcttcatgaggacacataaatggcgtgattccataggagctgttataaatgtggaagcatctggaacaggaggtcctgatctggtatgccaatctggacctggttcttggccttcttttgtctatgctcaatcggcaatatatcccatggcacatagtgcagctcaggatgttttccctgttattcctggagatacggattacaggatattttcccaagattatggcaacattcctggcctggatattatctttcttcttggtggttattactaccatacctcatatgatacggtggacagactattgtatgcattacaactgctcctgtgacctggtagcatgcaagcacgtggagacaatttgtataacacagtgaaggcctttgctgagtctcctaagcttaaaaatgctcttgaaagagaatcctttggtattagtgatgactacaatgatgaacgggcgattttctttgattacttaacttcgttcatgatattctactcaagaagggtagctgtggtacttcatagcatccccattgccattttcctaataatgcctttctatttacgtttgaattgtgggttatgttgttgtttttcaaccttctatgattttgtaaaaggaatgatcctccatgctactggaattatgctggctattattttcccagtgttattttccatcctgagattgctattttccagttatgcaatgaactggtttgcaaatccctacttggctttcatgatgttcattcccatctcgcttattggtctattgatccctagaatagtttgtcaccttttccccctctctcaagatgcttcagttttcaagacatcaaaggagatgctatctgatgaggcaagattctggggtgcatttggattttatgcttcattaactttggcttatcttgtagctgggttaagtgggggtttcttgaccttctgcacgtctgcttctatgcttcttgcatggatctccttttacctatcaatcacgttttatggtcatcagtcagtcaggtcaacagttttttatgtgatacctctaattccatgccttacatactctgtttattttggcgggtttcttcttcaatttttgattgagaagatgggaatgatgggtgctgttccacccccgtatgggtattacataactgatattgtggtggcatcagtagttggtgttgttactggttgtgtgattgctttggctctatcttcgcggttctttccatatagtacagatgcacctaagagagttgttttccagcatacatttctgactgcagatgcaaatcaggttgttgattcaagttatgacttttctgtggtggattccaattctttgctgtttctgtttaaatatgcacctgaagtggcaaaggagttgcacattggtccagagttttcttttgacactgctaacatgtctaaccaacagacttttatggcactttttccagtttcccttttgttttcaagaagtttgaagttccccgcaagaagtgatgagattttgaagcaatatagacattttcctcatttgtatgcttataagccacaaaagatgttaagcgatggatctcggagagtttatttggaactttccttaggctccttagaggaggtttgggttgctgtccttaacattactggccctttatctagttggtcatttgctgacaataagctaccagtcccggaaaacgctgaaggtggtccaccatcatacatttgtagacttactggagccagtcatgaaaattggaccttctggttggaggctagcaattctggagatataagggtggatgtagcggtgcttgaccaaatattggtagatgaagcaaagaagttgaagggacttttcccagtctgggcagatgtgactgctggttctagttttttgtccagctatgtgaagtattcaagggaacccgataatcccaccaagtcctgcaaggcaaggggctctgatcttcgggttcatttcaagaacacaagggagacagcctttgccataagaaagttgcctttgggtaaggctaagaggtatttggaggatgttatggcccacaagcaggccatacccttccgacgcttctgtggtggtgttggacgtacagctcaggcaaagaacaggcattctaatggacaaggtcgctggcctgtaaaatctgccaagttcattctagacttgctgaaaaatgctgagagtaatgctgaggttaagggtttagatgtcgatgcactctatatttctcacatccaagtaaaccaggctcagaaacagaggcgtcgtacctaccgtgctcatggaagaatcaacccatacatgtcttctccttgccacattgaattgattttgtctgagaaggaagaacctgtcaagaaagagcctgagactcaattggctgccagcaagtctaagaagtcccaagctctgcgcagtggtgtttcctcttgagttgaagtttaaaattttagtcagtgaaggggtgcttctcaactttgatttcttacctagaggaagttttgatatttttcaaaatagaatgagttgttatgtagatgtattggatggtttcttgtgttttcaaacaatgtttagtcaaatgttatctgagatttttcttggagattttggttgatcttagtctaattataaagttttatataagttgcatttgtgattgagg

SEQ ID NO: 1296 - DNA, 978 bp, Castanea mollissima
ctctttggctgggattttgggaaagacagtattcaacagagccagcaaccatggtgaagtattcgaaggagccagacaaccccaccaagtcctgcaaggccaggggttctgatctccgagttcatttcaagaatacgagggagactgcctttgcaattagaaagttgcatttgaccaaggccaaaagatatttggaggatgttttggcccacaagcaagccattcccttccgacggttttgtagaggagttgggcgaactgcacaagctaagaatcgccattcaaatggacaaggacgctggcctgttaaatctgcacagtttattctggatttacttaagaatgctgagagtaatgctgaggtgaaaggtttggatgtggattcgcttttcatatctcacatccaggtaaatcaagcccagaagcaaaggcgtcgcacataccgtgctcatggacgaatcaacccttacatgtcatctccgtgccatattgagttgactttatctgaaaaggaagaaccagtcaagaaggagcctgagactcagttggctcctaagaaaccaaaggctagagcattacgtagcggcgcttcttcttgagatgcagagttgtagtctgtcagcagtcattttcttggttgactacagtaacattagaaccttttttgtctgccttctttcataaagtgttaaattttctgagtctcttcggagatatttgtattgtgttgttggagcttacttcaaaccagttgaaattgtctttgtcccgtttatcatgaatgcttgaactgttttgatcctctactggttactagctgagctgtctgaatgtttttagagttcaaattcaagccaaattagtaaggtttatttgataattccagcagaagcaatttcaaagcgtgtgggtctcataatcatagaacccgcacaaccgcacactgcatgtatttaatacatgagataattattatta

SEQ ID NO: 1297 - DNA, 788 bp, Eschscholzia californica
gaaaccctctcctacactaaccggagcaaaagcagcagccggagccatggtaaagtactccaaagaaccagacaatccgaccaagtcctgcaaagccaggggtgcggatcttcgagttcatttcaagaacacaagggagacagctttctcaatcaggaaattgcccctagtgaaggctaaaagatatttggaagatgttttagcccacaaacaagctattcccttcagacgtttctgtggtggtgttggtcgaacagcacaagctaagaaccgtcactctaatggacaaggacgttggcccgctaagtctgccaaattcattcttgatttgctcaagaatgccgaaagcaatgctgatgttaaggggttagatgtggattcactatatatttcacacatccaagtgaaccaagctcaaaaacaaaggcgtagaacttaccgagcccatggaagaatcaacccatacatgtcatctccatgtcacattgagttgaccttgtctgagaaggaagaacctgtaaagaaagaggttgatactcaattggcggcgaggaaaactaagaagtctcaggttttacgcagtggtgcttcttcttagaaagtgtaacaagagatggaaaaactgagtaaccaagttttgaagttggtagttgtccattttcaaccttttgatgtattgaaagacagtaaattgcgtttgctaagtttagaactggtgttgtttagaactacagagctttatttttatcaacatttatttggttacagatattggatctcttgttgtg

SEQ ID NO: 1298 - DNA, 767 bp, Euonymus alatus
gctgcagaccactggacctctctggctcctctcattcgttggctgggaaccgaaaatttccggagacgcagtcatggtgaagtattcgagagagccaagcaaccctaccaagtcctgcaaagccaggggcagtgaccttcgggttcattttaagaatactagagagactgcccaggctattaggaagttggctttggtgaaggctaaaaggtacttggaggatgtgattgcccataagcaagctattccatttaggcgtttctgtcgcggtgtgggccgaactgctcaggcaaagaaccgccactccaatggacaaggtcgctggcctatgaagtcagctacatttattcttgatttgctcaagaatgctgagagcaatgctgaggtgaaaggtttggatgtggatgctctttatgtttctcacatccaagtaaatcaagcacagaagcaaaggcgaaggacatacagagcacacgggaggatcaacccatacatgtcttccccttgccacattgaattgattctgtcggagaaggaagagcctgttcagaaagagcctgagactcagttggctccaaggaaaactaaaggtcaagctctccgcagtggtgcatcctcttagtactgagttccacactgattcaagagtagtcgacaccttaagaaattcacagcttttctgtctttttaaaatactcttaaacttagttttcatcatgggatgctcatgcattttggtttttggatgatgtgctatactaatttag

SEQ ID NO: 1299 - DNA, 846 bp, Euonymus alatus
agggtttattttttacacacttctgctgcagaccagtggatctctctggctcctctcattcgttggctgggaaccgaaaatttccagagacgcagtcatggtgaagtattcgagagagccaagtaaccctaccaagtcctgcaaagccaggggcagtgaccttcgggttcattttaagaatactagagagaccgcccaggctattaggaagttggctttggtgaaggctaaaaggtacttggaggatgtgattgcccataagcaagctattccatttaggcgtttctgtcgcggtgtgggccgaactgctcaggcaaagaaccgccactcaaatggacaaggtcgctggcctatgaagtcagctacatttattcttgatttactcaagaatgctgagagcaatgctgaggtgaaaggtttggatgtggatgctctttatgtttctcacatccaagtaaatcaagcacagaagcaaaggcgaaggacatacagagcacacgggaggatcaacccatacatgtcttccccttgccacattgaattgattctgtctgagaaggaagagcctgttcagaaagagcctgagactcagttggctccaaggaaaactaaaggtcaagctctccgcagtggtgcatcctcttaatactgagttctagactgattcaagagtagtcaacaccttaagaaattcacagcttttctgtctttttgaaatactcttaaacttagttttcatcatgggatgctcatgcattttggtttttggatgatgtgctatactaatttagattcgtaatgctttgttaaatttgagattcttgttaatgcgatgatgagtttaga

SEQ ID NO: 1300 - DNA, 753 bp, Euphorbia peplus
ggtgaagtactcaagagagcccgataattccaccaagtcctgcaaggccagggctctgaccttagagttcacttcaagaatacaagggagactgcatttgccttgaggaagttacctttggccaaggccaaaaggtacttggaagatgttatggctcacaaacaagctattcccttccgacgtttttgtggtggcgttgggcgtactgctcaggcaaagaacaggcactctaatggacaaggacgctggcctgccaagtctgccaagttcattctagatttgctcaagaatgctgagagtaatgctgaggtgaaaggattggatgtggacaacctcttcatttctcatatccaagtgaatcaggcacagaagcaaaggcgccgtacctacagggctcacggaagaattaatccttacatgtcaagcccttgccacatagagttgatcttgtctgagaaggaagaaccagttaagaaagagcctgaggcccagctggcgaccagcaaatctaagaagtctcaagctataaaaacaggtgcttctgcttgagagctggtcggtcattgaccagtcgaaggagaacttttgaatacttgtatttttttcagtcttgaggaattttgtttgttctcatttagaatgataagctacttagatgaattgaacagcttgtttgtttgttttgacctatgtttagttacttgttctgagatcggcattgactatttatatgaaagccttccttttcagtgt

SEQ ID NO: 1301 - DNA, 775 bp, Fraxinus spp
cggccgggggtctccttttcgggtatcgatttctgcagtgctgccgccttcgcctctgcccttcgctatggtgaagtattccagggagcccgaaaacccgaccaagtcatgcaaagccaggggatctgatctcagagttcacttcaagaatacaagagagaccgcccatgctctcaggaaaatgcctctgtccaaggccaaaagatacttggaggatgttcttgcccacaaacaagctattccattcacacgattctgtcgtggggttggccgcactgctcaggcaaagaatcgccattcgaatggacaaggacgttggcctgttaagtcagcaaattttattcttgacctactcaagaatgctgagagtaatgaccgaagtcaaaggcttggatttagattcactttacatatctcacatccaggtgaaccaagcaaggaagcagaggcgtcggacataccgtgcccatggaagaatcaacccttacatgtcgtctccctgccatattgagttgatcttgtcagaaaaagaagaaccggttaaaaaggagcctgaaacccagctggctcccaagaagacaaaatagacttcgagttctacagagggatgcttaatgaaatggtagacttgaggtagtctttgatttcgggaaggcggaagaatttatgtttcattctctactgtccacgagaacattttatattatctgaattagtaggatacgagcattcaagttttgaataattcatttcgacattgatgaagggtagtgtt

SEQ ID NO: 1302 - DNA, 731 bp, Panax ginseng
  misc_feature (685)..(685): n is a, c, g, or t
gggggggttaatgctggaaaccaaagcccaaactcagtgggttctagggtttcactctttctgacgctcgttattacttattatattctgataagccagcctccttttgatttcggttgggtactagaacaaatcagcggcggcggcggcaatggtgaagtattcaaaggaacctgacaaccccaccaaatcttgcaaagccaggggctccgatctcagagttcattttaagaatactagagagactgcacatgctattcgtaagttgcctttgacgaaggctaaaaggtacttggaggatgttcttgcccacaaacaagccatcccattcactcgcttctgtagaggagttgggcgaactgctcaggccaagaatagacattctaatgggcaaggacgttggcctgttaaatccgcaaaatttattttggacttgctcaagaacgccgagagtaatgctgaagtgaagggcttggacgtggattcacttcacatatctcacattcaggttaaccaagcacagaagcagaggcgtcgcacataccgtgcccatggggagaatcaacccttacatgttatcaccctgtcacattgaattgactttgtctgagaaggaagaacctgtcaagaaggagcctgaaacttagtggctccttaggaaaacaagaaccaaaccttacgcagngggtgctttgtcatgaattacaaagtgggaagtttgaattaagaac

SEQ ID NO: 1303 - DNA, 845 bp, Jatropha curcas
accagtggtatcccgcagagtggcattacggcggggctgttaagagggaaccataaaccaagaccaagcttcacagaggcagaagcagcgtcagccgccatggttaagtactcaagagagcctgataattccaccaaatcttgcaaggccaggggctctgaccttagagttcatttcaagaacacgagggagaccgcccatgccttgaggaagttgcctttggctaaggctaagaggtatttggaggatgttatggctcacaaacaagctataccttttcgacgtttctgtggtggggttggacgtactgcacaggcaaagaacaggcactcaaatgggcaaggacgctggcctgttaaatctgccagattcattctagatttgctcaagaatgctgagagtaatgccgaggtcaaaggcttggatgtcgatgccctctacatttctcatatccaagtgaatcaggcacagaagcagaggcgtcgaacttatcgcgctcatggaagaatcaatccttacatgtctagcccgtgtcatattgagttgattttgtccgagaaggaagagccagtgaagaaggagcctgagaaccagctagctacaagcaaatctaagaagtctcaagctctacgaagtggtgctgcctcttaagtggcaatcatattttaccatttcaaggagcactttcttatatccctgggttgtttttatttgaagagagttttgtgccattttatttagaaagagcaccattttagtcgaattgagcagcttgtttgctatgtttagttattatatgaaatttttgtgggagaactgggaggaaagagcaacttttcagagtc

SEQ ID NO: 1304 - DNA, 786 bp, Liriodendron tulipifera
  misc_feature (177)..(177): n is a, c, g, or t
  misc_feature (372)..(372): n is a, c, g, or t
  misc_feature (462)..(462): n is a, c, g, or t
  misc_feature (466)..(466): n is a, c, g, or t
  misc_feature (492)..(492): n is a, c, g, or t
  misc_feature (516)..(516): n is a, c, g, or t
  misc_feature (658)..(658): n is a, c, g, or t
  misc_feature (678)..(678): n is a, c, g, or t
  misc_feature (710)..(710): n is a, c, g, or t
  misc_feature (721)..(721): n is a, c, g, or t
cctctcccagcaccggcagccatggtgaagtattcgagggaaccggacaatcccaccaagtcctgcaaggccaggggatcggatctgagggttcacttcaagaataccagggagactgcccatgcaattagaaagttgcccttggtgaaggcgaaaaggtatcttgaggatgtaatngctcataaacaagccatccccttccggcgattttgtcggggtgttggccgtactgcccaagcgaagaaccgccattcaaatggacagggccgctggccagcgaaatctgcaaagttcatcctggacttgctcaagaatgctgagagcaacgccgatgtgaaaggtttggatgtggacacactgtttgtttctcangtccaggtgaatcaagcccagaagcagaggcgccgaacgtaccgagctcatggaaggattaacccctatatgtcatcaccttgtcatatngagntgattttgtctgagaaggaagaaccngtcaagaaggagcctgatactcanttggctccaaggaaacccaagaaatctcaagcgcttcgcagcggtgcttcgtcttaagtgggccataggtagaaggcagctctgaaaattttgaaaatttcagcttcattttatgtttttcctcatttccgtagtcgtgcanttgagaactcagtggtgttntgtttgccagaagttttgatattttactcttngaggtgttttnttttttttatctaaatagttctgttaaaaataactgtggtggaacctcattaagttggtttgagt

SEQ ID NO: 1305 - DNA, 847 bp, Momordica charantia
tcgctgggggactcaagttggtagcagaggggtgaagaagcatcagccgccatggtcaagtactcaagggagccggacaattctaccaagtcctgcaaagcgcggggctctgacctcagagttcattttaagaatacgagagagactgctcatgccctcaggaagttgcccttggccaaggcaaaaaggtacttggaggatgtccttgcccacaaacaggctattccatttagacgtttctgtgggggtgttggacgaactgctcaggcaaaaaataggcactcaaatggacaaggacgctggcctgttaaatctgctaaatttatactagatctgctcaagaatgcagagagtaatgctgaagtgaagggtctggatgttgattctctcatcatctcccacattcaggtgaatcaagcacagaagcaaagacgtcgtacctaccgagctcatggacgaattaacccctatatgtcatccccctgccacatcgagcttattttgtcagaaaaggaagaacctgtcaagaaagagcctgagacccagttggcagcaagtaaagccaaaagaggtcaagttctccgcagtggtgcttcatcttgatctattttttattgtcatttttctttccgatagagttggttgctttcatcaatatagaatgagttgttccgtatctagtggcccctaactttgtaagtttacaaaaacgtcgatcttgttttttaggaattcttttctaaattttggattctattccttttaatcgaggagttatagaaatcaagacttattttactttttattttttaaccagggtccacaccaggttttgcttctgatgaac

SEQ ID NO: 1306 - DNA, 1326 bp, Quercus alba
ctcggcgccttaccgcattttctctttggctgggattttgggaaagacagcattcaacagagccagcaaccatggtgaagtactcgaaggagccagacaaccccaccaagtcctgcaaggccaggggttctgatctccgagttcatttcaagaatacgagggagacagcctttgcaattagaaagttgcatttgaccaaggccaaaagatatttggaggatgttttggcccacaagcaagccattcccttccggcggttttgtagaggagttgggcgaactgcacaagctaagaatcgccattcaaatggacaaggacgctggcctgttaaatctgcacagtttattctggatttacttaagaatgctgagagtaatgctgaggtgaaaggtttggatgtggattcgcttttcatatctcacatccaggtaaatcaagcccaaaagcaaaggcgtcggacataccgtgctcatggacgaatcaacccttacatgtcatctccatgccatattgagttgactttatctgaaaaggaagaacctgtcaagaaggagcctgagactcagttggctcctaagaaaccaaaggctagagcattacgtagtggcgcttcttcttgagatgcagagttgtagtctgtcagcagtctttttcttggttgactacagtaacattagaacctttttgtctgccttcttttgagaaagtgttaaattttcagagtctcttcggagatatttgtattgtgtgttggagcttatttcaaaccagttgaaattgtctttgtcccgtttatcatgaatgcttgaattgttttgatcctctactggttactggctgagctgtctgaatgtttttagagttcaaattcaagcgaaattagtaaggttcatttggtaatgccagcagaagctatttcaaagcatgtgggtctcataattgtagaagccgcactctacatgtatttaatgcacgagataattattgttattctagatatccatggtgttaaaaagttggggcttttgaccaataattggttgtaaagataaggtagctgtttggcaagacaatttatagggccattgatcaatgtctccatacaaactagccattcaagaagggatctttagattctttactaaagctaaatgtggaaacttgtgaaggcaagtcctgcaatattgaaccttagttcattgtaccaagcagttggtagaaatgaatttaatcaaaaacctttggttaacattactcaaaagaattgatttcaaaaattcaagttgcaaaacagattcagtgtcctgatgtaatgaataaagatgg

SEQ ID NO: 1307 - DNA, 753 bp, Phalaenopsis aphrodite
cagggatggggtcgtttgtgggtcgtttgctcatcgatttagggtttcgtttcaaggtttctctataaattcctccatttcgtgatccgccgtcggccagagaagagcaagaaaaatcggaggctgcggcaccaacccttccgctcaacggagacctctgcaaccaggcatcatggtgaaatactcgaaagagccatccaaccctaccaagtctacgaaggcgatggggcgggacctcagggttcatttcaagaataccagagaaactgcccatgccctccgaaagctgcccttggctaaggctaagcggtatctggaggatgtaatagcccacaagcaagctattccttttcgcaggtactgcggcggtgtcggccgcaccgcccaagccaaggcccgccattccaatgggcagggtcgctggcctgtaaaatctgccaggttcatattggatttgctcaaaaatgctgagagcaatgctgttgtcaaaggcctggatgtggatgccctctacatttctcacattcaggtcaaccaagcacagaagcagaggcgccggacttaccgtgctcacggccgaattaacccttatatgtcttccccctgccacattgaactgatcttgtctgagaaggaagagccagtgaagaaagagccggagactcagattgccgccagaaagccaaagaaagctcaggttttgcgcagtggtgcatcttcttaaatcggggcctgcctgaattgactagtttt

SEQ ID NO: 1308 - DNA, 786 bp, Platanus occidentalis
ggagaggaacagagcagcggtgttcttttggcggcgcagcaacacaacaacaagccatggttaagtattcgagggagccggacaattcgaccaagtcctgcaaagccaggggctcggatctgagagttcactttaagaacacaagggagacagcctttgcaattagaaagttgcctttggtcaaggcgaagaggtatttagaggatgttctagttcacaagcaagccattcccttccgacgcttctgtaggggtgttggtcgaacagctcaggcaaaaaaccgtcattcaaatgggcagggacgctggcctgttaaatctgcgaagtttattctggatttgctcaagaatgctgagagtaatgcagatgtaaagggtttggatgtggattcactttatgtatcccacatccaagtgaaccaggctcagaagcagaggcgtcgcacataccgtgctcatggaagaatcaacccctatatgtcatctccctgccatattgagttgattctgtctgaaaaggaggaaccagtcaagaaggagcctgagactcagttggctcccaggaaaggcaagaaggttcgagctctacgaagcggtgcttcttcttgagcagtgtagtattatggcaattcagaaaggtgctggagttcattttctttgatgacatttttgttgcatttcagatcaaatgtcctgttatttagattttgtgcgagtgttattgtttttttggatatctagacaaaatatagattgatcctaattgagtagttttaataatattaaa

SEQ ID NO: 1309 - DNA, 592 bp, Pteridium aquilinum
agccatggtgaagtactcgagagagccagacaacccgaccaagtcctgcaaagccaggggctctgacctccgtgttcatttttaagaatactagggaaacagcctttgcaatccgaaagttgcctttgataaaggctaaaaggtacttggaggatgttatggcccacaagcaagccattccattccggcgcttctgtggtggagttgggcgaaccgcgcaggctaaaaatcgccagttctaacggtcaaggtcgctggcctgtgaaatctgcaaaattcattcttgatttgctcaagaatgccgagagcaacgcagaggtgaaaggcttggatgtagattcacttttcatatctcacatccaagtgaatcaagcacagaagcaaaggcgccgaacatatcgtgcacatggaagaattaacccttacatgtcttctccatgtcacattgaactgattttgtcagagaaacaggaatctgtcaagaaagagcctgagactcagttggctcctaggaaatcaaagggtcaatctctacggagcggtgcttcctcttaaactgctgagtgatggatcatattcagaaactattgtc

SEQ ID NO: 1310 - DNA, 875 bp, Sarracenia psittacina
aaagcgatacggcatcaggcagattttcttttccttcttcgagagaaaatcgaagcgaagcaaagtaacgcactccgtaatacttttaaggcagaagcgatggtcaaatactcaagagagccagacaatcccaccaagtcctgcaaagccaggggctcagatctcagagtgcattttaagaacacaagggaaacagcccatgccataaggaaactgcatttggccaaggctaaaaggtatttagaagatgtactggctcacaagcaggccatacccttcacacgtttttgcaggggagttggacgaactgctcaggcaaagaacagacattcaaatgggcaagggcgctggcctgccaagtctgcgagattcatacttgacttgcttaaaaatgctgagagtaatgccgaggtgaaaggtttggatgtggatacactttacatatctcacattcaggtgaaccaggcacagaagcagagacgccgcacgtaccgtgctcatggaagaataaatccctacatgtcttccccctgccatattgagctgatattgtccgagaaggaagagcctgtcaaaaaggagcttgagtctcagttggcaactagcaaatcccgcaagtcccaagctctaagaagtggtgcatcctcttgaactgtttttgatgcggccggcagcttaagaagttttggagtgttctccctctcctcttttcagttcttttgaagatgctctgttcctcctattcgttatccatgttttacttgggaagcgggttaggtaggtattgcttgttcctgtttgtaaaagggattttatttggatattttgaaaaaagcttaattgattccatgagcaatgaacaatggaagttttca

SEQ ID NO: 1311 - DNA, 650 bp, Scabiosa columbaria
tcttcctttcgttggggaccttaacgcatcaagcaccagcagccatggttaagtattcgagagaacctgacaaccacaccaagtcttgcaaagccaggggctctgatctccgatgccattttaagaataccagagaaacagcacatgctattcgcaagctgggattgacaaaggccaaaagatatttggaggacgttcttgcccacaagcaagccattcctttcactcgcttttgtcgaggagttggacgaacagctcaggctaagaatcgtcattcaaatgggcaaggacgatggcctgctaaatctgccaagtttattcttgatttgcttaagaatgctgagagcaatgctgaagtgaaaggtttggatgtggattcgcttttcatttcccatatccaggtgaaccaagcacaaaagcaaaggcgtaggacctaccgtgcccatggaagaattaatccttatatgtcatctccatgccatattgaattgatcttgtctgaaaaggaggaaccagtcaagaaagaggctgagacccaattggcaccaaggaagaccaagaagaatcaagctttgcgcagtggtgcatcctcttaaagatctattcttggttgcattcatgcattgcgaggaatatctgtttgatgaata

SEQ ID NO: 1312 - DNA, 812 bp, Glycine max
ctagtttttcttcctccttcagccgttgctctgcttcaaccttgcggaagaagaagacgccgcagccatggtgaagtactccagagaacccgacaatcccaccaagtcctgcaaggccagaggcgctgaccttagagtgcatttcaagaacactagggagactgcctttgccatcaggaagttgcccctggttaaagctaaaagatacctggaggatgttttggcccacaaacaggccatccctttccgacgcttctgtggtggtgttgggaggacagcccaggctaagagcagacactccaatggtcaaggacgctggcccgtcaaatcagctaagttcatcctagatttgctgaagaacgctgagagtaatgctgaggtaaaaggtttggatgtcgatgctctgtacatttcccatgtccaggttaatcaagcacagaagcaaaggcgtcgtacctacagagctcatggaagaatcaacccttacatgtcatctccatgccacattgagctgatattgtctgagaaggaagagcctgtgaagaaagaggctgagacccaattggcaacaagcaagaagaagggtgctcttcgaagtggtgcttcatcttaaattgcccttgaagctagttatctgatgacctacattcctagattatgtcagttttgtcgatcattttcctttatatttgttatgagctgcttttgaagcttgaacagcaccttttgtttcgtatactatgtttcaagttaattgagttacttgggaatttttattatggcaattggatgattgattttagtttcaatta

SEQ ID NO: 1313 - DNA, 933 bp, Juglans hindsii x Juglans regia
tgtgttggtcccggggatcggccattacggccggggccctctgcttagagcaaactaagcaagtcgaatcctcagccgaggcagcagcatcgtccccatccccttcagcggccatggtgaagtattccagagagcctgacaaccccaccaagtcctgcaaggccaggggtaaggaccttagggttcatttcaagaacacaagggagacagcttttgcaatcagaaagttgccattgaccaaggctaaaaggtatttggaggatgttctggtccacaaacaagcaatccccttccgacgcttctgtcgtggtgttggacggactgcccaagcgaagaataggcattcaaatggacaagggcgctggcctgtgaagtctgctaaattcatcctagatttgctcaagaatgccgagagtaatgctgaagttaagggtttggatgtggattctctctatgtatctcacgttcaggtgaaccaagctcaaaagcaaaggcgtcgtacctaccgagctcatggaaggatcaatccctatatgtcatcaccctgccatatcgagttgatcttgtctgaaaaggaagaacctgtgaagaaagagcccgagacccagttggcaactagcaagtctaagaagtctcaagctctacgcagtggtgcttcatcttgagtgacagttttagaactggcaattgaaatgagtgccccgaatttctggctggcttgcacgttttgcctttcgatggaagttttttttatgctgttatgtagttgatttgggtcgcatttgtcttatttcaaattatggttagttcaatcttcagtgatatttttgttggatatttttggttggaaagactattaattcaagagttctatatacaagtattctgagatgcataatgcccgaaattgcaattattgttagtttgatgaac

SEQ ID NO: 1314 - DNA, 766 bp, Vaccinium corymbosum
taccaacctcgtcttctgtaggggagaagagaaactgcaaagggaagcattccattcacttccctcgtcgatagttcgacgcagcagcaatggtgaagtactcgagagagccagacaatcccactaagtcctgcaaagccaggggctccgatctcagagttcatttcaagaacacgagggagactgcccatgccatcaggaagctgcctttgaccaaggctaagaggtatttagaagatgttctggctcacaagcaggccatacccttcacccgcttttgccgtggtgtaggacgaactgctcaggctaagaacaggcattccaatggacaagggcgttggcctgtcaaatctgcaaaatttgtacttgacttgctaaagaatgctgagagtaatgctgaggttaaaggtttggatgtggattcactttacatatctcacattcaagtaaaccaggcacagaagcagagacgtcgcacataccgtgcccatggaagaataaacccatacatgtcctccccttgccatattgagttgactttgtctgagaaggaagagcctgtcaaaaaggagcctgaatctcagttggcaactggcaaatccagaaagtctcaatctctaagaagtggtgcatcctcttgaatggctttgatatatcttgctgttcagaagttttggggtctccgctcttcttctttaagttctttggaagacgttttatccttttttcatatgagaagaagaatgtatcaataacttttgtttac

SEQ ID NO: 1315 - DNA, 975 bp, Beta vulgaris
cctgcattttagggtttcacaaaatatcagttgtgttcctccttcgaatctctctctcatcagttgtaccgccattgacgcagcagcaaagagcaacaatggtgaagtattcaaaagaacccgacaaccccaccaagtcttgcaaggctaggggatcagatcttagggtccatttcaagaatacaagagaaactgcgttttctctccgaaaaatgcctctaggcaaggctaaaaggtatttggaagatgtccttgcccacaaacaagcaattccattccgtcgcttttgtagaggagttggtcgaactgctcaggcaaaaaaccgtcactcgaatggacaagggcgttggcctgccaaatccgcaaagttcatcttggacttgctaaaaaatgctgagagtaatgctgagatgaaaggtttggatgtcgattccctttacatctcacacattcaagtgaaccaagctcaaaagcagaggcgtcgtacttaccgtgctcatggaagaatcaacccttacatgtcacatccatgccacattgagttgactttgtcagaaaaggaagaatcagtgaggaaagagcctgagtctcagttggccgcaagcaaatagaagggtggttccggttcatcttaagcacactttgagggctgtcttcaccacggaggactgatccttcatatcaatttctcttgatcttgccagatgtctttttgctgttcttaccctgtatggggattttgtactgttgatttagatattatttgcgctctattatatgagatttagaaaatacacttacatttcccgttggtttactatggtgcattaatgattattctggactgtctgcttatatctcttgtatgcatttgtgtgattgtggaaaagctgttggagttgcgacctctaatggttattacacccttgccaatcaggcttggagatggaaagttgagtccctttggttttcaaa

SEQ ID NO: 1316 - DNA, 789 bp, Gerbera hybrid cultivar
ggtcataattcgcaaaccctaagccctcagttcgattctcctaagaactccaacttcagcggcatttgcaccggcgaaaccagttgcagccatggtgaagtactcgaaggaaccagacaaccctaccaagtcttgcaaagctaggggttcagatctcaggtgtcatttcaagaacacaagagaaaccgcccatgctcttcgtaagatgcctttgattaaggctaaaagatacctagaggatgttcttgctcataaacaagctattcctttcacacgtttctgtcgtggagttggacgtactgcacaggccaagaatcgtcattcaaatggacaaggacgttggcctgctaagtctgcaaaatttattctggatttgctcaagaatgccgagagtaacgcagaagttaaagggttggatgtggattctcttcatatctctcacatccaggtgaaccaagcacagaaacagagacgtcgcacgtatcgtgctcatggaagaatcaacccttacatgtcttctccttgtcatattgagctgactttatccgagaaggaagaacccgtcaagaaagagcccgagactcagttggcttcaagaaagaccaaatagaatcttacgtaactctgtggtggatcctttttgacttggtgagtcgtagtttgatgctaaaaagagctttatttcgctctctgtgtttctgttttcaaagattttctatcgaatgttatttatcagattttatcatttctttatgaaattaaaacgttatataaaaaaaaaaaaaaaaa

SEQ ID NO: 1317 - DNA, 1095 bp, Zea mays
aaactggttctttttccttggatgaacgtgggccaagctcgagcggctcggcccataacgaagccgctagggtttttgcccagtagttggcttgcatagttgcatgtacacaatttctcgcgctcctaccgccgccgcttcgttctctaaccttggctcccgctccctccgcaggagcatctcaacaccgccttgaggaccccccaactcgccggctgcagccatggtgaaatattcgacggagccaaccaaccccaccaagtcaaccaaggccatgggccgtgacctacgtgttcacttcaagaacacccgtgagacagcttttgcccttaggaagttgtcactcaccaaggccaaaaggtaccttgaggatgtgattgcccacaagcaggccatcccgttccgcaggtattgtggcggtgttggacgtaccgctcaggctaagtctcgtcactcaaatgggcagggacgctggcctgtcaaatctgctagattcattctagaccttctcaagaatgctgagagcaatgctgaggtaaaaggtcttgatgtcgataccctctatgtgtcacacattcaagtgaaccaggctcagaagcagcggcgcaggacctaccgcgctcatgggcgcatcaacccttacatgtcctccccgtgccacatcgaactcatcttgtcagagaaggaagagcccgtgaagaaagaggctgagtctcagatcgcaaccaggaatgcttagagaatgggaacataccttctatgattggctgagtgaagattttggctgattatttgtcgtcccatattgtttacctgagtattgtttgcaagtgctttatcacatggatcacagcctggaattcactggccctgagaattgtctctggattgtttcatttttatgcccatggtatgccaatgctcatgttcagttgccttggttgatgacgcttgtcccaaactcccaaacttaaggctttggttgttgcatcctgtaaaacggtacgcccttggccgcacctgttttggacatattgggcgattgtatgttctgaagcaatttgggctgtattataacgtttctctattgattta

SEQ ID NO: 1318 - DNA, 842 bp, Orobanche aegyptiaca
aatccgaacatttcctcgttagttttttttctttctgaagtagaaaaccccgaacggtctacaatcttccccactgcgccgccgtaaaagcagctacaatggtgaagtactcgagagagcccgataaccccaccaaatcctgcaaggctaggggatctgatctcagagttcatttcaagaacactagggagacagcacacgccatcagaaaactgcctctagtgaaggcgaagaggtatttggaggatgtgctggcccacaagcaagcaatacctttcactcgtttctgtcgaggtgtcggaagaactgctcaggcaaagaacagacattccaatgggcagggtcgctggcctgttaagtctgccaagtttatcttggatttactcaagaatgctgaaagcaatgctgaggtgaaaggtttggatgtggatgcactagttatttctcacattcaggttaaccaggctcagaagcaaaggcgccgcacttaccgtgctcatggacgaattaacccctacatgtcctctccgtgtcacattgagttgattctatccgaaaaggaggcacccgttcaaaaggagcccaacactcaggtggcaaccaggaaggcttgagagcttggttattactatttcttcaggcatttagttattggacaagcttttgaaagaaatgttgttttgtttgtcctttggttttgaaaccaaggtcttctgctattctcctaatgagtttgattctagaggtttttttgatttactgtatggattttgtgctttgaatgctgaattctggaatattcgtagtgaactcttatggtatgattgtttctctgttgcttt

SEQ ID NO: 1319 - DNA, 848 bp, Orobanche aegyptiaca
ggtctacaatcttccccactgcgccgccgtaacagcagctacaatggtgaagtactcgagagagcccgataaccccaccaaatcctgcaaggctaggggatctgatctcagagttcatttcaagaacactagggagacagcacacgccatcagaaaactgcctctagtcaaggcgaagaggtatttggaggatgtgcttgcccacaagcaagcaataccattcactcgtttctgtcgaggtgtcggaagaactgctcaggcaaagaacagacattccaacgggcagggtcgctggcccgttaagtctgccaagtttatcttggatttactcaaaaatgctgaaagcaatgccgaggtgaaaggtttggatgtggatgcactagttatttctcacattcaggttaaccaggctcagaagcaaaggcgccgcacttaccgtgctcatggacgaattaacccctacatgtcctctccgtgtcacattgagttgattctatccgaaaaggaggcgcctgttcaaaaggagcccaacactcaggtggcaaccaggaaggcttgagagcttggttattactatttcttcaggcatttagttattggacaagtttttgaaagaaatgttgttttgtttgtcctttggttttgaaaccaaggtcttctgttattctcctaatgagtttgattctagaggtttttttgatttactgtatggattttgtgctttgaatgctgaattctggaatattcttagtgaactcttacggtatgattgtttctctgttgctttatcagtttctatcttctttaacttttaatggaaaacatcaaaagatgggttttttatcctt

SEQ ID NO: 1320 - DNA, 892 bp, Triphysaria pusilla
aaaacctcgagtccatcatcttccccagtgcgccgactggaaaaaaatcagctacaatggtgaaatactcgagtgagcctcataacatcaccaaatcctgcaaggccaggggatccgatctcagagttcattttaagaacaccagagagacagcgcacgctcttaggaagatgcctttggtcaaggccaagagctacttggaggatgtgctggcccacaagcaagcaatccctttcacccgtttctgcagaggtgttggaagaactgcccaggcaaagaaccgacactcaaacgggcagggtcgctggcccgtcaaatctgccaagttcatcttggacttgctcaagaatgctgagagcaatgctgaggttaaaggtttggatgtggatgcactgtttatttctcacatccaggttaaccaggctcagaagcaaaggcgtcgcacgtaccgtgctcatggacgaattaacccctacatgtcctctccctgtcacattgagttgattctatcggagaaggaagagcctgtcaaaaaagagcccgaatctcagttggcgaggaaggcttgagctctggtggctattggatctcattagtagtttttttttgttgaacgagttttggaatgttgtcttatgttgccttttgtttcaaatcagacttgtgttattcacataatatgattggttttagaggatttttattattaattggagtttatcatatgtgtttttttgtttttgttttttatgttaaatgttagtatgcatgttgaaccttaaaaagaaaggatacatttgaattgtgtcgacaaaatgcaatgttattgcctaattttaagtctgactataatcatatcaaataactattccacaaaaaaaaaaaaaaaaaa

SEQ ID NO: 1321 - DNA, 834 bp, Triphysaria pusilla
gaaataccgcaattagtcacggagcagaaaatcaaaaccccgaggtctattatcttctccgccgctgcaaaacctgctacaatggtgaagtactcgagtgagcctcataacatcaccaaatcctgcaaggccaggggatccgatctcagggttcatttcaagaacactagagaaacagcgcacgctcttaggaaaatgcccttggtcaaggccaagagttacttggaggatgtgctggcccacaaacaggccatcccattcacccgtttctgcagaggtgttggaagaactgcccaagctaagaaccgacactcaaatgggcagggtcgctggcccgtcaagtctgccaagttcatcttggatttgctcaagaatgctgagagcaatgctgaggtgaaaggtttggatgtggatgcactgtttatttctcacattcaagttaaccaggctcaaaagcaaaggcgtcgcacataccgtgctcatgggcgaattaacccctacatgtcgtctccttgtcacattgagttgattctatccgagaaggaagagcctgtcaaaaaggagcccgaatcacagttggcagcaaggaaggcttgagctagtttgtttgatgaacaagttttggaatattttatcttgtgtttcacataatgattttggatttagaggattattattaattggagttatcttgtggattttatcttgttttggatgctaaatgttactatgcatgttgaacctttaaaaggtgcattattatcttttttatttactatgcaaaactcacaaatggtcaacttatatattattcattatttaacggataatttt

SEQ ID NO: 1322 - DNA, 851 bp, Sesamum indicum
tgcagctttgctgctcaaagtaaaaccctaacgccagagtattttctccactgcgcagcagaagcagcaacgacaatggtaaagtactcgagagagcctgacaatcccaccaaatcttgcaaggctaggggatccgatctcagagttcatttcaagaacaccagggagacagcacatgctattaggaagcttcccctaggcaaggccaagaggtatttagaggatgtgcttgttcacaagcaggccatacctttcacccgcttctgtggaggtgtaggccgaactgctcaggcaaaaaacaggcactcgaatggacagggacgctggcctgtgaagtctgctaaattcatcttggatctgcttaagaatgctgaaagtaatgctgaggtgaaaggcttggatgtggatgctctctacatttctcacattcaggttaaccaggcgcagaagcaaagacgccgaacataccgtgctcacggaagaataaacccatacatgtcatctccctgccatattgagttgattctatccgaaaaggaagagccagtcaagaaggagcctgaatcccaattggcaacaagcaaacccaggaaggcttgagctttgtaccgagtggtctatcatatagttgaacaagttttgagaaaactccaccgtttctgtcctttccttttggagatgaattttgctatttatttttctattttagaggattattggattgaccaaattttatgccatgttttgatgatattatttttctatgatctttaagtgttgctagaatttgcaaccgtgcttgcgtggatattgatgcactgtttgagattatgccttgggctgggttgggg

SEQ ID NO: 1323 - DNA, 714 bp, Antirrhinum majus
aaaaaccctagtccgatcaatttccgcagttcacccgccgccgaagatcgtcgcgatggtgaagtactcgagagagcctgataacatcactaaatcctgcaaagctaggggagccgatttgcgtgtacatttcaagaacactagagaaaccgcacacgccatcagaaagctccctctaatcaaggcgaagaggtacttggaggatgtgcttgcccacaagcaggccattccattcactcgcttctgtagaggtgtaggccgaactgcccaggcaaagaacaggcattccaatggtcagggaagatggcctgtcaagtctgccaagtttatcttggatttactaaaaaatgctgaaagcaatgctgaggtgaaagggttggatgtggatgccctctacatttctcacattcaggttaaccaggcccagaagcaaaggcgcaggacataccgtgctcatggaagaattaacccctacatgtcgtcaccctgtcacattgagttgattttgtcggagaaggaggagcctgtcaaaaaggagcccgagtcacagttggcagcaagcaaacctagaaaggcttgaaacttttacagaagtgcaagggccatatagttttgaaactgatgttgctctattttccttccttccaaaagacaatgacaaattcatttttgttaatttacttgacagttttattttagaggattattggattt

SEQ ID NO: 1324 - DNA, 824 bp, Primula obconica
cgcgagagagtaaatcgaagctccctcccactttctctctcatcctcgcagcagctatgcccaagtactcgagggaccccgataaccacaccaagtcctgcaaggccaggggttctgatctcagggttcacttcaagaacacccgcgagactgcacacgccctcagaaagatgcaactgaccaaggcaaagaggtatttggaggatgtgttggcacacaagcaggcaattcccttcactcgcttttgcaggggtgttgggcgtaccgctcaggcaaagaacagacattcaaatggacaaggtcgctggcctgcaaagtctgccaaatacattctagatttgctcaagaatgctgagagcaacgctgaggtcaaaggcttggatgtggacaccctttacatttctcacattcaagtgaaccaggcccaaaagcaaagacgtcgcacttatcgtgctcatgggcgaatcaacccctatatgtcttctccttgccacattgaattgatcttgtctgagaaggaggagcctgtaaaaaaggagccggagtctcaacttgcaactggcaaatccaggaaggcgtaaatccatcaagagttgtgctagatcggagcataagaagttttggactttgatctcttttgtttcttttttcttaatcttgttctggttcgtcgcttactttgtagaacatgggttttctgtggcgttattactggatgttggcaactttaaatattttaatttggataattatatggagaaaaatgatttccgtaaattacgtgattgatgggtgagaatgtaattgcaaattttgtttgttgc

SEQ ID NO: 1325 - DNA, 818 bp, Salvia sclarea
cgagtagcgccgcccgcatttgcagcagcgaccatggtgaagtactccagagaaccggacaatatcaccaaatcctgcaaggctaggggatccgatctcagagttcattttaagaacactagggagaccgcacatgctatcaggaagcttcctctgggcaaggccaagaggtatttggaggatgtgcttgcccacaagcaggccatacctttcacccgtttctgtggtggtgtaggccgaactgctcaggcaaagaacagacattccaatgggcaggggcgctggcccgtaaagtctgctaagttcatcttggatttgcttaagaatgctgagagcaatgctgaggtgaaaggcttggatgtggatactctcttcatttctcacattcaggttaaccaggcccagaaacagagacgccgcacctaccgtgctcatggaagaatcaacccttacatgtcctctccttgccacattgagttgatcctatctgaaaaggaggagcctgtcaaaaaggaggctgagtcacaattagcaaccagcaaacccaggaaggcttgagcttgtagtgaatgagtggatcatatagtttttcaagttttgggaaaactgtttaccccatttatttttgcagatgactctggttatttattttctatttttgaggattattggattttcatctaatgctatggttctaaaagcagtcgtctatacccttttacagatgcttgtttgttactagcgtgaccattgcccttggcaacatcgatttggttatgatcattaaatgatttgatcctcgtgccgaattcctgcag

SEQ ID NO: 1326 - DNA, 717 bp, Secale cereale
  misc_feature (105)..(105): n is a, c, g, or t
  misc_feature (109)..(110): n is a, c, g, or t
  misc_feature (140)..(140): n is a, c, g, or t
  misc_feature (500)..(500): n is a, c, g, or t
  misc_feature (504)..(504): n is a, c, g, or t
  misc_feature (521)..(521): n is a, c, g, or t
  misc_feature (535)..(535): n is a, c, g, or t
  misc_feature (607)..(607): n is a, c, g, or t
  misc_feature (615)..(615): n is a, c, g, or t
cgccgccgccgccttctctgccccgccgccgcagccatggtgaagtactcgacggatcccgccaatcccaccaagtccgccaaggccatgggccgggacctgcgngtcnnttcaagaacacgagggaaacagcgttttcnctgaggaagatgccactgaacaagccaagagtaccttgaggatgtgtggcacacaagcaagctatccccttccggaggtactgccgtggtgttgggcgtacggcccaggttaaaaaccgccagccaaatggtcagggacgctggcctgccaagtctgctaagttcgttctggatcttcttaagaatgcagagagcaatgctgaggtgaaaggtcttgatgttgatgctctatacatttcacacattcaagtgaaccaggcccagaagcagcggcgcaggacctaccgtgctcatgaacgcatcaacccctacatgtccaacccttgccacatcgagctgatcttgtcgaagaaggaaganccgntaaagaaggagaccaantcacagattaccangaaggcctagagaaggaagctctacataacctatccgcctattcgttagagcagtttgtagcatctggtttngctgagtngaaatttttggcctgttatctatcgtctaaatactgctagctcatactttgtgaaacccttgataatcatctcatgtactgaattcaatctaattatatttt

SEQ ID NO: 1327 - DNA, 831 bp, Allium cepa
agggtttcacacttataaagtcgatattattttctgctagcttgtttcctcatttcacaaaaggcggccagtctctgcaatcgtaaaaatggtgaagtattccagggaacccgacaacatcacgaaatccgcaaaggcgatgggtcgggatttgagggttcattttaagaacaccagggaaaccgctttctctattagaaagatgcctttggcaaaagctaaaaggtacttagaagatgttgttgctcacaagcaagctatcccatttagaaggtactgccgtggagttggccgtacagctcaagctaagaatcgtcattctaatggtcaaggtcgttggccaatgaaatctgcaaagttcattctcgacttgcttaagaatgctgagagcaatgcagaagtgaaaggtttagatgtggatgcactttacatctcccacattcaagtgaaccaagctcagaagcagaggcgaagaacttaccgtgctcacggacgaatcaatccttacatgtcatcgccctgtcacattgaacttattctctcggagaaagaagagcctgtgaagaaagagcctgaaactcagttggcgactaaatcaaagaaatcctcttaagagtggtggaattgtgctgtctttttgttccgagatattttggaccaaagtttaaatcttgttatcctagttaagtttccttttgtttcgttctattttgttccttttattttatcttgggccgctagttgtgtactcttatcttaaaagatggttggacaaaagcattcattcaaaaattcaaaaatttgacttatttacgtttagacccttttagt

SEQ ID NO: 1328 - DNA, 832 bp, Plantago ovata
cgaagccgctgaaccagagctgaaacgagaatggtgaagtactctagagaacccgataatgccaccaaatcttgcaaagctcagggatctggtttgagggttcatttcaagaacacaagagagaccgcacatgcaatcaggaagatgcctctaatcaaggccaagaggtacttggaggatgtgctcgcacacaagcaagctatccccttcactcgtttctgtagaggtgttggccgcacagctcaagcaaagaacagacactctaatggacaggggcgttggcctgtgaaatctgccaagtttgtcttggatttgctaaaaaatgcagaaagcaatgctgaggttaaaggcttggatgtagatgctctcttcatttctcacattcaagttaatcaggctcagaagcaaaggcgtcgcacttaccgtgctcatggaagaattaacccctacatgtcttctccctgccatatcgagctgattctctctgagaaagaagagccagtcaaaaaggagcccgacactcagatcgcaccaaacaaagtgaggaaggcttgagctacctcatttctagttgcttcaccagtttctgtactgagctgtctttttaccttttggaggctaagattttatcagtgactttttttatttgtgttactggattcttctctggaaattgtgttttacatgcatactgttcatgatatagttttggttttattccctcccttctgtttatgtccaatgtatttacaatgtgcacatatcctgatgaaaatggactgcctgtccgcaccattgttcctgcaaccaaacaaacatgaattaagctgca

SEQ ID NO: 1329 - DNA, 827 bp, Tamarix hispida
  misc_feature (15)..(15): n is a, c, g, or t
  misc_feature (17)..(18): n is a, c, g, or t
ggggggggggggatngnnagtagtaacgaagagttcgtcgaaccagctcctagcagcagcaacaatggtgaagtattcaagggaacctgataaccccaccaaatcttgcaaggctagaggctcagatcttagagttcatttcaagaacacaagagagactgcgtttgcacttaggaagatgcatttagccaaggctaaaaggtacttggaggacgttctagcccacaagcaagcaatcccatttcggcgcttctgccgaggagttggacgtactgcccaagcaaagaaccgccactcaaacggtcaaggacgttggcctcaaaaatctgcgaaatttattctggatttactcaagaacgctgaaagcaatgctgaaatgaagggtttggatgtcgattccctctatgtatcccatattcaggttaatcaagctcagaagcagaggcgtcgcacataccgtgctcatggtagaatcaacccctacatgtcgcatccatgccacattgaattgatattgtctgagaaggaagagcctgttaagaaagagcctgagagccagctcgccactagcaaatcagagaagccttaagtgttgtccaaattgaagcaaatcaaagaagcctaagtgttgtccaaattgaaattttgtttagtttgaggggttggatattagttttatgatcattgaaatttcgttagcaatttcaacttgtcttcacgaattatgaactgtagcgtcgaagaggctgtttcttgttttccttttgtctcacaagcggagaaatggtgctcctgtggagatttctggatgctgtatactggtgaac

SEQ ID NO: 1330 - DNA, 855 bp, Trigonella foenum-graecum
cggccggggggctatataaacacaggcataccttctagctctgaaccctgcatcgtttatttgcaggttgcatcacaccacacgccgtcgccatggttaagtactcaagagagcctgataaccctaccaagtccaccaaggctaggggtgctgatctgagagttcatttcaagaacactagggaaactgcctttgccatcaggaagttgccattgatcaaggctaaaaggtatttggaagacgttcttgcacacaaacaggccattccattcagacgtttttgtcgtggtgttgggaggacagcccaagccaagaatagacattctaatgggcaaggaaggtggcctgtcaagtcagccaagtttattttggatttgctaaagaatgcagagagtaatgccgaagtgaaaggcttggatgtggatgctctatatgtgtctcatatccaagtcaatcaggcgcagaagcagcgccgcagaacatacagagcccatggaagaatcaacccttacatgtcatctccttgccacattgagttgatattgtctgaaaaggaagaggctgtcaagaaggagcccgagacccaattggcaacaaacaagaagaaagcttaagctctttgtagtgtcgcttgtcttaaactcttagattacgtcaagagaacagttttgttgcaatgtttatttttcttccattatttctgagatatttgttggaaagactttaaacgctgttttgttttatactctcttgaattagcgtctatttggaaactttatgttttttatctctgaccgaataccatttgcagtgactgtctggatattcaacaattttatttccctacagttcaaa

SEQ ID NO: 1331 - DNA, 737 bp, Artemisia annua
catcaacaccagcagcagcagaaatggtgaagtactcaaaggagcctgataatcccaccaagtcctgcaaggctaggggttctgatctccgatgtcacttcaagaacaccagagaaaccgcacatgctctcaggaagatgcctttgatcaaggctaagaggtatttggaagatgtcttggtccacaagcaggctattccatttacccgtttctgcagaggtgttgggcgtactgctcaggctaagaacagacactccaatggtcaaggtcgatggcccgccaagtcagccaagttcattttggatttgcttaagaatgctgaaagcaatgctgaggtgaaaggtttggatgttgatgctcttgtcatttctcacattcaagtgaaccaagctcagaagcagagacgtagaacttaccgtgctcatgggcgaatcaacccttacatgtcatctccctgccacattgagttgactttgtctgaaaaggaggaacccgtgaaaaaggaggctgaatcccagttggctaagtccaagtaaacgtaggttgccggaagctagtagtggtactaaatcagttttgaactctttgtaggctgattgagccatttatgcttttgaagacaagttttgttctacatattttgacgtgtaaaaggatattagattttgtgatgtgctgttttgatcatcatgcgggttatttataatggcaaatggatttggctaaactacagtgct

SEQ ID NO: 1332 - DNA, 837 bp, Artemisia annua
ctcgcgtgtcagtactccgacggggaggggcggcctctgaagaacacacacacacacgcaaaaacaccatctgtatctgcaacaatggtgaaatactcaaaggaaccagaaaacccaaccaaatcttgcaaggcaagaggatctgatctcaggtgtcatttcaagaacacccgtgaaaccgcccatgctctccgtaagatgcctttgattaaggctaaaaggtacttggaagatgttttggctcacaaacaagccatcccattcacccgtttctgtcgtggagttggacgtaccgcacaagcaaagaaccgtcattccaatgggcaaggacgttggcctgctaagtctgccaagtttatcttggatttgctaaagaatgctgagagtaacgcagaagttaaggggttggatgtggatgctcttcacatctctcacatccaggtgaaccaagcacagaaacagagacgtcgtacataccgtgctcatggaagaatcaatccttacatgtcatctccctgtcacattgaactcacattgtctgagaaagaagagcctgttaagaaggagcctgagagtcagttggcctcaagaaccaagtagaaccgagctttaattcaaggggacatcttcatgaatgggatttatagtttgttggtagaaggaaatctgtttttgttttcattttgttatctcaaaaccatctgtttccattttcaaatatttttatcttgtgtttgattatgaggtgatcttgctttatgaatctaaatactaatcgaaacttgtttcatccagtgttgaaatgctcgattctgatatggttaacatcttttgctg

SEQ ID NO: 1333 - DNA, 717 bp, Cichorium intybus
acacaatactgcggcatctgcaccggcgaacgagctgctgccatggtgaagtactcaaaggaaccggaaaaccctaccaaatctcgcaaagcaaggggatcagatctcaggtgccattttaagaacactagagaaactgcacatgccatccgcaagttacctttgatcaaggctaaaagatacctggaggatgttcttgtccacaaacaagctatcccgttcacacgtttctgtcgtggagttggccgtactgcacaggcaaagaatcgccattcaaatggacagggacgatggcctgctaaatctgcaaaattcattctggacttgcttaagaacgctgagagcaatgcagaagttaaggggttggatgtagatgcccttcacatctcccacattcaggtgaaccaagcccagaaacagagacgtaggacatatcgtgctcatggaagaatcaacccttacatgtcttctccgtgtcacattgagttgactttgtctgaaaaggaagagcctgttaagaaagaggctgagacccaattggctccaaggaagaccaagtagggtgcagcgtagctgatgattggtatgctaagaaagagctttattttggcttaattgccacccggaaaacatgtattttctattttggaaggtttttatccagtgtccaattatgagattctccatttcttatgaaattatagctaaatttgatta

SEQ ID NO: 1334 - DNA, 787 bp, Taraxacum officinale
tttgaagctcatataattcagcggcatttgcaccggcgaaccagctgctaccatggtgaagtattcaaaggaaccggacaaccctaccaaatcttgcaaagcaagaggatcagatctcaggtgtcattttaagaacactagagaaactgcacatgctcttcgcaaaatgtctttgatcaaggctaaaagctacttggaggatgttcttgttcacaaacaagctattccattcacacgtttctgtcgtggagttggccggactgcacaggcaaaaaaccgccattcaaatggacagggacgctggcctgctaaatcagcaaagtttattctggatttgctcaaaaacgctgagagtaacgcagaagtgaaagggttggatgtggatgcccttcacatctcccacattcaggtgaaccaagcacagaaacagagacgtagaacatatcgtgctcatggaagaatcaacccttacatgtcgtctccatgtcacattgagttgactttatcggaaaaggaagagcctgttaagaaagaggctgagactcaattggccccaaggaagaccaaatagatgatggtgtattgatttaattttataagttctaggttgattttgatctgctagaaaagcttagttttcactcaggaaacatatatttcttttttggaagagttttatccggtgttcaattatcagatattcggtttcttataatataagctaaatgcgatttcttattatcatgttaaaattttctaatattacatatatttattttggacaaaa

SEQ ID NO: 1335 - DNA, 1256 bp, Amborella trichopoda
accctctcttagcaattagccgctcagcaaaacagcagctccactgcgaaagttctctcgctttctcttcccagtaaaggcagcctctcgcccagtactattcgcgcccttgcaacctcaacaggaacttcgtgaggaacttccaatttacagttcatgaacttgcttccagttatcaaacaggcccttagggtttcctacttttgtcgttgcgattagagagagagaatattagggtttttggattcacaaaaattcacagctttgaggcgctcatacacttcggcctcttggagcagtcagagaccttcatttccatcagcagccatggtgaagtattccagggagccggacaatccaactaaatcttgcaaggccagaggatctgacctgagggttcacttcaagaacaccagggaaaccgcatttgctctcaggaagctcccattggccaaggctaagaggtatttggaggatgttcttgcccacaagcaggccatccctttccggcgcttttgtggaggtgttgggcgcactgctcaagcaaagaaccgccatccaaatggacaagggcggtggcctgtcaagtctgccaagttcatcttgaacttgctcaagagtgctgagagcaatgctgatgtgaagggcttggatgtggatacactattcatttcgcatatccaggtgaatcaggcccagaagcagaggcggcgaacttaccgtgcccatggaagaatcaacccttacatgtcctccccctgtcatattgagttgatattgtccgaaaaggaggcacctgtcaagaaagaggctgaaacccaagtggtgcccaagaggacgaagaaatctcaagctcttcatagtggggcttcatcttaaagctttgcagagtacggagattggtatcgcgtcaactttaagatttactcagagagattgacatcgtttttccttctatttgaatgctcatgcttttgcaacatttcgtcaagaattttgtggttgtacaaggactaagaatctgtcacgcaatttggggagacatcttttctggcttgacttggccagtttgagccttagatcatatttgggtcattgtttgtcttccttcgtgaacacccatgtccttacatcgcaggcattagttactacgaaagtgttttagaacttttgttagtaatgtgattttttcataatctactctttacccaatgttggcgactgcgctttggctgaagagaggccgaaatcttggg

SEQ ID NO: 1336 - DNA, 1429 bp, Gossypium raimondii
gtaaaagcttcaaaacctaggtcttgaactgggcactcgtaaactcgaaccctataaagaaagcacttaaaaaccctagaatcagattcatatatattcttataccttccctcttcttttacttcctcttttaggcggcagaagcagcttaggcaaccagttcgcagccatggtgaagtattcgaaggagtcagataatcccaccaagtcctgcaaggcaaggggctctgatctcagggttcatttcaagaacacaagggagactgcgtttgctatcaggaagttgcctttgggtaaggctaagaggtatttggaggatgttatggctcacaaacaggccatacccttcagacgcttctgtggtggtgttggacgtacagctcaggcaaagaacaggcattctaacggacaaggtcgctggcctgtaaaatctgccaaattcattctagatttgctgaagaatgctgagagcaatgccgaggtcaagggtttggatgtggatgcactctatatttctcacatccaagttaaccaggctcagaaacaaaggcgtcgtacataccgtgcccatggaagaatcaatccttacatgtcttctccttgccacatcgagttaattttgtcggagaaggaagagcccgttaagaaagagcctgagactcagttggcagctagcaagtcgaagaagtcccaagtatctgtgtagacggtcagcaaaagattgaaattttagtcgatgaaggaagttgtatctgggaaatgatttctgtcttactctgcgagtaagtagttttgatgtttattcaaagtagaaagagttgttagatgtcttttgaaaccttgtttagtcaaatgttattgatctgagattcatgttggagatttttgttttaatccatgattttatatgaagttattttgttgaggaaaataatgagtgttcattgccataaaccataattagttgagcaaaaggtggttgcttacttttctcaagatttagccatggatttcctaaagttagacaagtttttgttggcaatgagtctaagatcagcttggaaaagattgtttgctgttaattttgggactcttttactggctatttgttccccccccccccccaaaaaaaaaaacgtaaaatgtaaaaaagaagatttagaatttatgaataaaagaaatttataatcttctccctgaaaggaaagcctaaatttgacatgtaatgtatatttactatagtttagtcgacaattagatttgctcatttaagtttgattcgcgagatagactcttcttaaataaaatattgaggtttgcactagttttatgaaaattggtcatttaacaaattaattttcttggttgtggtatgattttgcttttacaccacaaattcaaggaaagaaaatggaaggttaaattttga

SEQ ID NO: 1337 - DNA, 815 bp, Musa acuminata
gctaaacggagtggggtgcagtggagagccgaacgccatggtgaagtattcgagagagcccaccaacccgaccaagtcctccaaggccatgggccgggatttgagggttcacttcaagaatactcgcgagacagctcatgcaattagaaagctacctttagctaaggctaaaaggtaccttgaagatgtaattgctcataagcaagccattccattccgaaggttttgtgggggtgtaggacgtacagctcaagccaagggtcgtcatccaaatgggcaaggacgctggcctatgaaatcagccagattcattttggatttgctcaagaatgctgagagtaatgcagaggtgaaaggtttggatgttgatgctctctacatctcacacatccaggtgaaccaagctcagaggcagcggcgtaggacttaccgtgctcatggacgaattaacccttatatgtcctctccatgtcatattgaattgattttatcggagaaggaagagccagtcaagaaagagccggagacccagattgcaccaagcaagcccaagaaatctcaagctattcgaagtggtgcgtcttcttaaagatcagtggttacagctttgaggaaagcattgatcttgggctgatttgaaatagatgcagctatcttatttttggtaacaaaagatattctggagatactagtgcttctggaacattatctttttctacctttgtttttgattgggaaatttgtgggattccatagctactttgaaatggaagcaatgtgacaccttaatcgttgagtatttgatctgttttccc

SEQ ID NO: 1338 - DNA, 786 bp, Musa acuminata
tcgacccacgcgtccgcttcgctccctcgctcctcctgcagagtgtgcaagtcggagatcgcgacgactcttctgcagccatggtgaagtactcgagagagccttccaatcctaccaagtccgccaaagccatgggtcgggacatgagggttcacttcaagaatacccgtgagacagctcatgccattagaaagctgcctttgtcaaaggccaaaagataccttgaagatgtaattgctcacaagcaggctattcccttccgaaggttttgtggtggtgtaggacgcacagctcaagcgaagggccggcacccaaatgggcagggccggtggcctctgaaatcagccagattcatattggatctgctcaagaatgctgaaagcaacgctgaagtgaaaggtttggatgttgatgcactcttcatatcacacatccaagtgaaccaagcgcaaaggcagaggcgcaggacttaccgtgctcatgggcgaatcaacccttatatgtcctccccctgtcatattgaactgattttgtcagaaaaggaagagcccgttaagaaagagccggagacccagattgctcccagtaagcccaagaaagctcaagcaattagaagtggggcttcttcttaggcggcagcagtagttgcatttttcaagaagatatccacccgtttctaattagcaggtttcattgtggtatcaaacatatcttcatgagctctatgcactttataaactctattacagttgctttatttaatggagttctgaaggatttgatgga

SEQ ID NO: 1339 - DNA, 769 bp, Fagus grandifolia
aagaaaactctaacgcccctctctttgcttctcttttgttagagcaaacgaaaccaaaccaacgagcttcttcactcaggcagatcagccaccatggtgaagtactccagagagcctgacaatcccaccaagtcctgcaaggccagggggtccgaccttagggttcatttcaagaacactagagagacagcgtttgccatcagaaagttgccattgctcaaggctaagaggtacttggaggatgttctggcccacaaacaggccatcccctttcgacgcttctgtcgtggtgttggacggactgctcaggcaaagagcaggcactctaatggacaaggtcgctggcctgttaaatctgctaagttcatcctagatttgctcaagaatgccgagagtaatgctgaagtgaaaggtttagatgtcgattcactctacatatctcacgtccaggtgaaccaagcacagaagcaacggcgtcgtacctaccgtgctcatggaagaatcaacccctatatgtcatctccttgccacattgagctgactttgtccgagaaagaagaacctgtgaagaaagagcctgagactcagttggcaactagcaaatctaagaagtctcaagctctacgtagtggtgcttcctcttgagtggctattgtagaacactaacaattgaatggctgtcccaaatttcttgcttctaccctttttgcctatcaatgggagttttgttgcttgtcatatagaatgagctgctatttagatgctttgg

SEQ ID NO: 1340 - DNA, 684 bp, Vaccinium corymbosum
ggaagcattccattcacttccctcgtcgatagttcgacgcagcagcaatggtgaagtactcgagagagccagacaatcccactaagtcctgcaaagccaggggctccgatctcagagttcatttcaagaacacgagggagactgcccatgccatcaggaagctgcctttgaccaaggctaagaggtatttagaagatgttctggctcacaagtaggccatacccttcacccgcttttgccgtggtgtaggacgaactgctcaggctaagaacaggcattccaatggacaagggcgttggcctgtcaaatctgcaaaatttgtacttgacttgctaaagaatgctgagagtaatgctgaggttaaaggtttggatgtggattcactttacatatctcacattcaagtaaaccaggcacagaagcagagacgtcgcacataccgtgcccatggaagaataaacccatacatgtcctccccttgccatattgagttgactttgtctgagaaggaagagcctgtcaaaaaggagcctgaatctcagttggcaactggcaaatccagaaagtctcaatctctaagaagtggtgcatcctcttgaatggctttgatatatcttgctgttccagaagttttggggtctccgctcttcttctttaagttctttggaagacgtttattccttt

SEQ ID NO: 1341 - DNA, 789 bp, Theobroma cacao
atatgctagaaagtagaaaccctaacacgctctttttctcttttgtaaggaagtgcacccctcagcagcagaagcagcagccatggtgaagtactcgagagagccagacaacccgaccaagtcctgcaaagccaggggctctgacctccgtgttcattttaagaatactagggaaacagcctttgcaatccgaaagttgcctttgataaaggctaaaaggtacttggaggatgttatggcccacaagcaagccattccattccggcgcttctgtggtggagttgggcgaaccgcgcaggctaaaaatcgccattctaacggtcaaggtcgctggcctgtgaaatctgcaaaattcattcttgatttgctcaagaatgccgagagcaacgcagaggtgaaaggcttggatgtagattcacttttcatatctcacatccaagtgaatcaagcacagaagcaaaggcgccgaacatatcgtgcacatggaagaattaacccttacatgtcttctccatgtcacattgaactgattttgtcagagaaacaggaatctgtcaagaaagagcctgagactcagttggctcctaggaaatcaaagggtcaatctctacggagcggtgcttcctcttaaactgctgagtgatggatcatattcagaaactattgtctttttctttcattatgtctgtaacgagaacatttttgtttcctttactaaggtgcttaagactcaagtttgtctctggagatactttgtttttatttaaatcttatgttataagcattctg

SEQ ID NO: 1342 - DNA, 992 bp, Castanea mollissima
ttaacgcctcttctttctttctcttcttctacaagagctaacctatctaagcaattccaagttcactcagaggcgcacagatcagccgccatggtgaaatactccagagaacccgacaatcccaccaaatcctgcaaggccaggggttcagaccttagggttcatttcaagaacactagagagacagcgtttgccatcaggaagttgccattggtcaaggccaagaggtatttggaagatgttctggcccacaaacaggccatcccctttagacgcttctgtcgtggtgttggacgtactgctcaggcaaagaacaggcactctaatggacaaggacgctggcctgttaagtctgctaaattcatcctagatttgctcaagaatgcagagagtaatgctgaagtgaagggtttggatgtagattcactcttcatctctcacatccaggtgaaccaagcacagaagcaacggcgtcgtacctaccgtgctcatggaagaatcaacccctacatgtcgtctccttgccacattgagctggttttgtccgagaaggaagaacctgtgaagaaagagcccgagtcccagttgacaactagcaaatcaaagaagtctcatgctttacggagcggtgcttcctcttgagtggttgttttagaactgacaattgaatggccgtctcgagtttcttgctgctgcccttttgcctgtcaatggggagttttgttgcttgtcgtatagaatgagctgttatttagattattggacggcttgtttttttcaaactatatctagtcttaagtgaaatttttcttgaagattttgtgattggaagcctaagaatgcaggagtttatatacattgttatttttattagatgcattttatccatggccgtctttgcaatttttggttgtttagtggtcaaatttcgttaatttgttgtacttatctttatttgccctatgtgttttaccacagctggctcatttcat

SEQ ID NO: 1343 - DNA, 895 bp, Castanea mollissima
cacaacgctctctttgccccagaaagctcagtgatcagtgaccctcccaatctaccttgaaccaacaacaatggtgaagtattcaaaggagcctgataatcccactaagtcctgcaaggccaggggctcggatctgagagttcatttcaagaacacaagagagacggcccatgctattagaaagttgcctttagcaaaggctaaaaggtatctggaagatgttctggtccacaaacaagccattccctttcgacgcttttgtcgtggtgttggtcgaactgctcaggcaaagaaccgtcattcaaatggtcaaggacgctggccttttaaatcggctaaatttattcttgacttacttaagaatgctgagagcaatgcagaagtgaaaggtctggatgtggattctctgcacatatctcacatccaggtgaaccaagcccagaaacagaggcgccggacctaccgtgctcatgggagaatcaatccctatatgtcatctccctgccatattgagttgaccttgtctgaaaaggaagagccagtcaagaaggagcctgaaacacagttggctcctaggaaaaacaggaagtctcaagctttacacagcggtgcttcttcttgaatgtggtggctacagggaattctagttattcatttctgtactgtccactccttttaagtagaatctatccttctaagataatatatcatttaaaattgagaaccgtctctgatttactgtctttttcatcaaattttcttttttgagtacttgtatggaacttgagtcatggatttttttttattttagttttgatgtggatgttggagtaacattaacattgatgatgccttaaaattttctttggaatgagtaacattataattatgataa

SEQ ID NO: 1344 - DNA, 662 bp, Cucumis sativus
ttctgctcgcaggagggtctcaagttttgtagagaactagcatccgccgccatggttaagtactcaagggagccggataaccccaccaagtcctgcaaagcgcgaggatctgacctcagagtccattttaagaatacacgtgagactgctcatgccctcagaaagttgcctttggccaaggcaaaaagatacttagaggatgttcttgcccacaagcaggctataccatttcgacgtttttgtggaggtgttggacgaactgctcaggccaaaaataggcattcaaatggacaaggacgctggcctgttaaatctgcgaaatttattttagatcttcttaagaatgctgagagtaatgccgaagttaaaggactggatgttgattctctcatcgtatcccacattcaagtgaaccaagctcaaaagcaaagacgtcgcacataccgtgcccacggaagaattaacccctacatgtcatctccatgccacatcgagcttattttgtcagaaaaggaagaacctgttaagaaagagcctgagacccaattggcaacgagtaaatccaagaaatctcaagccctccgcagtggtgcttcatcttgatcaatattattgctgcattaagtgttcttttttttttttgatcattatagaatgagttt

SEQ ID NO: 1345 - DNA, 960 bp, Eucalyptus grandis
gcgccgtctcgctatccctttcttctggctcatttcaagcgagtaaaaaccctagcgacagcagcagcagcagcagccgccatggtgaagtactcgagagagccggacaatcccaccaagtcctgcaaggcgaggggctccgacctccgcgttcatttcaagaataccagagaaacagcttttgccattaggaagttgcctttggttaaggccaagaggtacttggaagatgtgctcgcgcataagcaagccatacccttcaggcggttctgtcgtggtgttggtcgaactgctcaggccaagaacaggcattcaaatggtcaaggacgctggcccgtaaagtcagctcgattcatactggatttgttgaagaatgctgagagtaatgctgaggtcaagggattggatgtggacgcactcttcgtctctcacgttcaggtaaaccaggctcagaagcaaagacgtcgtacctaccgtgctcacggaagaatcaatccttatatgtcatctccctgccatattgagttgattttgtctgagaaggaagaacctgtgaagaaggagccggagactcagttggccaccagcaagtccaagaggtcacaggctatgaggagttctgcatgaggctaacgccaaatgaaccaggacacacccaacagagactcatgtttttctcaggcctttttttggagagttgcttcagttttccccatagaatgtactctggatttttggaacaatgtgattttttccgtcagttgctatgtcccgacttttatctgcagtattgaggatagtgtattaaattttaatttcctccatctttctctcttcactcgacttaagcaccgtactctaagttgtaattgaaaaaaagagatcgattttttagtatcattctaaaaggaattatgcctcgtatacaaactttgattggccactctgaggtaggattcc

SEQ ID NO: 1346 - DNA, 1054 bp, Eucalyptus grandis
ataatcgcaaaaaccctagctcggacttcctcagcaggcccccggagcggaggatcgagtacagagcatcgggcaacaatggtgaagtactcgaaagagccggacaaccccaccaagtcttgcaaggcaaggggctccgatctccgggtccatttcaagaatactcgagagacggcccatgctattaggaaattgcccttgacaaaggctaaaagttatttggaggatgttttggctcacaagcaagccattccgttccggcgcttctgtaggggtgttggacggactgcacaggccaaaaaccgtcattctaatggccaggggcgctggcctgtcaaatctgcgaagttcattttggatttgctcaagaacgctgagagtaacgccgaagtgaaaggtttggatgtggatactctatacgtatctcacatacaggttaatcaagctcaaaagcaaaggcgtcggacataccgagctcatgggagaattaatccttatatgtcatctccatgccacattgagctgattttgtctgaaaaggaagaacctgtcatgaaagagcctgagacccagcttgctcctaggaaatcaaagagcgctctgcgtagtggggcttcttcttgaaagttggtgcattagggtggttcagatttgattagccaaatttcatcctcgggattttgttctctctttgttgagtgagaatgtgcgatttggagtatttactattttagttttgtttcttggcatcctggccggcatcttccagcaaactcaggtcatgatcaactgaggaattttttggttttctcgtaagttgaaatttgattttcagttgcatttggatgagtgcttcttatgcaaaagcattcgaagtttgtgcctcttcgttctttttgcaaattgctccttacaattggaattgggggttttcacttgcttagctgctttagaagatgcgtgccaatcttagacactgcatgcacgaagattggtgccggttgtttagccgtagatttggcaaaattcaattggctgagatattcttttttgg

SEQ ID NO: 1347 - DNA, 978 bp, Actinidia deliciosa
  misc_feature (819)..(819): n is a, c, g, or t
  misc_feature (849)..(849): n is a, c, g, or t
  misc_feature (866)..(866): n is a, c, g, or t
ctttcttctgcgaaacaaagcactgaagagagcaagcatggtgaagtactcaagagagccagacaaccccaccaagtcctgcaaagccaggggctcagatctcagagttcattttaagaacacgcgggagacagcccatgccatcaggaagatgccgttgactaaggctaagaggtatttagaagatgtgctggctcacaagcaggccatacccttcacgcgattttgtagaggtataggacgcactgctcaggcaaagaacaggcattcaaacggacaaggacgttggcctgtcaaatctgtgggattcatacttgatttactaaaaaatgctgagagtaatgctgaggtgaagggcttggatgtagatacactttacatatctcacattcaggtgaaccaggcacagaagcagagacgccgcacgtaccgtgctcatggaagaataaacccctacatgtcttccccatgccatatcgagttgatcttgtccgagaaggaagagccggtcaaaaaggagtccgagtctcagttggctaccagcaaatctagaaagtctcaagctctgcgaagtggtgcatcctcttgaatggcttcgatatgacaagtagtttaagaaactttccgagtattttctgtgttctctccctttcggacaacaccgttcatcttttgtcattactcatctttgaattacgacgacatactattcagtaaaagtgctctttttggtgactttgacgacaacctagttgagttgattattaaacttgttgcttgtaagttgcaagaaaattaagatgtttcagttatgctgcnttagtgatgggattttactgatggtgatgnatatggtatattgttgntgcgtgtaacaagtaaacgcatttaaacatggcaaatgcgtgttggaaataagaagcaacagaggaagatattttaatcttggattcagttcatgtgtaaatgatttatttg

SEQ ID NO: 1348 - DNA, 877 bp, Actinidia deliciosa
  misc_feature (93)..(93): n is a, c, g, or t
aatcactccgcactcttatcggcgcaggagcagcagcagcagccatggtcaagtactcaagagagccagacaatcccaccaagtcctgcaaanccaggggctccgatctcagggttcattttaagaacacaagggagacagctcatgccatcaggaagctgcctttgacgaaggctaagaggtatttagaagatgttctggctcacaaacaggccatacccttcacgcgtttttgtaggggtgtaggacgaactgctcaggctaagaacaggcattctaatggacaagggcgttggcctgtcaaatctgctacattcatacttgacttgcttaaaaatgctgagagtaatgctgaggtgaaaggtttggatgtggataccctgtacatatctcacattcaggtgaaccaggcacaaaagcagagacgccgcacataccgtgctcatggaagaataaacccctacatgtcttccccgtgccatattgagttgatcttatctgagaaagaagagcctgtcaaaaaggagcctgagtctcaattggcaactagcaaatcaagaaagtctcaagctctgcgaagtggtgcatcctcttaaacaagggctttcaaagaaccagcagttttaaaaagttttggacttttctctctactctcccagtcctatggaagagattgtattcctttttttttatttttgatcttttatttgagaagggtatgtatggcttgttttgttacaactaaatgctatttagttaaaatgctttaattgtaggcaagtttttggcaaaatatagttgatttctttatgaaatgtgtcacggtgatggatgcaatggaaaactttattgcaaatatttcagtaaaaaaaaaaaa

SEQ ID NO: 1349 - DNA, 736 bp, Liriodendron tulipifera
  misc_feature (630)..(630): n is a, c, g, or t
  misc_feature (671)..(671): n is a, c, g, or t
  misc_feature (679)..(679): n is a, c, g, or t
agaaagagagagatggtgaagtactcgagagaaccggataatcccacgaagtcctgcaaagccagggggtcggatcttagggttcacttcaagaacaccagagaaacagcccatgcaatcagaaagttgcatttggccaaggccaaaaggtatcttgaagacgtcattgctcacaaacaagccattccttttcgccgattctgtcgtggtgttggtcgaactgctcaggcgaagaacaggcattcaaatggacaaggtcgttggccggcaaaatctgctcggttcattctggacttgcttaagaatgcagagagcaacgccgatgtgaaaggtttggatgtagacacgctgtttgtatctcatatccaggtaaatcaagcccagaagcagaggcgccgcacataccgtgcccatggaagaatcaacccctatatgtcatcaccttgccatattgagttgattctgtccgagaaggaagagcctgtcaagaaggagcctgagacgcagttggctcctcggaaaaccaagaaaggacaagcactccacagtggcacctcatcctgagcggcactagttgtagaaggaaacagtattttttttagaaagtctctccccctttttatctgaagnttattcatattttgcttgagatctttatccatgggacatanttgaattntttatctggggtgcatgttggaccccattaaaccagctccagtacattttcacatgc

SEQ ID NO: 1350 - DNA, 845 bp, Lotus japonicus
tttctgcgtaacctgaagccgtcgtcatggtgaagtactcacaagagcctgataatcccaccaagtcttgcaaggccagaggctctgaccttagagttcatttcaagaacactagggaaacagcgcatgccatccgcaggttgcctttggcaaaggccaaaaggtatttagaggatgtgcttgctcacaaacaggccattccattcagacgtttctgtcgtggtgttgggaggacagcccaagccaagaacaggcactccaatggacaaggacgctggcctgccaagtcagctaaattcatcctagacttgcttaagaatgccgagagcaatgctgaagtcaaaggtttggatgttgatgctctttacatcactcatgtccaagtcaatcaggcacagaagcaaaggcgcagaacataccgagcccacgggagaatcaacccttacatgtcatctccttgccacatagaattgatttgtctgaaaaggaagagcctgtcaagaaggagcctgagacgcagcttgcagcaagcaagaagtcctaagcgtgcttcatctattagctaaattgttgaggcccttatcgtgtcaagaggacaattttgttggttgttttactttttctgtcatttgttgagctattcctagaaaaatctttaacgctatgttttgtctcatactgtgtttaaatactttgaattaattgggaaacctcttagtttttttatggcttttttatggcttgacgtggatatttaaattagccatggccgactagatatttgattcctaatgattttattcatttgaacgtacatgttaatcggatttatggcaaatatttta

SEQ ID NO: 1351 - DNA, 1138 bp, Pinus pinaster
attgtccggctgttcgtagtagtttacccttttaccactgttgtttcattttaggacggcccgaggcgaggcgaggagaggagaggtgagagaagcagaggttggtgaggccgcagccatggtgaaatactcgagggagcccggcaatcccaccaaatctgcgaaggcgagagggtctgatttacgtgttcattttaagaatacaagagaaactgcacaggcagttaagaagctacctctaggtaaggctaagaggtatctggaggatgtaattgcccacaaacaagcaataccctttcgccgcttttgtggaggtgtgggcagaactgcccaagcgaagtctcgaaattctaatggacagggtcgctggcctgtcaagtcagctgaatttttgttaggtttacttaaaaatgcagagagcaatgccgaggtaaaggggcttgatgttgatacactttatatttctcacattcaagtgaaccaggctcagaagcagcgaagacgaacataccgtgcccatggaagaatcaatccttatatgtcatcaccatgtcacattgagctgatattgtctgaaaaggaagcacccgtcaaaaaagaggttgaaactcaaattgctccaaggaaaccaaggaaagcacaaacacttcgaagtggtgcctcatcttgagatgctgaggcagtttgaatttgagcacaccaatgacatatatttaacagaaaccttatgtcgtttatttttttgagtgactggaggaaactacacccgtttttgttaactggcatagtatgaattgtagacaaacattttcctattgaaaacttttattcatgttattgttgctttgtgtgatttactggctgctgttaatgtgcgactcggcctggtaagcatacaaaagtgaaggaaagctttgcttctattgttttacatggcataagactctggatggtttatgtgatcctcaaggcgacgaaaattaaaagacttattttcatgcataccatgaggacttttctgcaaggctgtctggggaatgaaggttcgggttcagttgacaggccaccagatgggaggtgtcgacgttcgacttttgttagatagttcattatgatgtatttcttgagattttggttt

SEQ ID NO: 1352 - DNA, 1129 bp, Cucumis melo
ctcgcaggagggtctcaagttttgtagagaattagcatccgccgccatggttaagtattcaagggagccggataaccccaccaagtcctgcaaagcgcgaggatccgacctcagagtccattttaagaatacacgtgagactgctcatgccctaagaaagttgcccttggccaaagcaaagagatacttagaggacgttcttgcccacaagcaggctataccattccgacgtttttgtggaggtgttggacgaactgctcaggccaaaaataggcattcaaatggacaaggacgctggcctgttaaatctgcgaaatttattctagatcttcttaagaatgctgagagtaatgccgaagtgaaaggactggatgttgattccctcatcgtatcccacattcaggtgaaccaagctcaaaagcaaaggcgtcgtacataccgtgctcacggaagaattaacccctacatgtcgtctccatgccacatcgagcttattttgtcagaaaaggaagaacctgtcaagaaagagcctgagacccaattggcaacgagtaaatccaagaaatcgcaagccctccgcagtggtgcttcgtcttgatctatattattgctgcactaagtgttctttttttccttttaaaaaaacagaggttcgtttctttgatcattatagaatcctgctcagaatccattgcccccaactttgtagtttacgaaatctcgtcgatcatgttttatttattaggaatcatctcccaaattttggatttccgtttcttttaagcagagtttatacatcgagactttctttcactctcccctctgttggttcacgtttgctttaggtaattgttgttcaaaacgtgatgatgattttattgtcataatttcttttgtatttgaaagagtactgtcatcattttcaacagttcatagtagaattgtaaatttagtttggttcggtttctgctttaattgggccaaaggtaatttgcagatataaaatgagtagaccatttatgaacgttcacgattttttttcgagtacgagggttgtgggctgtgtcaaacatacatttgcaacttccaatattactaagctagctagactcattttaacaaaaaaaaa

SEQ ID NO: 1353 - DNA, 846 bp, Nuphar advena
gagacggcgtcgctcgatctgcaacgaaaatggtgaagtattcgagggaacccgataaccctaccaaatcatgcaaggcaaggggatcggatcttcgggttcacttcaagaatacccgtgagacagcctttgcgataaggaagctgccattggccaaggccaagaggtacctcgaggatgttattgcccataaacaagctattccattcaggcgtttttgcggtggtgttgggcgaaccgctcaagcaaaggttcgccattccaatgggcaagggcgttggcccttaaaatctgccaagtttatcttgaacttgctgaaaagtgctgagagcaatgcagatgtgaaaggtttggatgttgatacactatatatatctcatatccaagttaaccaggcccaaaagcagagaagacgtacttatcgtgcgcacggacgaataaacccttacatgtcctcaccttgtcatattgagttgattttgtcagagaaagaggcacctgttaagaaagaggctgaaacacaggttgcgcctaggaagaccaagaaaagtcaagtaattcgtagtggagcctcctcttgaagaggttaggagcggtagtgggggcagtggttttttctaccaattatggattatgggatttctctccaatatgaaatattaattttgggttattgcccttgtttcttgcttttttattgtgctttatgtgttgtttatcggaacatcatttttgtgtaccggagttcactaggatcgtataacatctgttgcaacttgcaagttttctttttggcggtactggtatattttaagttttgtttgaattttatttttttttcttctc

SEQ ID NO: 1354 - DNA, 930 bp, Quercus alba
atggggagctagggtttcactccatcgatcgcgttaaacacaacgctctctttgccccagaaagctcggtgatcagtgaccctcccaatctaccttgaaccaacaacaatggtgaagtattcaaaggaacctgataatcccaccaagtcctgcaaggccaggggctcggatctgagagttcatttcaagaacacaagagagacagcccatgctattagaaagttgcctttagcaaaggctaaaaggtatctggaagatgttctggtccacaaacaagccattccctttcgacgcttttgtcgtggtgttggtcgaactgctcaggcaaagaaccgtcattcaaatggtcaaggacgctggccttttaaatcggctaaatttattcttgacttacttaagaatgctgagagcaatgcagaagtgaaaggtctggatgtggattctttgcacatatctcacatccaggtgaaccaagcccagaaacagaggcgccggacctaccgtgctcatgggagaatcaatccctatatgtcatctccctgccatattgagttgaccttgtctgaaaaggaagagccagtcaagaaggagcctgaaacacagttggctcctaggaaaaacaggaagtctcaagctttacatagcggtgcttcttcttgaatgtggtggctacagggaattctagttattcatttctgtactatccactcctttaaagtagaatctatccttctaagataatatatcatttaaaattgagaaccctgtctctgatttactgtctttttcatcaaattttcttttttgagtacttgtatggaacttgaatcatggatttttgtttattttagttttgatatggatgttggagtaacattaacattgatgatgccttaaaattttcattggaatgagtaacattataattat

SEQ ID NO: 1355 - DNA, 886 bp, Phalaenopsis aphrodite
tacgacaacccaacctttaggagctagggttttcagattggttttatggtttcgcatcttcatatattactgccttcgatttcttgcggcgcacaaggaagaggcgtcctcgactgaacgcccacatcggagatccactctaggcagccatcatggttaagtactcgaaggagccctccaaccctaccaagtccgcgaaggctatgggcagggacctcagggttcattttaagaatacaagggaaactgcccacgctctaagaaagttacctttggctaaagcaaaacggtatcttgaggacgtcattgctcacaaacaagccatccccttcaggaggtattgtggaggtgtagggcgaaccgcccaagcgaaggctcgccattcaaacggacagggtcgctggcccattaaatctgctagattcatattggatttgcttaaaaatgctgaaagcaatgctgatgttaaaggcttggatgtggacgctctctatatttctcacattcaggtcaaccaagctcagaagcagaggcgcaggacataccgtgctcatgggcggatcaacccttatatgtcatctccctgtcacattgaactgatcttgtctgagaaagaagaaccagttaagaaggagccggagacccagattgcaactaaaaacaaagaagaccacccaagctctgcgcagcggtgcctcttcttaagcaataccagcagtaactcgtaatttaaattgaaaacgttatagtggacattccagttttgttattttagtagtttcttattgtttagaaaataatttattttttctgtaatccgggcttatgtctgccctttgttattatgtactgattttgatgctatctagcttgttgagaaattcaa

SEQ ID NO: 1356 - DNA, 852 bp, Phalaenopsis aphrodite
ataaggaagaggcgtcctcgactgaacacccacatcggagatccactctaggcagccaacatggtcaagtactcgaaggagccctccaaccctaccaagtccgcgaaggctatgggcagggacctcagggttcattttaagaatacaagggaaactgcccacgctctcagaaagttacctttggctaaagcaaaacggtatcttgaggacgtcattgctcacaaacaagccatccccttcaggaggtattgtggaggtgtagggcgaaccgcccaagcgaaggctcgccattcaaacgggcagggtcgctggcccgttaaatctgctagattcatattggatttgcttaaaaatgctgaaagcaatgctgatgttaaaggcttggacgtggatgctctccatatttctcacattcaggtgaaccaagctcagaagcagagacgcaggacataccgtgctcatgggcggatcaacccttatatgtcatctccctgtcacattgagctgatcttgtctgagaaagaagaaccagttaagaaggagccggagacccagattgcaactaaaaaacaaaagaagaccacccaagctctgcgcagcggtacctcttcttaagcagtaccagcagtaactcgtaatttaaattgaaaacgttatagtggacattccagttttgttattttagtagtttcttattgtttggaaaataatttattttttctataatccgggcttatgtctgcactgtgttattatgtactgattttgatgctatctagcttgttgagaaattcaaagtttaaatcgtttttataatcattgtatctttttctggtttgttggacttgattc

SEQ ID NO: 1357 - DNA, 675 bp, Platanus occidentalis
cgaactataaaaggtgaccttgcccctcttctttcacttctgcttgctcgcgagaaaaaaaaaatcggagccaccctcggtgaagcagccatggttaaatattcgagggagccggacaatcagaccaagtcctgcaaggccaggggctcggatctgagagttcactttaagaacacaagggaaacagcccatgcaattagaaagttgcctttggtcaaggctaaaaggtatttggaggatgttctagtccacaagcaagccattcccttccggcgtttttgtagaggtgttggacgaactgctcaggcgaagaatcgtcattcaaatgggcagggacgctggcctgttaaatcagcaaagtttattctggatttgcttaagaatgctgagagtaatgcagatgtgaaaggtttggatgtggattcgctttatgtatctcacatccaggtgaaccaagcccagaagcagagacgtcgcacataccgtgctcatggaagaatcaacccttatatgtcatctccttgccatattgagttgattttgtccgaaaaggaggaaccagtcaagaaggagcctgagactcaattggctcccaggaaatccaagaagactcttcgaagtggtacttcctcctgagcagtgaagtagtagagatagtattgcagaaagttttgg

SEQ ID NO: 1358 - DNA, 666 bp, Prunus persica
ggcttcgttactctttgcgagctgggaaggaaaatcctagcagagcctgtgggagcagccatggtgaagtattctagagagccagacaaccataccaagtcctgcaaagcaaagggcaatgatctccgagtgcattttaagaacacaagagagactgcccatgctattcgcaagctgcctttgatcaaggctaaaaggtatttggaggatgttttggtccacaagcaagccattccattccgtcgcttttgtcgtggagtagggcgaactgctcaggctaagaatcgccattcaaatggacagggacggtggcctgttaaatctgcaaagtttattctcgacttacttaagaatgctgagagtaatgcagaggtgaaaggtttggatgtggattcgctttatgtatctcatatccaggtaaaccaagcccagaaacaaagacgccgcacataccgtgctcacgggagaattaatccttacatgtcatctccatgccatattgagttgattttgtcagaaaaggaggagcctgtcaagagagagcctgagactcagctggcgagtaggaaagcagagaagggtcgaactctacgcagtggtgctgcttcttaaacaatgatgacctactttaagatgttatgagttggggtttttgtgttgtcatca

SEQ ID NO: 1359 - DNA, 749 bp, Rhizophora mangle
cttcttcttcttcttcttcttcttttgtgacgccgttgattcgggaagtattgacggaagctattaccatggtgaagtactcgagagagccagacaaccccaccaagtcatgcaaggccaggggatctgatctacgagtacattttaagaatacaagggagactgctcatgcaattcgaaagttgcctttgggcaaggctaagaggtacttggaagatgttttgtctcataaacaagctatcccattcaggcgcttttgtgggggtgttggtcgaactgcacaagctaagaaccgtcattcaaatggacaaggacgctggcctgttaaatctgcaacatttatccttgatctgctcaagaatgctgaaagcaatgccgaggtaaaaggtttggatatggatgcactttacatatctcatatccaagttaaccaagcacaaaagcaacgtcgtcgcacttatcgtgcccatggaaggattaatccttacatgtcctctccatgtcacattgagttagttttatcagaaaaggaagaacctgtcgccaaggagcctgagactcagctggctcctaggaaaccaaaggctcaagctctgcgcagtggggcatcttcctaaaaatgatcatcagatccatgatgttggcaccatgagaacattttgttttctgtttctgtttgagtactgagatacattggattagttttgatacattattgcgtatatttatgtagactgttattgttaacc

SEQ ID NO: 1360 - DNA, 855 bp, Sarracenia psittacina
cgcagaagcagcagcaatggtgaaatactcgagagagccagacaatcccacgaagtcctgcaaagccaggggctccgatctcagagttcattttaagaacacaagggagacagcccatgcaatcaggaagctgcctttggccaaggccaagaggtacttagaagatgttcttgctcacaagcaggccatacccttcacacgcttttgtcgtggagtcggacgaactgctcaagcaaagaacaggcattcaaatgggcaagggcgttggccggccaaatctgccagattcatactagatcttcttaagaatgccgagagtaatgctgaggtgaaaggtttggatgtagatacactattcatctctcacattcaggtaaaccaggcacagaagcagagacgccgtacttaccgtgctcatggaagaataaacccctatatgtcttccccctgccatattgagttgatcttgtctgagaaggaagaacccgtcaataaggagccggagtctcaattggcaactagtaaatcaagaaagtctcaagctctacgaagtggtgcatcctcttgaacggttttgacacaaccggtagtttttaagaagttttggagtcttttctctcttatctcagttctttggaagacactagggtgccttcattatattattaatcttttacttgaagagcatgtgtatgacttgttttgttgcaaccaaatgctatttagtcttaaagtgcttttttggatggttcagaaagctcttaaatctcgaatgtaacaattgtggatgctgcatgaggctgaaacagtggcctgaaatgctaagtctttttaaatttgatcatattagagctc

SEQ ID NO: 1361 - DNA, 666 bp, Scabiosa columbaria
aaacccctagcaagcactcttcctttcgctggttacctcaatacctcaagcagcagcagccatggttaagtattcgagggaacctgataaccataccaagtcttgcaaagccagaggctcggatctcaggtgccattttaagaataccagagaaacagcacatgctattcgaaagttgggtttgacaaaggccaaaaggtatttggaggatgttctagtccacaagcaagctattccattcacacgtttctgtcgtggagttggaagaactgctcaggcaaagaatcgtcattcaaatggtcaaggacgatggcccgctaagtctgccaaatttattcttgacttgctcaagaatgcagagagtaacgctgaagtgaaaggtttggatgtggattctcttttcatttcccatatccaggtgaaccaagcacaaaagcaaaggagaaggacctaccgtgctcatggaagaatcaatccttatatgtcatctccgtgccatattgaactgatcttgtctgagaaagaggaacctgtcaagaaagaggctgagacccagttggctcctaggaagactaagaagaatcaagctttgcgcagcggtgcttcgtcttaaagaaccagtatcagtagttttaaatttaatgcagtggtggaatttcattttgc

SEQ ID NO: 1362 - DNA, 1068 bp, Picea glauca
gacgaattagggttttttttatccatcatatcggctattcgcaatacttaattctttaccactattgtttcattttagaagggcagggccgagggggaggccaggagaggagaggagaggagaagagaaaagtagagcggagcagaagttgttgaggccgcagccatggtgaaatactcgagggagcctggcaatcccaccaaatctgcgaaggccaggggttctgatttacgtgttcatttcaagaacacaagagaaactgcacaggcggttaagaagctacctttaactaaggctaagaggtatttggaggatgtcattgcccacaaacaagcaataccctttcgccgcttttgtggaggtgttggcagaaccgcccaagcaaagtctcgaaattcaaatggacagggtcgctggcctgtcaagtctgctgaatttttgttaggtttacttaaaaatgcagagagcaatgctgaggtaaaggggctcgatgttgatacactttatatttctcacattcaagtgaaccaggctcagaagcagcggagacgaacataccgtgctcatggaagaatcaatccatatatgtcatcaccatgtcacattgagctgatactgtctgaaaaggaagcacctgtcaaaaaagaggctgaaactcaaattgctccgaggaaaccaaggaaagctcaaacacttcgaagtggtgcctcttcttgagatgttgaagtagtttgaatttgagcacgccaatgcgatatttttaacataaaccttgtctggtttatctttttagtgactggaggaaactacacccgtttttattttactaggatagtatgaattgtagacaaacattttcttattgaaaactttactttaattcatgttattgttgctttgtgtgattttccggctgttgttatagtgcaagccagcctggtaagcatacaaaagtaaaggaaagctttgctttttatgtttttcatggcataaaactctggatggtttatgtgatcctcaaggtgacgaaaattaaaagacttattttcatgcaaaaaaaaaaaaaaa

SEQ ID NO: 1363 - DNA, 1154 bp, Picea glauca
tttttttatccatcatatcggctattcgcaatacttaatttctttaccactattgtttcattttagaagggccgggccgagggggaggccaggagaggagaggagaagagaaaagcagagcggagcagaagttgttgaggccgcagccatggtgaaatactcgagggagcctggcaatcccaccaaatctgcgaaggccaggggttctgatttacgtgttcatttcaagaacacaagagaaactgcacaggcggttaagaagctacctttaactaaggctaagaggtatttggaggatgtcattgcccacaaacaagcaataccctttcgccgcttttgtggaggtgttggcagaaccgcccaagcaaagtctcgaaattcaaatggacagggtcgctggcctgtcaagtctgctgaatttttgttaggtttacttaaaaatgcagagagcaatgctgaggtaaaggggctcgatgttgatacactttatatttctcacattcaagtgaaccaggctcagaagcagcggagacgaacataccgtgctcatggaagaatcaatccatatatgtcatcaccatgtcacattgagctgatactgtctgaaaaggaagcacctgtcaaaaaagaggctgaaactcaaattgctccgaggaaaccaaggaaagctcaaacacttcgaagtggtgcctcttcttgagatgttgaagtagtttgaatttgagcacgccaatgcgatatttttaacataaaccttgtctggtttatctttttagtgactggaggaaactacacccgtttttattttactaggatagtatgaattatagacaaacattttcttattgaaaactttactttaattcatgttattgttgctttgtgtgattttccggttgttgttatagtgcaagccagcctggtaagcatacaaaagtaaaggaaagctttgctttttatgtttttcatggcataaaactctggatggtttatgtgatcctcaaggtgacgaaaattaaaagacttattttcatgcataccgtgaggacttttctgcaaggctatctggggaatgaaggttcaggttcagttgacaggtccatcaaatgggagatgtcaacatttgacttttgttagatagttcaccatgatat

SEQ ID NO: 1364 - DNA, 1161 bp, Picea glauca
gattatggtttgctacgaattagggttttttttatccatcatatcggctattcgcaatacttaatttctttaccactattgtttcattttagaagggccgggccgagggggaggccaggagaggagaggagaagagaaaagcagagcggagcagaagttgttgaggccgcagccatggtgaaatactcgagggagcctggcaatcccaccaaatctgcgaaggccaggggttctgatttacgtgttcatttcaagaacacaagagaaactgcacaggcggttaagaagctacctttaactaaggctaagaggtatttggaggatgtcattgcccacaaacaagcaataccctttcgccgcttttgtggaggtgttggcagaaccgcccaagcaaagtctcgaaattcaaatggacagggtcgctggcctgtcaagtctgctgaatttttgttaggtttacttaaaaatgcagagagcaatgctgaggtaaaggggctcgatgttgatacactttatatttctcacattcaagtgaaccaggctcagaagcagcggagacgaacataccgtgctcatggaagaatcaatccatatatgtcatcaccatgtcacattgagctgatactgtctgaaaaggaagcacctgtcaaaaaagaggctgaaactcaaattgctccgaggaaaccaaggaaagctcaaacacttcgaagtggtgcctcttcttgagatgttgaagtagtttgaatttgagcacgccaatgcgatatttttaacataaaccttgtctggtttatctttttagtgactggaggaaactacacccgtttttattttactaggatagtatgaattatagacaaacattttcttattgaaaactttactttaattcatgttattgttgctttgtgtgattttccggctgttgttatagtgcaagccagcttggtaagcatacaaaagtaaaggaaagctttgctttttatgtttttcatggcataaaactctggatggtttatgtgatcctcaaggtgacgaaaattaaaagacttattttcatgcataccgtgaggacttttctgcaaggctatctgggggaatgaaggttcaggttcagttgacaggtccatcaaatgggagatgtcaacatttgacttttgt

SEQ ID NO: 1365 - DNA, 848 bp, Gossypium raimondii
tttgttggcattctttttcttaggtgaagtattcaagagaaccggacaaccctactaaatcttgcaaagctaggggttctgaccttcgtgttcattttaagaatacacgagaaactgcctttgccatccgaaagctacctttgacaaaggcaaagagatacttggaggatgttattgcccacaagcaagcaattccgttccggcgcttctgtggtggagttgggcgaaccgcacaggctaagaatcgccattctaatggacaaggtcgctggcctgtgaaatctgcaaaattcattctcgatttgctcaagaacgctgagagcaatgccgaggtgaaaggtttggatgtagactcacttatcatatctcacatccaagtgaaccaagcacagaagcaaaggcgccgaacatatcgtgcacatggaaggattaacccctacatgtcttcacagtgtcacattgaactgatactgtcagagaaagaggaacctgtgaaaaaagagcctgagactcagttggctccgaggaaatcgaagggtgcttcatcttaaattgctgagcggtggattataacttggaaactattacatttttctttagttgtctctgtaatgagaacatttttgtttcccttcacaatgaggtgtttaagactcaaagtttgtctatggagattcttggttctatggtgattttgcttgtaatacttaagtagctcgtaaacctgattaagttctatatttgtattcttatttttatcgattctttaaaatattcaaacttaagcttgaaatctgttttaaataaataattctttgtattctttcaacgtcatttttatttattta

SEQ ID NO: 1366 - DNA, 761 bp, Antirrhinum majus
cgcaagaagcagcagctacaatggtgaagtactcaagagagcccgataacatcaccaaatcctgcaaagctaggggagccgatttgagagtccatttcaagaacacaagggagaccgcgcatgccatcagaaagttgcctctgaccaaggccaagaggtatttggaggatgtgcttgcacacaagcaggctattccattcactcgcttctgcagaggtgtagggcgaactgctcaggcaaagaacaggcattctaatggacagggacgctggcctgtcaaatctgccaagtttatcttggatttactgaagaatgctgaaagcaacgctgaggtgaaaggcttggacgtggatgcactcttcatttctcacattcaagttaaccaagcccagaagcaaaggcgtcgcacataccgtgctcatgggagaattaacccctacatgtcttctccatgccacattgagttgattctttctgagaaggaagagcctgtcaaaaaggagcctgagtcacagttggcagcaagcaaaccaaggaaggcttgagctcacggtggtttgctaggccatatagtttgcttaacgagttttgaaattgtgctttagctgtcctttttctttttggagactttaagctttttgttgctacttaatgatttatgttttagaagacgattggatctacgttatggatcacaaatgcttttatattggcaatatgtttctgcacttgtactatatcctatagagtttcagcttttc

SEQ ID NO: 1367 - DNA, 747 bp, Antirrhinum majus
  misc_feature (669)..(669): n is a, c, g, or t
  misc_feature (673)..(673): n is a, c, g, or t
aatcacagcaagccctaacagttttatttgctccagtacgccgctgaagcagcagcgacaatggtgaagtactcgagagaacctgacaacatcaccaaatcctgcaaagctaggggagctgatttgagagtgcatttcaagaacaccagggaaaccgcgcatgccatcagaaagttgcccctaaccaaggccaagaggtacttggaggatgtgcttgcccataagcaggccataccctttactcgcttctgtcgaggtgttgggcgtactgctcaagccaaaaacagacattccaatggacagggtcgatggcctgtcaaatccgccaaatttatcttggatttactgaagaatgctgaaagtaacgctgaggtgaaagggttggatgtggatgcactcttcatttctcacattcaggttaaccaagctcagaagcaaaggcgccgcacttaccgggctcatggaagaattaacccctacatgtcatcaccatgccacattgagttgattttgtctgagaaggaggagcccgtcaaaaaggagcctgaatcacagttggcgactagcaagcctaggaaggcttgacctcatagtgcatgcaagacttttggtagttgcttaacaggtttcgaaactgtgtcctgtctatcgtaatttttggagacgtangatnttgatatttacataattagtttattgaagtatgatgggattgatcacaatgtggttgagtgattgtccttcctt

SEQ ID NO: 1368 - DNA, 723 bp, Cicer arietinum
cctgagccctaattcgttttctgccggttccgccacaaccccgtcgtcatggtcaagtactcaagagagcctgataatcccaccaagtcatgcaaggctagaggtgctgatcttagagttcatttcaagaacactagggaaactgccttttctatcaggaaattgcctttgacaaaggccaagaggtacttggaggatgttcttgcacacaaacaggccattccattcaggcgtttctgtcgtggtgttgggaggacagctcaggccaagaatagacactctaatggacaaggaaggtggcctgccaaatctgccaagttcattctagatttgctcaagaacgcagagagtaatgctgaagtgaaaggtttggatattgatgctctttacgtttctcatatccaagttaatcaagcacagaagcaaagacgtcgaacatacagagcccatggaagaattaacccttacatgtcatctccatgccacatagagttggtattatctgaaaaggaagaggcggtcaagaaagagcctgagactcagttggcaccaagcaagaagaaggcttaagctcttcatgcctgcgcatgttaattttaaatccattatttgtatcagatatttgtaggaaatgtttaaactcttttctatttcatactgttttgacttattcagtgaatttcggaaacgtgttgtactgttttgacttattcagtgaatttc

SEQ ID NO: 1369 - DNA, 756 bp, Ipomoea batatas
ggccgggggaagcaggaaggagcaatctctaatctcgccccttaagcagccggcgccatggtgaagtactcgagggagcccgacaattccactaaatcctgcaaagctaggggctcagatctcagagttcatttcaagaacactagggaaacagcgcatgctatcaggaagcttcctttgggaaaggctaaaaggtatctagaagatgttttggcccacaagcaggccattcccttcacccgcttctgccgtggcgttggaagaactgctcaggctaagaacagacatcctaatggacagggaaggtggcctgtgaaatctgcaaagttcattcttgatttgctcaagaacgccgaaagcaatgctgaggtgaaagggctcgacgtggatatactctacatctcccacattcaggttaaccaagcacagaagcagaggcggcgaacataccgtgctcacggaagaattaacccttacatgtcttccccttgccacattgagctaatcctgtctgagaaggaagaacctgtcaaaaaggagcccgagtcacaaataacaaccagcaaatccaggaaggcataggctttcttttccatatttgttgttcctgagcctacagagctgtgtttcttaaacatatcccctactttatgttgagaattgtactggtagtggattgtcactattcaaattttctgaagagtttatggagttaattttgtatgttaaggttaaaattgatatactgctttacat

SEQ ID NO: 1370 - DNA, 753 bp, Ipomoea nil
gggaaagcaggaaggagcaaaccctaatctcgcttctgaagcagcagccgaagcagcaggcgccatggtgaagtactcgagggagcccgataatcccaccaaatcctgcaaagctaggggctcagatctcagagttcatttcaagaacactagggaaacagcacatgctatcaggaagcttcctttggtaaaggctaaaaggtatctagaagatgttttggcccacaagcaggccattccctttacccgcttctgccgtggtgttggaaggactgctcaggctaagaacaggcatcccaatggacagggaaggtggcccgtgaaatctgccaagttcattctcgatttgctcaagaatgctgaaagcaatgctgaggtgaaagggctcgatgtggatacactttacatctcccacgtccaggttaaccaagcccagaagcagaggcggcgcacataccgtgctcacggaagaattaacccttacatgtcttccccttgccacattgagttaatcctttctgagaaggaagaacctgtcaagaaggagcctgagtcacaaatagcaaccaccaaatccaggaaggcttaggctttcttttccatatttgttgttcctgagccttgatagagctgtgtttcttacatatcccctactttatgttgagaattgtattggtagtggattgtcactattcaaattttctgaagagattatggagttaattttgtatgttaaggtaaaaatgatatact

SEQ ID NO: 1371 - DNA, 827 bp, Tropaeolum majus
cggccgggggacaacatcagttgcatcttccaccaaggtcgttcttcattccgttgctcgtgaagtgtaaagcgcattcgtagcagccatggtgaagtactccagagagccggacaatcccaccaagtcttgcaaagccagaggctctgatcttcgtgttcattttaagaataccagggaaacagcccatgcaatccgtaaaatgcctttgaacaaggcaaagagctacttggaagatgtattggctcacaagcaagccattccatttcgccggttttgccgtggtgttgggcgaactgcacaagccaagagtcgccattcaaatgggcaaggtcgctggcctgctaaatctgctaactttatcttggatttactgaagaacgctgagagtaatgctgaggtgaaaggattggatgttgatgctctttatgtgtctcacatccaagtgaaccaagcccagagacaaagacgtcgaacataccgtgctcatggaagaattaatccttacatgtcctcaccatgccacattgaaatttgtctgtcagagaaggaagagcctgttaagaaagagcctgagagtcagttggctccaagaaaatcaaaggcctaatttctgttcagaagctgcttcatagtggttctattagctgaggaagtatgagtctttatgattttagcagtatcttttcgcgtcttggaaacttgccttccatttttgtatttggaaatcgtatgaaaacttatttgaacgtttgtttttccttgcgttatcaactccagattttgatgtttaaatgaaatatttattgttctgttggtgtttaaaa

SEQ ID NO: 1372 - DNA, 768 bp, Platanus occidentalis
aggaccgcggttttggatcattttgccgcagagcagcagcggcaacagctgccatggttaagtattctagggagccggacaatcataccaagtcctgcaaagccaggggctcggatttgagagttcactttaagaacacgagggagactgcccatgcagttcgaaagttgcctttggccaaggcaaaaaggtatttggaggatgttctagcccacaagcaagccattccctttcgacgcttttgtaggggtgttggtcgaacagcgcaggcaaagaaccgtcattcaaatggacagggacggtggcctgtaaaatcagcaaagttcattctggatttgcttaagaatgctgagagtaatgcagacgtaaaaggtttggatgtggattcactttatgtatcccacatccaggtgaaccaagctcagaagcagaggcgtcgcacataccgtgctcatggcagaataaacccctatatgtcatctccctgccatattgagttgattttgtctgagaaggaggagcctgttaagaggggggagcctgagactcagttggcccccaggaaagagaagaaggctctacgaagtggtgcttcttcttgatcagtgaagcagctgagtaggtgattcagaaagttttgaagtcctttattttcatttttcctcttcaagacatttttatcgctttcggatcaatgtccacttattttgagaatgccctgggatatgatatttctcatcatgcattgttgggtttcacgagtaaata

SEQ ID NO: 1373 - DNA, 798 bp, Helianthus annuus
tttgattcttcgtacaacacagttcggctgcattttcaccggcgaatccgctgcagcaatggtgaagtactcaacggaaccggaaaaccctacgaaatcttgcaaagctagaggttcagatctcaggtgtcactttaagaacaccagagaaactgcacatgccatacgcaaattgccgttgatcaaggctaagagatacttagaagatgttcttgctcataaacaagcaataccgtttacacgtttttgtcgtggagttggacggactgcacaagcgaagaatcgccattcgaatggacaaggacgttggcctgctaaatctgcaaagtttatccttgatttgctgaagaatgctgagagtaatgcggaagttaaggggttagatgtggatgctcttcacatttctcacattcaggtgaaccaagcacaaaaacagagacggaggacttaccgtgctcatggaagaatcaatccttacatgtcttctccttgtcatattgaactgaccctatccgagaaggaagaacctgttaagaaagagcccgagactcagttggcctcaagaaagacaaagtagagtctggtttttatcggcggtggattggcgttactagaaagagctcttagttatattctcgcactattttttcattttgaaaagttcatttgatgttaaattttgagattttctatattttttttatcattatcttgcatttacaacggctcgaattcttcttttctgtgtattttgaaacaaagtaaaattaaaacggctttgatcattaattcattttt

SEQ ID NO: 1374 - DNA, 834 bp, Helianthus annuus
attgacgacgaagaagaagaagcagcaatggtgaagtactcgcaagagcccgataatccgacaaaatcctgcaaagccaggggttctgatctgagatgccatttcaagaatacgagagaaacagcgcatgctatcagaaagttgcctttgatcaaggcaaaaagatatttggaggacgttctggcccacaaacaggctataccgttcactcgtttttgtaggggtgttgggcgtacagctcaggcaaaaaaccgacactctaatggtcagggtcggtggcctgccaagtcagcaaaatttattttggatttactcaaaaatgctgaaagcaatgctgaggttaaaggcttggatgttgatgcacttttcatttcacacattcaagtgaaccaagctcaaaagcaaaggcgtagaacataccgagctcatggaagaattaatccttatatgtcatctccgtgtcatattgagctgactttatccgaaaaggaagagcctgtgaaaaaagaggcggaatcacaactggcaaagtcgaagtagtctcagactaaatctatggcttatttatttaattttaaccaaaaaaaacctttcaaaactattctcagggttaattttgtcgtttttggcttctacttgtgaacacaaattttgttggagacttttgtattggtgcctaatatatttgtttttggatgtttttcaaaaaaatagacactcaccaaacttataccgaagataacatgttggtgggccttgggcccattggattttaaaatcgaacaagcttatgcttgcggcccgaatttggagcccccttgggccaattttccc

SEQ ID NO: 1375 - DNA, 815 bp, Helianthus annuus
aagcaaataaccttcgtcttcttcgacgaaaaccctagccttcaattttgattctccgtagaacacagttcggctgcattttcaccggcgattccgctgcagcaatggtgaagtactcaacggaaccggaaaaccctacgaaatcttgcaaagctagaggttcagatctcaggtgtcactttaagaacaccagagaaactgcacatgccatacgcaaattgccgttgatcaaggctaagagatacttagaagatgttcttgctcataaacaagctataccgtttacgcgattttgtcgtggagttggacggactgcacaagcgaagaatcgccattcgaatggacaaggacgttggcctgctaaatctgcaaagtttatccttgatttgctgaagaatgctgagagtaatgcggaagttaaggggttagatgtggatgctcttcacatttctcacattcaggtgaaccaagcacaaaaacagagacggaggacttaccgtgctcatggaagaatcaatccttacatgtcttctccttgtcatattgaactgaccctatccgagaaggaagaacctgttaagaaagagcccgagactcagttggcctcaagaaagacaaagtagagtctggtttttatcggtggtggattggcgttactagaaagagctctttagttatattctcgcactattttttcattttgaaaagttcatttgatgttaaattttgagattttctatatttttatcattatcttgcatttacaacggctcgaattcttcttttctgtgtattttgaaacaagtaaaattaaa

SEQ ID NO: 1376 - DNA, 621 bp, Helianthus annuus
gaagaagaaccagcagtagctagcagcaatggtgaagtactcgcaagagcccgataatccgacaaaatcctgcaaagccaggggttctgatctgagatgccatttcaagaatacgagagaaacagcgcatgctatcagaaagttgcctttgattaaggcaaaaagatatttggaggacgttctggcccacaaacaggctataccgttcactcgtttttgtaggggtgttgggcgtacagctcaggcaaaaaaccgacactctaatggtcagggtcggtggcctgccaagtcagcaaaatttattttggatttactcaaaaatgctgaaagcaatgctgaggttaaaggcttggatgttgatgcacttttcatttcacacattcaagtgaaccaagctcaaaagcaaaggcgtagaacataccgagctcatggaagaattaatccttatatgtcatctccatgtcatattgagctgactttatccgaaaaggaagagcctgtgaaaaaagaggcggaatcacaactggcaaagtcgaagtagtctcagactaaatctatggcttatttatttaattttaaccaaaaaaacctttcaaaactattctcagggttaattttgtc

SEQ ID NO: 1377 - DNA, 842 bp, Helianthus annuus
aagcaaataaccttcgtcttcttcgacgaaaaccctagccttcaattttgattcttcgtagaacacagttcggctgcattttcaccggcgaatccgctgcagcaatggtgaagtactcaacggaaccggaaaaccctacgaaatcttgcaaagctagaggttcagatctcaggtgtcactttaagaacaccagagaaactgcacatgccatacgcaaattgccgttgatcaaggctaagagatacttagaagatgttcttgctcataaacaagctataccgtttacgcgattttgtcgtggagttggacggactgcacaagcgaagaatcgccattcgaatggacaggggcgttggcctgctaaatctgcaaagtttatccttgatttgctgaagaatgccgagagtaatgcggaagttaaggggttggatgtggatgctcttcacatttctcacattcaggtgaaccaagcacaaaaacagagacggaggacttaccgtgctcatggaagaatcaatccttacatgtcttctccttgtcatattgaactgaccctatccgaaaaggaagaacctgttaagaaagagcccgagactcagttggcctcaagaaagacaaagtagagtctggtttttatcggtggtggattggcgttactagaaagagctttagttatattctcgcactattttttcattttgaaaagttcatttgatgttaaattttgagattttctatattttattttgttatcattatcttgcatttacaacggctcgaattcttcttttctgtgtattttgaaagaaagtaaaattaaaacggctttgataattaattca

SEQ ID NO: 1378 - DNA, 707 bp, Acacia harpophylla
ggcgaaagccatcggcgtgttcagagagtagctcccataaaagacgcaatggtgaagtactccagggagccggacaatcctactaagtcctgcaaggccagaggctccgacctcagagtccacttcaagaatactagagaaactgcttttaccatcaggaagttgcccttggtaaaggctaagaggtacctagaggatgttctagcccacaaacaaaccattccgttccgaaggttctgcggtggagttggtaggacagcccaggctaagaatagacattctaacgggcaaggacgctggcctgttaaatcagctaaattcatcctagacttgcttaagaatgctgagagtaatgctgaagtgaaaggtttggatgtcgacgccctctacatttctcatatccaggttaatcaagcacaaaaacaaagacgccgcacctaccgagctcacggaaggatcaacccttatatgtcatctccctgccatattgagcttactttatctgagaaggaagaacctgtgaggaaggagcccgatacccagttggccacaagtaagaaatcttaagcccttttaagcggtgcttccatcttaaattgccagtgtaacatctgatcgaagacccaatactttttagagtttctcgagaattttgttactctttattatcacatttgtatgagttgttcttaggctttgggcaagta

SEQ ID NO: 1379 - DNA, 540 bp, Arnica chamissonis
gctatggtgaagtactcaaaggaaccggacaaccctacgaaatcttgcaaagctaggggttcagatctcaggtgtcattttaagaacactagagaaactgctcatgctatacgcaagttgccattgattaaggctaagagatacttagaagatgttcttgctcataaacaagctattccgtttacacgtttttgtcgtggagttggacgaactgcacaagcgaagaatcgtcattcaaatggacaaggacgttggcctgctaaatctgcaaagtttatccttgatttgctcaagaatgccgagagtaatgctgaagttaaggggttggatgtggattctcttcacatttctcacattcaggtgaaccaagcacggaaacagagacgtcgcacttatcgtgctcatggaagaatcaatccttacatgtcttctccttgtcatatcgagctgactttatctgagaaggaagaacctgttaagaaagaggctgagtctcagttggctgcaagaaagacatagtagaatctagctatctggttg

SEQ ID NO: 1380 - DNA, 814 bp, Artemisia annua
taataaaccctcaacacacaattcggccaccagtgtgaaccagctgctacaatggtgaagtactcaaaggagccagaaaaccccaccaaatcttgcaaagctagagggtcagatctcagatgtcatttcaagaacactagagaaactgcacatgctctacgcaagatgcctttgatcaaggctaagagatacttagaggatgttcttgcacataaacaagccatcccgttcacacgtttctgtcgtggagttggacgtactgcacaagctaagaatcgccattcaaatggacaaggacgttggcctgctaagtctgctaagtttattcttgatttgctcaagaatgctgagagcaacgctgaggttaaaggtttggatgtggatgctcttcacatctctcacatccaggtgaaccaagcacaaaaacaaagacgtcgcacatatcgtgctcatggaagaattaacccttacatgtcttctccttgtcatattgagctgaccttgtctgaaaaggaagagcctgttaagaaagaggcggagactcaattgtctgcaaagagcaagtgaatctaggttgactcaagcggcaaatcaaaacttttggcaagtattagatcagtaccagaaagggttttatttttgtgtacttttgacatttggaagaattgttattctatctttaagattatgatctcatattctcatgtttacggtatgaaattattcacttttggatctctattagtagatgtttttatgaaggttgcattttgtttttatgttatgaaggttgcattttggtgctttcacgaaa

SEQ ID NO: 1381 - DNA, 1176 bp, Beta vulgaris
  misc_feature (482)..(482): n is a, c, g, or t
  misc_feature (484)..(484): n is a, c, g, or t
  misc_feature (491)..(491): n is a, c, g, or t
  misc_feature (520)..(520): n is a, c, g, or t
  misc_feature (556)..(556): n is a, c, g, or t
  misc_feature (561)..(561): n is a, c, g, or t
  misc_feature (574)..(574): n is a, c, g, or t
  misc_feature (590)..(590): n is a, c, g, or t
  misc_feature (601)..(601): n is a, c, g, or t
  misc_feature (634)..(634): n is a, c, g, or t
  misc_feature (643)..(643): n is a, c, g, or t
  misc_feature (652)..(652): n is a, c, g, or t
  misc_feature (654)..(655): n is a, c, g, or t
  misc_feature (660)..(660): n is a, c, g, or t
  misc_feature (669)..(669): n is a, c, g, or t
  misc_feature (676)..(676): n is a, c, g, or t
  misc_feature (680)..(680): n is a, c, g, or t
  misc_feature (692)..(692): n is a, c, g, or t
  misc_feature (701)..(701): n is a, c, g, or t
  misc_feature (705)..(706): n is a, c, g, or t
  misc_feature (715)..(715): n is a, c, g, or t
  misc_feature (719)..(719): n is a, c, g, or t
  misc_feature (740)..(740): n is a, c, g, or t
cgaggcgcagcagcaaagagcaacaatggtgaagtattcaaaagaacccgacaaccccaccaagtcttgcaaggctaggggatcagatcttagggtccatttcaagaatacaagagaaactgcgttttctctccgaaaaatgcctctaggcaaggctaaaaggtatttggaagatgtccttgcccacaaacaagcaattccattccgtcgcttttgtagaggagttggtcgaactgctcaggcaaaaaaccgtcactcgaatggacaagggcgttggcctgccaaatccgcaaagttcatcttggacttgctaaaaaatgctgagagtaatgctgagatgaaaggtttggatgtcgattccctttacatctcacacattcaagtgaaccaagctcaaaagcagaggcgtcgtacttaccgtgctcatggaagaatcaacccttacatgtcacatccatgccacattgagttgactttgtcananaaggaanaatcagtgaggaaagagcctgagtctcanttggccgcaagcaaatagaagggtggttccggttcntcttnagcacactttganggctgtcttcaccacngaggactgatncttcatatcaatttctctgatctgccagatgcnttttgctgntctacctgnanngggantttgactgntgatttngaantatttgcgctcnatttatganattnngaaaaaccntacnttccccgtgttactatgggcnttaagatattctgactgtcgctaaaaaaaaaaaaaaattcaggggggcccggaccaaattcccctttgggagcggataccatcctggcgtctttttaacgctgctggaaaactggggtccaattaatgcttggggaatcccctttccagtgggaaaacaaaagcccccgaccctttcaaattgcacctaagggaggaattaacggaaattgtaaatcggaatttgtaacccctttcccaggcaacgaaacttaataaaaacaaagggggtttcctggaaatccttaaatgcccctagggaactttgggggcctgaccccacttttggggggaataaaccggccttttgaacgaggaaaaaaaacgccgcatccccccccccccggggttgggcttttataacaaaaaaaactttttctaaaaaaataattttccgc

SEQ ID NO: 1382 - DNA, 779 bp, Cichorium intybus
attggcggggggaaacccaaccgaaaaccgttatcgacttatcgtgactgcaggaggaggaggagcagccatggtaaagtactcaaaagagcctgataatcccaccaaatcctgcaaggctaggggttcagatctcagatgtcacttcaagaatacccgtgaaaccgcacatgcaatcagaaagatgcctttaatcaaggccaagaggtatttggaagatgttcttatccacaaacaggccatacccttcaccagattttgtaggggtgttggtcgtactgctcaagcaaaaaatagacattcaaatggtcaaggtcgatggcctgccaagtcagcaaaattcattttggatttgcttaaaaatgctgaaagcaatgctgaggtgaaagggttagatgtggatgcccttttcatatctcatatacaagtgaaccaagcacaaaaacaaagaaggagaacataccgtgcccatgggagaatcaacccttatatgtcatcaccttgccatattgagttgactttatctgagaaggaagaacctgtgaaaaaggaggctgaatctcagttggcaaagtcgaagaaaccttagattcccaatagggtattaatctatagattctgatatgttttgaagtacttttgggttaattaaagttcttggttttttgaagatgaatattgttttacatattttgaaactgtatcaggatattggattttttgatgagttttgatggtcaagttgaaagcaaaccttttgttttaagtctaaaaaaaaa

SEQ ID NO: 1383 - DNA, 576 bp, Cirsium arvense
tcagttaatcggcatttacaccggcgaaaccaatggtgaagtactcaaaggaaccggaaaaccccacgaaatcttgcaaagccaggggatcagatctcaggtgtcatttcaagaacaccagagaaactgcacacgcgatacggaagttgcctttaattaaggctaaaagatacttggaggatgttcttgtccataagcaagcgatccctttcacacgcttctgtcgtggagttggacgtactgcacaagcaaagaaccgtcattcaaatggacaaggacgctggcctgctaaatctgcaaagtttatcttggatttgctcaagaatgccgagagtaacgcagaagttaaagggttggatgtggatgcactttacatctctcacatccaggtgaaccaagcacgaaaacagagacgtcgcacatatcgtgctcatggaagaatcaacccttacatgtcttctccttgtcacattgagctcaccttatctgaaaaggaagaacctgttaagaaagaggctgagagtcaattggctgcaagaaagagcaattagaaagtagcatataaattggtactag

SEQ ID NO: 1384 - DNA, 792 bp, Helianthus annuus
gacacctagggtttatatctataaacatcgacggcacatacattgacgacgaagaagaagaagcagcaatggtgaagtactcgcaagagcccgataatccgacaaaatcctgcaaagccaggggttctgatctgagatgccatttcaagaatacgagagaaacagcgcatgctatcagaaagttgcctttgatcaaggcaaaaagatatttggaggacgttctggcccacaaacaggctataccgttcactcgtttttgtaggggtgttgggcgtacagctcaggcaaaaaaccgacactctaatggtcagggtcggtggcctgccaagtcagcaaaatttattttggatttactcaaaaatgctgaaagcaatgctgaggttaaaggcttggatgttgatgcacttttcatttcacacattcaagtgaaccaagctcaaaagcaaaggcgtagaacataccgagctcatggaagaattaatccttatatgtcatctccgtgtcatattgagctgactttatccgaaaaggaagagcctgtgaaaaaagaggcggaatcacaactggcaaagtcgaagtagtctcagacttaatctatggcttatttatttaattttaaccaaaaaaaacctttcaaaactattctcagggttaattttgtcgtttttggcttctacttgtgaacacaaattttgttggagacttttgtattggtgcctaatatatttgtttttggatgtttttcaaaaaaatagacactcaccaaacttataccgaagataacatgttggt

SEQ ID NO: 1385 - DNA, 824 bp, Helianthus annuus
gcggggtagaagcctaaataaatccaagcaaataaccttcgtcttcttcgacgaaaaccctagccttcaattttgattcttcgtagaacacagttcggctgcattttcaccggcgaatccgctgcagcaatggtgaagtactcaacggaaccggaaaaccctacgaaatcttgcaaagctagaggttcagatctcaggtgtcactttaagaacacccgagaaactgcacatgctatacgcaaattgccgttgatcaaggctaagagatacttagaagatgttcttgctcataaacaagctataccgtttacgcgattttgtcgtggagttggacggactgcacaagcgaagaatcgccattcgaatggacaaggacgttggcctgctaaatctgcaaagttcatccttgatctgctgaagaatgctgagagtaatgcggaagttaaggggttagatgtggatgctcttcacatttctcacattcaggtgaaccaagcacaaaaacagagacggaggacttaccgtgctcatggaagaatcaatccttacatgtcttctccttgtcatattgaactgaccctatccgagaaggaagaacctgttaagaaagagcccgagactcagttggcctcacgaaagacaaagtagagtctggattttatcggcagtggattggcgttactagaaagagctctttagttatattctcgcactattttttcattttgaaaagttcatttgatgttaaattttgagattttctatattttttttatcattatcttgcatttacaacggctcgaattcttcttttctgtgtattt

SEQ ID NO: 1386 - DNA, 713 bp, Camellia sinensis
ggggcttgtgcgagagcacaaagtgaatcacttcatactcttctcgacccaggtgcagcagctatggtgaagtactcaaaagagcctgacaatcccaccaagtcctgcaaagccaggggctcagatctcagagtccatttcaagaacacgagggagacagcacatgccatcaggaagctgcctttggccaaggctaagaggtatttagaagatgttctggctcacaagcaggccatacctttcacgcgtttttgtaggggtgtaggacgaactgctcaggcaaagaacagacattcaaatggacaaggacgttggcctgtcaaatctgctggattcatactcgacttgcttaaaaatgctgagagtaatgccgaggtgaaaggtttggatgtggatacactttacatatctcacattcaggttaaccaggcacagaaacagagacgccgcacgtaccgtgcccatggaagaatcaacccctacatgtcttccccctgccatattgagttgatcttgtctgagaaggaagagcctgttaaaaaagagccgagtctcagtttggcaactagccaaatccagtaagtctcaagctctgccgagtggtgcatcctctggaacaacttgataccaggtccggtagcttagaattatgaggtctactcgacatcttatccctggcaatttactttggggaacgaaattctggtgtccaa

SEQ ID NO: 1387 - DNA, 1259 bp, Amborella trichopoda
gaacttatcatgtaaaaaaatttccgacgaaaaggtcggaacgtagaaaagggcagtttatatcaaaacttcccccgataaaagccctaggtttactcagccactcacccacccaccctctcttcgccgctcagcaaaacagcagctccactgcgaaagttctctcgctctctcttcccagtaaaggcagcctctcgcccagtactattcgcggccttgcaacctcaacagggtttcctacttttgtcgttgcgattagagagagagaattttagggtttttggattcacaaaaattcacagctttgaggcgctcataaccctcggcctctgggagcagtcatggtaatctctctctctccatttcgatcagcagccatggtgaagtattccagggagccggacaatccaactaaatcttgcaaggccagaggatctgatttgagggttcacttcaagaacaccagggaaaccgcatttgctctcaggaagctcccattggccaaggctaagaggtatttggaggatgttcttgcccacaagcaggccatccctttccggcgcttttgtggaggtgttgggcgcactgctcaagcaaagaaccgccatccaaatggacaagggcggtggcctgtcaagtctgccaagttcatcttgaacttgctcaagagtgctgagagcaatgctgatgtgaagggcttggatgtggatacactattcatttcgcatatccaggtgaatcaggctcagaagcagaggcggcgaacttaccgtgcccatggaagaatcaacccttacatgtcctccccctgtcatattgagttgatattgtctgaaaaggaggcacctgttaagaaagaggctgaaaccgaagtggtgctcaagaggacgaagaaatctcaagctcttcgtagtggggcttcatcttaaagctttgcagagtaagagagattggtatcgcgtcaacttgaagatttactctgagagattgacatcttttttccttctatttgaatggtcatgtttttgcaacatttcgtaaagaattttgtggttgtataaggaccaagaattagtcacccaatttggagagatcttttcttgcttgaattggctagtttgagccttagatcatatttgggtcattgttttggcttgagtgtcttccgttgtggacaccaatgtccttacattgtaggcattagttaccacgaaagtgttttagaacttttgttagtaatgtgattgtttcatgaccta

SEQ ID NO: 1388 - DNA, 967 bp, Vaccinium corymbosum
ggggttccaaacagcagcagcagccatggttaagtactcgagggaaccagacaatcccaccaagtcttgcaaagctaggggatccgatctccgagttcattttaagaatacaagagaaacagcccatgccattcgaaagttgcctctggtcaaggccaaaaggtacttagaagacgttctagcccacaaacaagccattccattcactcgcttctgtcgtggagttgggagaactgctcaggcaaagaaccgccattcaaatggacaaggacgttggcctgttaaatctgcaggatttatcctggatttacttaagaatgctgagagcaatgcagaagtgaaaggcttggatgttgaggcactttatatttctcacatccaagtgaaccaagcccagaagcagaggcgccgcacttaccgtgctcatggaagaatcaacccctatatgtcatctccgtgccatattgagttagttttgtccgagaaggaagaaccagttaagaaggagcctgagatgcaagtggcttcaagtgccaagaagagccgaggtctgcgcagtggcgcttcttcttgaatgacatgagtaatagccaccttgttccagattgtttgggggatgttctctctttgtcctgtgttgttcaaaacttttccttttgttgggtttgctattttcagaaagatgattgttttcgttttgtttaagttagtgaattgctatcaccagagatgtatgacattcggatggaatttggtttccttattgagtagtttgccaaaagaacagaacaaagaacaaaatgtttagtcttcgactccaggaggagaagaaagacagctgagtaatttattccgtgcctctgtccaaactggaatgtcctcgtaccgcttcccaactacttgttagtacctaccagagcttatgcactccatagtccgccgcccccggccgtaactcgcctacctc

SEQ ID NO: 1389 - DNA, 917 bp, Gossypium raimondii
gccatcaccctcaattcgccgctttgatattgctaggcagacccccaattgaagcactcttgagcagcaacagaggcttcattcagatcacatatcagcagccatggtgaagtattcgaaggaacccgataatcccaccaaatcctgcaaggcaaggggctctgatcttagggttcatttcaagaacacaagggagacagctttcgccattagaaagttgccattggttaaggctaaaaggtatttggaggatgttatggcccacaagcaagccataccgttccgacgcttttgtggtggtgttggacgtacggcacaagcaaagaacaggcattctaacggacaaggtcgctggcctgtaaaatcggcaaagttcattctagatttgctgaagaatgctgagagtaatgccgaggttaagggtttagacgtcgatgcactccatatttctcacatccaggttaaccaggcccaaaaacaaaggcgtcgtacttaccgagctcatggaagaatcaacccttacatgtcctctccttgccacattgagttgattttgtccgagaaggaagaacctgtcaaaaaagagcctgagactcaattggcagcaagcaagtccaagaagtcccaagcttcttcttgagtgaacaaagtttgaaactttatcaagtcagttaatgtagtgatttctggtctttggatttcatacattatttttgaagtttttgacattaagatgtgttggatggttttttatttcaaagcatgttttagtcaaatgttgtcttgagttatgtttttcttggagattttgtctcaattacagtgttctatgttatgtttcatttatatactaaatgcatttcctaattaaataggaggatatcacgcatttaaagtttgaattcacaaaatttgaa

SEQ ID NO: 1390 - DNA, 842 bp, Medicago truncatula
aacgaaaaaccctaatctgctgaatcttctcagcctccttcccacaatcgtgttcattcctaacgaattagcagagcagccatggtgaagtactccagagagcccgacaatcccaccaaatcaaccaaggccagaggtgctgaccttagggttcatttcaagaacaccagggaaacagcgtttgccatcaggaagttgcccctgaccaaagccaaaagatacttggaagatgttttggcccacaaacaggctattcctttcagacgcttctgtcgtggtgttggaaggactgcccaagcaaagaacagacattctaatgggcaagggcgttggcctgtcaagtcagctaaattcattcttgacttgcttaagaatgctgagagtaatgctgaagtgaaaggtttggatgtggatgctctctacgtgtcccatgtccaggtcaatcaagctcaaaagcaaagaagacgtacctacagggctcatggaagaatcaatccctacatgtcatctccttgccacatcgagctgatactatctgagaaggaagagactgtccagaaagagcccgagacccagttggcaacaaacaagaagaagtctcaagctgttcgaagtggtgcttcatcataaattgttattggaggcaatagttgagaccctttatttatagattatgtcagttttgttgcactttctcagttatgtttgttatgagctgtttttgaagtttgagcagcagtttttgtttcgtattcaactatggtttatgttaattgacttgcttggaaaattctatggttttaattgcatgattgatttaagttttgtttacctgggtctcg

SEQ ID NO: 1391 - DNA, 819 bp, Rosa hybrid cultivar
atttcggacttccctaaacgtagaagaagctcttcttctgccgccgagcaactgaaaatggtgaagtactccaaggagcctgataatcccaccaagtcctgcaaggccagaggctcggatctgagagttcatttcaagaacacgagagagaccgcacaggccatcaggaagttgcgattggcgaaggcgaagagttacttggaagatgttttagctcacaagcaagccattccctttcgccggttttgccgtggtgttggtcgaactgctcaggcaaagaaccgccattcaaatggtcaaggacgctggcctgttaagtctgccaagtttgttctcgatttgctcaagaatgctgagagcaatgctgaggtgaaagggctggatgtggattcgctttatgtctctcacattcaggtcaaccaggctatgaaacaaaggcgtcgcacatatcgtgctcatgggagaatcaacccttatatgtcatctccttgccatattgagttgactttgtcagagaaagaagaggcagtgaaaaaagagcctgacactcaattggctccccggaaatcaaggaaaggtcaagccctacacagcggtgcatcttcttgagatgtttggtccaaagagtttagaagtcgtttgctatattatccacttggtatttcctagaatatctcagttttcagatatttattgatcaagaattttgtcactgaatattgtttatcaacttttcgtttcatgtcatgtgtggatgaaactcttagcctttatggttcctgcgtagaatgtttttcaaattttgaatcctagtctggg

SEQ ID NO: 1392 - DNA, 1261 bp, Malus domestica
gcaaggcgtaaaccctttcgctgaggcagaagccccgtcagccgccatggtgaagtactcaagagagcccgacaatatcaccaagtcttgcaaagcaagaggctctgacctgagggttcatttcaagaacacaagggaaactgcatttgctatcagaaagttgcccttggtcaaggcaaagcgatatttggaggatgttctggctcacaagcaggccattcccttccgtcgtttctgccgtggtgttgggcgtactgcccaggcaaagaacaggcattccaatgggcaaggacgctggcctgtcaagtctgccaagttcatattagatttgcttaagaatgctgagagcaatgctgaagtgaagggtttggatgttgattccctgatcgtatctcatatccaggtcaaccaagcacagaagcaaaggcgccgaacctacagggctcacggaagaatcaacccatatatgtcatctccctgccatattgagctgatcctgtctgagaaggaagaacccgtcaagaaagagcctgagagccagttgacaactagcaaatcgaagaagtctgctctcagaagtgacggatttgcagagaccaaaacgtgggctgatgctgttggtaggagcgtctcagtttctcacttccgtgccttcgtacgttggtctgttcgcaggttgcagaggaaggagttgttacctaagagttcatttcaagatggattggcaagggcagaagctagccgagcagctgatgcagatactgctactggtcttcgccgttgtgggtttcgccaccggttacataaccggatcgttccagatgatgactctgacttacgctggtggcgtggttctcacgacattggtcaccgtccccaattggcccttcttcaatcgccaccccctcaagtggttggacccgagcgaagccgagaagcatcccaagccgcagccgcagccgcagcagcactcgacctcgaagaagaaatcctccaagaagtaagaagtaggtcagttttttcgagactgatcacatcaatggatttaatgagatattaacattgttctgagactgatagtttcagcagttatacaatgagactaaaagagattttcttggtatttgctgctgcgtttatgtgatctcgttttaattgtttggttttctgattcagaaataggaaaccctttgattttcttttgatagttcattaggtaaacattgattcaagcatgattacaagtgcaaagatctctgag

SEQ ID NO: 1393 - DNA, 925 bp, Persea americana
gattctcttgcagttgcagacagcagcaatggtgaagtattcgagagagccggaaaaccctaccaagtcctgcaaggccaggggatctgatctgagggtccacttcaagaacactagggaaactgcccatgcacttaggaagctgcctttgaccaaggctaagaggtatcttgaggatgtcatagctcacaagcaagccatccccttccgtcggttttgtagaggtgtaggacgtacagctcaagcaaagtcacgccattcgaatgggcagggccgctggcctatgaaatctgccaagttcattctggacttgctaaaaaatgcggagagtaatgcagatgtaaaaggtttggatacggatactctgttcatctctcacattcaggtaaatcaagcacagaagcagaggcgcaggacgtatcgtgctcatggaagaattaacccctatatgtcatcaccatgtcacattgagttgattttgtctgagaaggaagagtctgtaaagaaggagcctgagacacagttggctcccaggaagaccaagaaagctaaagcacttcgcagtggcacctcttcttgaaaccatttcaaggatttcctttttcccccctcttattaagcaaagaacaagaatagtaggttcagttttatattctctccatttcatggaattgttaagattatggtggtttccatccggagaatacttttttgtttcatttgagtgcatgtatttggataatgttttggcctttataggagacctcaattgattcggttttcgacgcatgggcatttaatttcctttattgcaaggtagaatttagggaaaaaaacctttttctggaacgttctaattgaatccttagaaactggcgattgtgaatggcgtctctgatgttgaaaaaaaaaaaaaaaaaactcg

SEQ ID NO: 1394 - DNA, 3342 bp, Brassica napus
actacaacccgtcgtgtttatgatactgctgctcagcaagttgttagtggggctatgtctggaataaatggtactgtgtttgcttatggagttactagcagtggcaagactcacacaatgcatggggagcaaaggtcacctggaataattccgttggctgtaaaggatgtattcagcattattcaggagacaccagaacgggaatttcttctgcgtgtttcatatcttgagatatacaatgaggttattaatgacttactagacccaacagggcagaatctacgaatacgagaggattctcagggcacatatgttgaaggcattaaagatgaggttgtcttatccccagctcatgctctatccctcatagcatctggtgaagaacacaggcatgttggttcaaataatgtcaatctttttagcagtcggagccacacaatgttcaccttgactattgaaagcagtccacatggaaagggagatgatggagaagatgttactctctctcagttgcacctcattgatcttgctggatctgaaagttctaaatctgaaatgactggacaacggaggaaagagggatcttccatcaacaaaagtttactcaccctgggaactgtcatatctaaattgacagactccaaggcagctcatataccgtacagggattctaaacttactcgtctcttgcagtcaacacttagtggtcacggactagtatcacttatttgcactataacacctgcatccagtacaagtgaagagacgcacaacacactgaaattcgctcagaggtgcaagcatgttgaaatcaaagcctcgcgaaataagattatggatgagaagtccctaataaagaagtatcagaaagaaatatcatgtttgcaagaagaacttacgcaattgaagcacggggtttctatgtctacgtctaaccaagaagatttggctgatcgaaaacttcaggttaaaccccagttaaggttggaggaggaggaggatgaagccaaagcagctctgatgggaagaattcagcgtttgacaaaactaatcttggtttcaacaaaaagttccctgcaaggaaaagcttctgtaaaacctgaccatatatggaggcatactttcggagaggaagagctagcttacttgcccgatagaagaagggagaacatggctgatgataatgctagaagcacagtttctgaacattccagggagccgagagatggtggaactagtggcctggatgagatgacaaaggaccggaaaaagaataagactcgtggaggaatgcttggctggctgaaactgaaaaaatctgatggtgtggctgggacattactgactgatggtaaccagaactctacaaatggatctgcttcttcttcctcgaagtgcgcacaaacaaaatcaaccaggagagataaagcagcaacaaacaagtcttttccagaaagaactgtggccgaagacttattcagtgcagctgttggatcaggagacccttctctgattgcaactactattgcggatcaaatggatcttcttcacgagcaaacaaaaatactagttggggaagtagcattgcgtaccagttcattgaaaaggctttccgaacaagctgctcgcaaccctgaagatttccatatcagagatcaaatgcaaaaactggaagatgaaatcagcgaaaagaagaatcaaatacgtgcactcgagcaacagatgattgaaagtttcggaatgagtcataccacagactctcttggaatgtcccaggttttgtcaaagctcacaacgcaactaaatgagaaaatcttcgaacatgagataaagtctgcagacaataggatacttcaggagcagctcgagataactaaatcagagaaggctgagatgcaggagacaatcatgctgctaaggcaacaactggattcattagccgagagacaatcaacatatacacagcagcagaacggagcagacgaatcagcaggaaggaatactcacaacagaaatggtgatgagttgtcagaaatctattctggagcaggaacaccgaccagcgtgatgagcttaaatagagtttttgctcaggaagagactaaagatatcaaaaacggaacaaccctcaactctcaggctttggaaatagagaatctgaagaaggagaatatgagactgattgaggaaaaagatgagctcggaaaacttaataacaaactcacagaggaagcctcttatgctaaagaattggcgtctgctgcagcagtagagctccagaatttggctgaagaagttactagactctgcaatgaaaatgcaaaactgagcaagtgaaaaagctccagagactccagcattcaagataatgctgcaaagtagagatcatcttcattgaactataatgcaaatctcagactagttgaatgcttctgatgcttcaaaggagcaatgatgttcttggagaatatgatgcttctatctcccaaaagacattcatctgtctttgaatctaattctaatggctgagatgacaaacaaatgatgtaaatattctcacaaatttgttttcttgctatttgtgactactgctttttgtatgttcacttcttagttcgaaccgacgatgttgcaacgagaccaacgattagtttttcagctcaactttattggctataaaaaaaaaaggccgccatggtgaagtactcacaagaaccagacaataccaccaaatcttgcaaggcaaggggagccgatctcagggtccacttcaagaacactagggagacagcgcatgcgataagaaagctaccattgaacaaggcgaaaaggtacttggaagatgtgatagctcacaagcaagctatccccttcacacgtttctgccgcggtgttggacgtactgctcaagcaaaaaacagacattcaaacggtcaaggtcgttggcctgctaaatctgctcagttcgttcttgatcttctcaagaatgctgagagcaatgctgaggtgaaaggtttggatgtagatgcccttttcatatcacacatccaagtgaaccaagcagcaaaacagaggcggagaacataccgtgctcacggaagaatcaacccttacatgtcaaacccatgtcacattgagttgattctttcagagaaagaggagcctgtgaagaaagagccggagactcagttggcagcgaagtcaaagaagggaacctcgtcttgatccttatagacttgtagttaccattatcacttcgtgttacagcgcttggtacattttgttcactttctgtaagacatgtaaccaaaattttaaaacacttaatgaagattagttttt

SEQ ID NO: 1395 - DNA, 898 bp, Manihot esculenta
ttagggttttgatcgtttgtttcttataaaggggatcgctaacgcctcttctctttcgttggaggaagcacatcttgaacatccctagggcagaaacatggtgaagtactccagagagcctgaaaattccaccaagtcctgcaaggccagaggctctgacctcagagtgcacttcaagaatacaagagagacagcccatgccttgaggaagttacctttggcaaaggccaagaggtatttggaagatgttatggctcacaaacaagctatacctttccgacgtttctgtcgtggtgtgggacgtactgctcaggcgaagaacagacactcaaatgggcaaggaaggtggcctgttaaatccgccaagttcatactagacttgctcaagaatgctgagagtaatgctgaggtcaaaggcttggatgtcgatgccctcttcgtttctcacatccaagtgaatcaggcacagaagcagaggcgccgaacctacagggctcatggaagaattaatccttacatgtctagcccttgccacattgagttgattttgtccgagaaggaagaaccggtcaagaaggagcctgagacacagctggctaccagcaagtctaagaagtcccaagccatatgaaccgggctcttgaacaattttccgatgttcatctttttcttttttttttttttaaatttgagagattttggtggctcttcataaatgagcaggttacttggttgaattggacagcttgttcgtctgttttaatttctagttaattgttctgagatatttctcttttcgtcatactaatagttttccgtattgggttagctacctccattttgttttgttgttcaagaaaacgcaatgagtataatataatttatttttacaattgac

SEQ ID NO: 1396 - DNA, 1056 bp, Cedrus atlantica
ggtgaaatactcgagggagcccggcaatcccaccaaatctgcgaaggctaggggttccgatttgcgtgttcattttaagaacacaagagaaactgcacaggcagttaagaggctacctttagtcaaggctaagaggtatctggaggatgtaattgcccacaaacaagccataccctttcgcaggttttgtggaggtgtagggagaaccgcccaagcaaagtctcgaaattcaaatggacagggtcgctggcctgtcaagtcagctgaattcttgttaggtttacttaaaaatgcagagagcaatgctgaggtaaaagggcttgatgtggatacgctttatatttctcacattcaagtgaaccaggctcaaaagcagcggagacgcacctaccgtgcccatggaagaatcaatccttatatgtcatcaccatgtcacattgagttgatattggctgaaaaggaagcaccggtcaaaaaagaggcagaaactcaaattgctccaaggaaaccaaggaaagcacaaatgcttcgaagtggtgcgtcatcctgagatgctgaagcaatttgaatttgagcacaccaatgccatatttttaacagaaaccatttctggtttattttgtagtgatgggaggaaactacacccatttttgtttactggcatattatggattgtagacaaacattttactatttaaaactttagtttaattcatgttattgttggtttgtgtgattcacggctgctgttgtcagcctggtaagcatacaaaagtgaaggaaagctttgctccttgtgttttacatggcataaaactctggatggtttatgtgatcctcaaggtaatgaaaattaaaagacttattttcatacataccatgaggacttatctgcaaggctgtctggggaatgaaggttcaggttcagttgacaggtccaccggatggtagttgtcaacgtttgacttttgttagatagttcgccatgaaacgtctcttgaaattttgggttatgctaattttttaattaattatggttttgctgtttagttaaac

SEQ ID NO: 1397 - DNA, 894 bp, Gossypium hirsutum
gctggagctcgcccgcctgcaggtcgactccaaacccaaaagcgaattcggcacgagccttttccaagcactcttgagcagcaacagaggcttcattcagatcacatatcagcagccatggtgaagtattcgaaggaacccgataatcccaccaaatcctgcaaggcaaggggctctgatcttagggttcatttcaagaacacaagggagacagctttcgccattagaaagttgccattggttaaggctaaaaggtatttggaggatgttattgcccacaagcaagccataccgttccgacgcttttgtggtggtgttggacgtacggcacaagcaaagaacaggcattctaacggacaaggtcgctggcctgtaaaatcggctaagttcattctagatttgctgaagaatgctgagagtaatgccgaggttaagggtttagacgtcgatgcactccatatttctcacatccaggttaaccaggcccaaaaacaaaggcgtcgtacttaccgagctcatggaagaatcaacccttacatgtcctctccttgccacattgagttgattttgtccgagaaggaagaacctgtcaaaaaagagcctgagactcaattggcagcaagcaagtccaagaagtcccaagcttcttcttgagtgaacaaagtttgaaactttatcaagtcagttaatgtagtgatttctggtctttggatttcatacattatttttgaagtttttgacattaagatgtgttggatggttttttatttcaaagcatgttttagtcaaatgttgtcttgagttatgtttttcttggagattttgtctcaattacagtgttctatgttatgtttcatttatatgacttttaatataaaacaaggttcgttaatt

SEQ ID NO: 1398 - DNA, 923 bp, Gossypium hirsutum
ctttgatattgctaggcagacccccagttgaagcactcttgagcagcaacagaggcttcattcagatcacatatcagcagccatggcgatcgtttttccttcaatcgcttccttaatttcaattctaaattttttttcccttttatattatcattaaaaacaatattgttttgaatcgttttgcaggtgaagtattcgaaggaacccgataatcccaccaaatcctgcaaggcaaggggctctgatcttagggttcatttcaagaacacaagggagacagctttcgccattagaaagttgccattggttaaggctaaaaggtatttggaggatgttatggcccacaagcaagccataccgttccgacgcttttgtggtggtgttggacgtacggcacaagcaaagaacaggcattctaacggacaaggtcgctggcctgtaaaatcggctaagttcattctagatttgctgaagaatgctgagagtaatgccgaggttaagggtttagacgtcgatgcactccatatttctcacatccaggttaaccaggcccaaaaacaaaggcgtcgtacttaccgagctcatggaagaatcaacccttacatgtcctctccttgccacattgagttgattttgtccgagaaggaagaacctgtcaaaaaagagcctgacactcaattggcagcaagcaagtccaagaagtcccaagcttcttcttgagtgaacaaagtttgaaactttatcaagtcagttaatgtagtgatttctggtctttggatttcatacattatttttgaagtttttgacattaagatgtgttggatggttttttatttcaaagcatgttttagtcaaatgttgtcttgagttttgtttttcttggagattttgtctcaattacaatgttctatgttatgtttcat

SEQ ID NO: 1399 - DNA, 778 bp, Gossypium hirsutum
gcagcaaccatggtgaagtattcaagagaaccggacaaccatactaaatcttgcaaagctaggggttctgaccttcgtgttcattttaagaatacacgagaaactgcctttgccatccgaaagctacctttgacaaaggcaaagagatacttggaggatgttattgcccacaagcaagcaattccgtttcggcgcttctgtggtggagttgggcgaaccgcacaggctaagaatcgccattctaatggacaaggtcgctggcctgtgaaatctgcaaaattcattctcgatttgctcaagaacgctgagagcaatgccgaggtgaaaggtttggatgtagactcacttatcatttctcacgtccaagtgaaccaagcacagaagcaaaggcgccgaacatatcgtgcacatggaaggattaacccctacatgtcttcaccgtgtcacattgaactgatactgtcagagaaagaggaacctgtgaaaaagagcctgagactcagttggctccgaggaaatcgaagggtgcttcatcttaaattgctgagcggtggattataacttggaaactattacatttttctttagttgtctctgtaatgagaacatttttgtttccttcacaatgaggtgtttaagactcaaagtttgtctatggagattcttggttctatggtgattttgcttgtaatacttaagtagctcgtaaacctgattaagttctatatttgtattcttatttttatcgattctttaaaatattcaaacttaagcttga

SEQ ID NO: 1400 - DNA, 947 bp, Cucurbita pepo
gggtttctctactataagaaactcgaatttcgtcttcctagtactcttgcttgcaggaggactcaatctggttcagagaggtgaagatttagcatccgccgccatggttaagtactcaagggagccggataacatcaccaagtcctgcaaagctcgaggctccgacctcagagtccatttcaagaatactagagagactgcacacgcccttaggaagttgcccttggccaaggcaaagaggtatttggaggatgttcttgcccacaagcaggctattccattccgacgtttctgtggaggagtaggacgaactgcacaggccaaaaataggcactcaaatggtcaaggacgatggcctgttaagtctgcaaaattcattctagatcttcttaagaatgccgagagtaatgccgaagtgaaaggactggacgttgattctctcattgtatcccacatccaggtgaatcaagcacaaaaacaaagacgtcgtacctatcgtgctcacggaagaattaacccctatatgtcatctccatgccacatcgagcttattttgtccgaaaaggaagaacctgtgaagaaagagcctgagacccagttggcaacgagtaaaagcaagaagggtcaagctctccgcagtggtgcttcatcctgatccaatattattgccgcattttgtacttctttttggttttaaagcagagtttggttgcttaagtcaaatattagaacgagttgagttgttcggtatccaatgcctcttaactttgtagtttatggaatcctcgatcaagttcattttggatttttattcctttttatgccaacagttctacaaatcatttcttcttttttactcatccattctttatcatcgactcaggtgactttgttcgggattctttcaccgtaaaaatttgataattaatggcaaggtagttgattgc

SEQ ID NO: 1401 - DNA, 1108 bp, Cycas rumphii
gggagaggagaggtgaggccgagagaaaggagcgaccggttagatcagcggcaaccatggttaaatactcaagagagcccgataatccgactaagtcttgcaaggctcgggggtcggatttacgagttcattttaagaatacaagggaaactgctcaggctattaagaagctacctttggccaaggctaagaggtatcttgaggatgttcttgttcacaaacaagcaatacccttccgtcgcttttgtggaggagtaggtcggactgcccaagcgaagtctcggcattctaatggccagggccgttggcctgtcaagtctgcaaaatttttgctagatttactaaaaaatgctgagagtaatgctgaggtcaagggtcttgatgtggatacacttttcatttctcacatccaagtcaaccaggctcagaagcagcggagacgtacataccgtgctcatggaagaatcaatccatatatgtcatccccatgtcacattgagttaatattgtctgaaaaagaggcaccagtcaaaaaagaggctgaaactcaaattgctccaaggaagtcaaagaaagctcaaactcttcgtagtggcacctcgtcttgagttgctacagaagtttcaatgtcatcatggcatcaccatttttttttggcaagggaggaaagcctttgttttgaggcatgcctttgtagagaactgtgtctgcttttgtttactgccagtttttttatgctgttgatggaacctttttattttaggatttagatagtttgatttgcactgctatcttgattccatttgatttggcggcaatgctattataatgccagtcaggatgttaagcatacagaagtgagggaaggctttgctattgtgtcttgcattatacagagctctggatagtttatgggagcctcaaggtaatgaaaattaaaataggcttattttttgtgcataccatggggacttgtctgaaaggctatctggggaatgaaggttcaggttcagttcacagatcgaccagaaaacagttgtcaagatattgacttttattggatagttataactgtcttacatttatcaaaatgtcaggtcttgtgtcc

SEQ ID NO: 1402 - DNA, 762 bp, Eschscholzia californica
agtattcgaaggagcccgacaaccctaccaagtcttgcaaggccagaggggcagatcttagagttcattttaagaacacaagggagacagctttttccattagaaaattgcctctcgtcaaagctaagaggtatttagaagatgtgttagctcacaaacaagcaattcccttccgacgcttctgtggtggtgttggtaggactgctcaagcaaagaaccgtcactcaaatggccaaggacgatggcctgcaaaatctgccaagtttatccttgatttgctaaaaaatgctgagagcaatgctgatgtgaaaggtttggacgtggattctctttacatttctcacatccaagttaaccaagcccaaaagcaaagacgtaggacataccgtgctcacggaagaatcaacccttatatgtcatctccttgccacattgagttaactttgtctgaaaaggaagaagcagttaagaaagaggctgacactcaattggcaccaaggaaatcaaagaaaggtcaagttcttcgcagtggtgcatcatcttaagactagagttgaggaatagagtagtagagttggtgcagtccaagtctttcttcctttttttggtgtttgaataccttttcattgctttcttagatctttgttttatgacataaagattcttgacttccgtttttttaccaagtggtaatggattttggtttgagggatttggtaaccatatggggaacaagtttgttattttcatctaccaaaaaaa

SEQ ID NO: 1403 - DNA, 1046 bp, Euonymus alatus
gccagggttttgatttcgtactcttcagctgcagaccagtggaattctcttgctgcgcttcatctttggctgggaatcgaaatatttcagaggcggcagccatggtgaagtactcgagagagccaaacaaccctaccaagtcctgcaaagccaggggcagtgagcttcgggttcattttaagaatactagagagaccgcccaggctattaggaagttggctttggtcaaggctaaaaggtacttggaggatgtgattgcccataagcaagctattccctttaggcgtttctgtcgcggtgtgggacgaactgctcaggcaaagaaccgtcactcaaacggacaaggacgctggcctatgaagtctgctaattttattcttgatttgctcaagaatgctgagagcaatgctgaggtgaaaggtttggatgtggatgctctttatgtttctcacatccaagtaaatcaagcacagaagcaaaggcgacggacatacagagcacatgggcggatcaacccatacatgtcttcaccttgccacattgaattgattctatcggagaaggaagaatctgttcagaaagagcctgagactcagttggctccaaggaaggctaaaggtcaagctcttcgtagtggtgcatcctcttaaacagctgcagagttctaggctgattcaggagtccacatcataagaaagttccagctttgctactttgttaaaaatactctcaactcgagttttcatcatgggatgctcatgaattttggatgttaggctattataactaatttaaattcttaatgctctgttaaacttgaggtgcttgttaatgcttttgaatagtaagactgcgctgctgctagacagtggtagtgtacctagtggtaggacagcatggttcgtaccggttcctgcttctctacatgatgctgagttataatttttggttctctatatgctatgttcaaggccgttatattgcatgtgttcgcaagtaaatcgcttcacagaactcgcgctaccgttcaatgcaattgttgattg

SEQ ID NO: 1404 - DNA, 956 bp, Euonymus alatus
gccagggttttgatttcgtactcttcagctgcaggaccagtggaattctctggctgcgcttcatctttggctgggaatcgaaatatctcagaggcggcagccatggtgaagtactcgagagagccaaacaaccctaccaagtcctgcaaagccaggggcagtgagcttcgggttcattttaagaatactagagagactgcccaggctattaggaagttggctttggtcaaggctaaaaggtacttggaggatgtgattgcccataagcaagctattccctttaggcgtttctgtcgcggtgtgggacgaactgctcaggcaaagaaccgtcactcaaacggacaaggacgctggcctatgaagtctgctaattttattcttgatttgctcaagaatgctgagagcaatgctgaggtgaaaggtttggatgtggatgttctttatgtttctcacatccaagtaaatcaagcacagaagcaaaggcgacggacatacagagcacatgggcggatcaacccatacatgtcttcaccttgccacattgaattgattctatcggagaaggaagaatctgttcagaaagagcctgagactcagttggctccaaggaaggctaaaggtcaagctcttcgtagtggtgcatcctcttaaacagctgcagagttctaggctgattcaagagtccacgtcataagaaagttccagctttccttctttgttaaaaatactctcaactcgagttttcatcatgggatgctcatgaattttggatgttaggctattataactaatttaaattcttaatgctctgttaaacttgaggtgcttgttaatgcttttgaatagtaagaatgcgctgctgctagacagtggtagtgtacctagtggtaggacagcatggttcgtaccggttcttggttctctacatgatgctgagttataatttttggttctac

SEQ ID NO: 1405 - DNA, 769 bp, Euphorbia peplus
attctaacagccgtcatggtgaagtactcaagagaccccgataattccaccaagtcctgcaaggctaggggctctgaccttagggttcacttcaagaacaccagggagacagcgtttgccttgagaaagctccctttggccaaggccaaaaggtacttagaagatgttatggctcacaagcaagccatacccttccgacgtttttgtggtggtgttggacgtacagctcaagcaaaaagcaggcactctaatggtcaaggacgctggcccgcaaagtctgccaaatttattctagatttgctcaagaacgctgagagcaatgctgaggttaaaggattggatgtggagaacctctacattactcacatccaggtgaatcaggcacaaaagcagaggcgtcgtacctacagggctcacggaagaattaacccttacatgtctagcccttgccacattgagttgattttgtctgagaaggaagaatcagttcagaaggagcctgagacccagttggcgactagcaaatccaagaagcctcaagctgtaagaacaggtgcttctgcctgagtgttggttagtgattgaccgatcaaaggagaagttttgaattgcatactctgtatttctgaggaattttgtttgttctcgttttagaatgatatgctacttagatgaattgaacagattgtgtgtttgttttgacctatgtttagttaattgttctgagattatccttgacaatttatatggatacttttctttgcagagt

SEQ ID NO: 1406 - DNA, 912 bp, Vitis vinifera
ggattcagtcttccatctcccgcaaccctagcagcaggagcagaagaagaagctgtagcagcagccatggtgaagtattcgagagaaccagacaatcccaccaagtcctgcaaagccaggggttccgatcttagagtccatttcaagaacacccgtgagaccgcccatgctatccgtaagttgcatttgaccaaggctaaaaggtatttggaggatgttcttgcccacaaacaagccattccattccaacgcttctgccgtggagttgggcgcactgctcaggcaaagaaccgccattctaatggacaaggacgctggcctgtcaaatctgcaaaatttattctggatttactcaagaatgctgagagcaatgcagatttgaaaggcttggatgtggattctctttacgtatctcacatccaggtaaaccaagctcagaagcaaaggcgccgcacataccgtgctcatggaagaattaacccttacatgtcatctccctgccatattgagttgattttgtctgaaaaagaagagcctgttcaaaaagagcctgacactcagttggctcctaggaaaacaaagaagactcaagctctacggagtggtgcatcctcttgaacaacatggtggtaggctgtgattcaggaactgcagagtctcactctttatctgtttaaattggtagattgtgattcataagaacaattttgtttggcttatttgaaattgttaggttaatcgtctctgagataatatcatttccttttggagttcatttgagaattggatttttatcagctattaaacccttttcacaccttggatttcacatgtttttccatgtagttcacaatggttttcatggtggtggttttatggtagaatatactagtgttgcacaggtacttcaag

SEQ ID NO: 1407 - DNA, 628 bp, Guizotia abyssinica
attacattcttcggtctcacagtactatcgccggcgacgccatcatcctcagcagtcatggtgaagtactcaaaggaaccagaaaaccctaccaaatcttgcaaggccaggggatcagatctcaggtgccatttcaagaacactcgtgaaaccgcccatgctatccgtaagttgcctttaatcaaggctaagagatacttggaagatgtcttggcccacaagcaagccattccattcacccgcttttgtcgtggggttggacgtactgcacaagctaaaaaccgtcactccaatggacaaggacgttggcccgctaagtctgcaaagtttattcttgatctgctgaaaaatgccgagagtaacgcagaagttaaagggttggatgtggatgctcttcacatttctcacatccaggttaaccaagcacagaaacagagacgtcgcacataccgtgctcatggaagaatcaacccttacatgtcttctccttgccatattgaactcactttgtctgagaaagaagaacctgttaagaaggagcctgagacacagttggctcctagaaccaagaagactaagcttaggtcaggggtgcattcgcatgaaggagactcgtaatttcttggta

SEQ ID NO: 1408 - DNA, 904 bp, Quercus alba
ctctataataagactcttaacgcctcctctttctttctcttcctctgcaagagctaacccatctaaacaattccaagagcttcactcagaggcgcacagatcagccgccatggtgaagtactccagagaacccgacaatcccaccaaatcctgcaaggccaggggttcagaccttagggttcatttcaagaacactagagagacagcatttgccatcaggaagttgccattggtaaaggccaagaggtatttggaggatgttctggcccacaaacaggccatcccctttagacgcttctgtcgtggtgttggacgtactgctcaggcaaagaacaggcactctaatggacaaggacgctggcctgttaagtctgctaaattcatcctagatttgctcaagaatgcagagagtaatgctgaagtgaagggtttggatgttgattcactcttcgtctctcacattcaagtgaaccaagcacagaagcaacggcgtcgtacctaccgtgctcatggaagaatcaacccctacatgtcgtctccttgccacattgagctggttttgtccgagaaggaagaacctgtgaagaaagagcccgagtcccagttgacaactagcaaatcaaagaagtctcatgctttacgtagtggtgcttcgtcttgagtggctggtgttgtagaactgataattgaatggccatctcgagtttcttgctgctgcccttttgcctgtcaatggggagttttgttgcttgtcgtatagaatgagctgttatttagattatttggacggcttgttgtttttttcaaactatatttagtcttaagtgaaatttttcttgaagattttgtgattggaagcctaagaatgcaggagtttatatacattgttatttttattagatgc

SEQ ID NO: 1409 - DNA, 1194 bp, Pinus taeda
gacgagaggcgaggcgaggcgaggagagagaagcagagaggagcagaggtcggtgaggccgcagccatggttaaatactcgagggagcccggcaatcccaccaaatctgcgaaggcgagagggtctgatttacgtgttcattttaagaatacaagagaaactgcacaggcagttaagaagctacctctaggtaaggctaagaggtatctggaggatgtaattgtccacaaacaagcaataccctttcgccgcttttgtggaggtgtgggcagaactgcccaagcgaagtctcgaaattctaatggacagggtcgctggcctgtcaagtcagctgaatttttgttaggtttacttaaaaatgcagagagcaatgctgaggtaaaggggcttgatgttgatacactttatatttctcacattcaagtgaaccaggctcagaagcagcgaagacgaacataccgtgcccatggaagaatcaatccttatatgtcatcaccatgtcacattgagctgatattgtctgaaaaggaagcacccgtcaaaaaagaggttgaaactcaaattgctccaaggaaaccaaggaaagcacaaacacttcgaagtggtgcctcatcttaagatgctgaggcagtttgaatttgagcacaccaatgacatatatttaacagaaaccttatctcgtttatttttttgagtgactggaggaaactacacccgtttttgttaactggcatagtatgaattgtagacaaacattttcctattgaaaacttttattcatgttattgttgctttgtgtgatttactggctgctgttaatgtgcaactcggcctggtaagcatacaaaagtgaaggaaagctttgcttctattgttttacatgggcataagactctggatggtttatgtgatcctcaaggtgacgaaaattaaaagacttattttcatgcataccatgaggacttctctgcaaggctgtctggggaatgaaggttcgggttcagttgacaggccaccagatgggaggtgtcgacgtttgacttttgttagatagttcattatgatgtatttcttgatattttggtttatgctctttttaattttttttatttaatttttttgaatttttgctaccagtgttgagtccatgattaatgcgttttagtaccgattgacaggaaaaaaaaaaaaaaa

SEQ ID NO: 1410 - DNA, 1115 bp, Pseudotsuga menziesii
tggggcggggcgaagcgaggctggggagaggcaaggagacgagtaaagaggagaggagcagaggctgtcgaggctgcagccatggtgaaatactcgagggagcctggcaattccaccaaatctgcgaaggctaggggttctgatttacgtgttcattttaagaacacgagagaaactgcacaggcagttaagaagctacctctagccaaggctaagaggtatctggaggatgtaattgcccacaaacaagcaataccctttcgccgcttctgtggaggcgttggcagaactgcccaagcaaagagtcgaaattcaaatggacagggtcgctggcctgtcaagtcagctgagtttttgttaggcttacttaaaaatgcagagagcaatgctgaggtgaaggggcttgatgtggatactctttatatttctcacattcaagtgaaccaggctcagaagcagcggagacgaacataccgtgcccatggaagaatcaatccttatatgtcatcaccatgtcacattgagttgatattgtctgaaaaggaggcacctgtcaaaaaagaggccgaaacacaaattgctccaaggaaaccagggaaagctcaatcacttcgaagtggtgcctcctcttgagatgctgaagcagtttggatttgagcaaaccaatgctatatttttaattgaaaccttgtctggttttctttgtagtgactagaggaaactgcaccccctttttgtttactggcatattattggattgcaggcgaacattttcctatttaaaactctactttaattcatgttattgttgctttgtgtgatttactggctgctgttagaatgcaagtcagcctggtaaacatacaaatgtgaggaaagctttgcttcttatgtttgacatggcataaaactctggatggtttatgtgatcctcaaggtaacgaaaattaaaggacttgttttcatgcataccatgaggacttttctgcaaggctgtctggggaatgaaggttcaggttcagttgacaggtcctccaccagatgggaggagttgtcaacttttgacttctgttagatagttcaccgtgatacatttcttgaaattttggtttatg

SEQ ID NO: 1411 - DNA, 832 bp, Rosa hybrid cultivar
ggagtttcgctccatttcggacttccctaaacgtagaagaagctcttcttctgccgccgagcaactgaaaatggtgaagtactccaaggagcctgataatcccaccaagtcctgcaaggccagaggctcggatctgagagttcatttcaagaacacgagagagaccgcacaggccatcaggaagttgcgattggcgaaggcgaagagttacttggaagatgttttagctcacaagcaagccattccctttcgccggttttgccgtggtgttggtcgaactgctcaggcaaagaaccgccattcaaatggtcaaggacgctggcctgttaagtctgccaagtttgttctcgatttgctcaagaatgctgagagcaatgctgaggtgaaagggctggatgtggattcgctttatgtctctcacattcaggtcaaccaggctatgaaacaaaggcgtcgcacatatcgtgctcatgggagaatcaacccttatatgtcatctccttgccatattgagttgactttgtcagagaaagaagaggcagtgaaaaaagagcctgacactcaattggctccccggaaatcaaggaaaggtcaagccctacacagcggtgcatcttcttgagatgtttggtccaaagagtttagaagtcgtttgctatattatccacttggtatttcctagaatatctcagttttcagatatttattgatcaagaattttgtcactgaatattgtttatcaacttttcgtttcatgtcatgtgtggatgaaactcttagcctttatggttcctgcgtagaatgtttttcaaattttgaatcctagtctggg

SEQ ID NO: 1412 - DNA, 953 bp, Fragaria vesca
ggcagctaggaagggagatcgaagaagaagctgaagcagcagcagccatggtgaactattcgcaagagcctggtaacattaccaagtcctgcaaggccagaggcagcgatctccgagttcatttcaagaacacaagggagactgcccatgcacttcgcaagatgcctttggtcaaggccaaaaggtatctggaggatgttttggtccataagcaggccattccattcactcgattttgtcgtggagtaggacgaactgctcaggccaagaatcgccattcaaatggacagggtcggtggcctgctaagtctgccaaattcattctggacttgcttaagaatgccgagagtaatgcagaggtgaaaggtttagatgtggattcgctcttcatatctcatatccaggtgaaccaagccagaaagcagaggcgtcgcacataccgtgctcatggaagaattaatgcttacatgtcatctccatgccatattgagttaattttgtcagaaaaggaggagcctgtcaagaaagaggctgagactcagctcgctagtaggaaaacagggaagactagagctgtcgcagtttgagatgcttcaaatcctatctcttttatttgttaggtgctatcttttttttttcagaaatgcattctgttttgttttatcgagtaactctgcttcagcttgagtgaattgtgaaactcattcagacttcatcaggcattggaaccaattaggcttgaggattacaacaatttgattttgaaattggattggtctcatacaatatgcctaatttttgttttttcctccgttaaggattagggtatcatgcttgatgcttctacaatgcgttgataatgatttgtggatgatgataattatcaaattttccagactatcatggatcaattatcaccacaaagcatggatgtggttgttcctaggcctggt

SEQ ID NO: 1413 - DNA, 830 bp, Camellia sinensis
acgcaatccacgctgttctccacgcagaagcagcaatcatggtgaaatactcgaaagagccggacaatcccaccaagtcttgcaaagctaggggctccgatctcagggttcatttcaagaacacaagggagacagcgtatgccatcaggaagctacctttgaccaaggctaaaaggtatttagaagatgttctggctcacaagcaggctattccctttacacgcttttgtcggggtgtgggtcgaactgcccaggcaaagaacagacattctaatggacaaggacgctggcctgtcaaatctgcaggcttcatacttgacttgcttaaaaatgctgagagtaatgccgaggtgaaaggtttggatgtggatacactttacatatctcacattcaggtgaatcaggcacagaagcagagacgccgcacataccgtgctcatggaagaataaacccttacatgtcttccccatgccatattgagttaatcttgtccgagaaggaagagccagtaaaaaaggagcctgagtctcagttgacaactagcaaatccaggaagtctcaagctctgcgaagtggtgcatcctcttaaacagctttgatagaaccagcagagtttaagaagttttattgtctctttctatgcatttctattgtctctcagtactgttttccatttttcattattgatcttttacttgagaggatatatgtatggcttgctttgttgcaaccaaaatgctatttagtcaaattgcattttgtttggagatttcttgataaaacatagttgatttcctttttgaatgtcacttctgatggatgcatgggc

SEQ ID NO: 1414 - DNA, 909 bp, Valeriana officinalis
ctctaggttgggcagcaagaagacggtaagaacctgtggaaggcggcagatatggtgaagtattccagggaagccgacaatccgaccaagtcttgcaaagctagaggtgctgatctcaggtgtcattttaagaatacaagagagacagcgcacgcaattcgcaagctgccattgaccaaggctaaaagatacctggaggacgttcttgtccacaaacaagccattcccttcaccagattttgccgcggtgttggtcgtactgctcaagccaagaaccgccattcaaatggacagggacgctggcctgttaaatctgctaagttcattcttgatcttctccagaatgctgagagcaatgctgaattgaaagggttggatgtggattctctttacatttctcacattcaggtaaaccaggcccagaaacagaggcgtagaacttaccgtgcccatggaagaatcaacccctatatgtcatctccatgccatattgaactgatcttgtctgagaaggaagaagcagtcaaaaaagaggccgagactcagttggctcctaggaaggcgaagaagggtcaagctctacgcagcggcgcatcatcttgattattgatatcacaattttgttcaagatatctacatattgaaccaaattttatactcttttcttcattatatcttttgttcttgagttttgacagtgttagttttcatgggatagttgatccatttaaatcttgattatgttgagcaaattctcaaaagtattatcttgatagtattattctattctatagtgctcaagtgatatgaattattgtattatttactagttttagtaagtttttctagttacttgttgaactaaataactacattcgtacctaaatcgttactctttacttagtaact

SEQ ID NO: 1415 - DNA, 1332 bp, Amborella trichopoda
ccctataaagttgtgccctaggtttactcagccgctcacccacccaccctgtcttcgcaattagctgctcagcaaaacagcagctccactgcgaaagttctctcgctctctcttcccagtaaaggagcctctcgcccagtactattcgcggccttgcaacctcaacagagagagagaattttagggtttttggattcacaaaaattcaccgctttgaggcgctcataaccctcggcttctgggggcagtcagagatcttcatttcgatcagcagtcatggtgaagtattccagggagccggacaatccaactaaatcttgcaaggccagaggatctgacctgagggttcacttcaagaacaccagggaaaccgcatttgctatcaggaagctccctttggccaaggctaagaggtatctggaggacgttcttgcccacaagcaggccatccctttccggcgcttttgtggcggtgttgggcgcactgctcaagcaaagaaccgccatccaaatggacaagggcggtggcctgtcaagtctgccaagttcatcttgaacttgctcaagagtgctgagagcaatgctgatgtgaagggcttggatgtggatacactattcatttcgcatatccaggtgaatcaggcccagaagcagaggcgacgaacttaccgtgcccatggaagaatcaacccttacatgtcctccccttgtcatattgagttgatattgtctgaaaaggaggtacctgtcaagaaagaggctgaaacccaagtggtgcccaagaggacgaagaaatctcatgctcttcgtagtggggcttcatcttaaggctttgcggagtaagagagattggtatcgcgtcaacttgaagatttactcggtgagattgacatcgtttttccttctatttgaatgctcatgtttttgcaacatttcgtcaagaattttgtggttgtataaggaccaagaatcagtcacccaatgtggagagagatcttttcttgcttgagttggctagtttgagccgtagatcatatttggttcattgttttcgcttgagtgtcttcctttctggacacccatgtccttacattgcaggcattagttaccacgaaagtgttttagaacttttgttagtaatgtgattttttcataacctactctttacccaatgttggcggcttcgttttggccaaagagaccgaaatcttttgattttcggcctagtttgaggcaaagctctagtgtatcccgcttcagcccagttcggtccgattcgggctcttcggctgaagcacaaaattgtatttaaaaaaaaaaaaattatatgtt

SEQ ID NO: 1416 - DNA, 665 bp, Acacia harpophylla
ggcggcgcgttcgtgttaaacgccttttgcctccaaagaaccaatcaattgaccgtgcccaaagcctctaactctccgcccagccgcgaaaatggtgaaatactcaagagagcctgacaattccaccaagtcttgcaaagcccgaggttcagaactcagagttcattttaagaacaaagggagacagccttcgcaatcaggaagttgcccttggtaaaggctaaaaggtatctggaagatgttattactcacaaacaagccattccctttcgacggtattgtggtggagtaggccgcactgcacaagccaaaaaccgtcattcaaatggtcaaggacgctggcctgtcaaatcagcaaagtttatccttgatctgttgaaaaatgctgaaagtaatgcagaagtgaaaggtcttgatgtagatgcactgtacatttcccacattcaggtaaatcaagctcagaagcagaggcgccgtacctaccgtgctcatgggagaattaacccatacatgtcatcaccctgccacattgagctgattttgtctgaaaaggaggagccagtcaaaaaggagcccgagacacagctggctcccaggaccaagagctcgtagactggtgggctctggctctcgttattgagatgcgtagcttcagaatggtcgcc

SEQ ID NO: 1417 - DNA, 875 bp, Citrullus lanatus
gcttatgatgtttcgatcttagcaagtatctgaattcaggttgatattcatggtcttcttaacaggttaagtactcaagggagccggataaccccaccaagtcctgcaaagcgcgaggctccgacctcagagtccatttcaagaatacacgagagactgctcatgccctcagaaagttgcccttggccaaggcaaaaagatacttggaggatgttctggctcacaagcaggctattccattccgacgtttctgtggaggtgttggacgaactgctcaggccaaaaataggcattcaaatggacaaggacgctggcctgttaaatctgcaaaatttattctagatcttcttaagaatgctgagagtaacgctgaagtgaaaggactggacgttgattctctgatcgtatcccacattcaggtgaaccaagctcaaaagcaaaggcgtcgtacataccgtgctcacggaagaattaacccctatatgtcgtctccatgccacattgagcttattttgtcagaaaaggaagaacctgtcaagaaagagcctgagacccagttggcaaccagtaaatccaagaaatctcaagctctccgcagtggtgcttcatcttgatcaatattattggtgcattaagttttttttttttttttttttccttttaaaaaacgaaggttcgttgctttgatcattatagaattgagttgttctgtatccattgcccccaactttgtagtttatgaaatcatcgatcatgttctaatttgttaggaattcttttccaaattttggattttcattccttttgagcgaagagttttacatattgagacttcttttactctccctgtgttggtttacatttgctatccacgt

SEQ ID NO: 1418 - DNA, 662 bp, Sesamum indicum
ccagcagcaacagctacaatggtatcgtccttccttcggacgaacgaacacaaacaagtctaatgagtgcattgagttgttgatttgaggttgtgatttatttcagctttttaatgttttgttctctcttgatttttgcaggtgaagtactcgagggagcccgacaaccccaccaaatcctgcaaggccaggggatccgatctcagagttcatttcaagaacactagggagacagcacatgccatcaggaagctgcctctagccaaggccaagaggtatttggaggatgtgcttgcccacaagcaggccatacctttcactcgcttctgtggaggtgttgggagaactgctcaggcaaagaacagacattctaatggacaggggcgctggcctgtgaaatctgccaagtttatcctggatttactcaagaatgctgaaagcaatgctgaggtgaaaggtttggatgttgatgctctctacatttcgcacattcaagtaaaccaggcccagaagcaaaggcgccgaacataccgtgctcatggaagaataaacccgtacatgtcatcaccctgccacattgagttgattctatctgaaaaggaagaacccgtcaaaaaggagcccgaatcacaattggccacaagcaaacccaggaaggcttg

SEQ ID NO: 1419 - DNA, 981 bp, Vaccinium corymbosum
aaagcccagattctattgcgcagggtttcggtctctattctcttgtattactgagaaaaccctaagctcatttctcttcatttgggatttgaacccatctctagcaacagcagcagccatggtgaagtattcgagggaaccggataatccaaccaagtcttgcaaagctaggggatctgatctccgagttcattttaagaacaccagagagacagcccatgcaattcgaaagctgcctctgaccaaggccaaaaggtatttggaagatgttcttgcccacaaacaagccattccctttactcgcttctgtcgtggagttgggcgaactgctcaggcaaagaaccgccactcaaatggtcaaggacgctggcctgttaaatctgcaggatttattcttgatttacttaagaatgctgagagtaatgcagaagtgaaaggcttggacgtcgatactctttacatatctcacatccaggtaaaccaagctcaaaagcagaggcgtcgcacataccgtgcccatggaagaatcaacccttacatgtcatctccctgccatattgagttgactttgtctgagaaggaagaacctgtcaagaaagagcctgagatgcaagttgcttcaggaaccaagaagggtaaagcactccgcagtggcgcatcttcttgaacagcggggcgacaaagtctacatgcaaaaaggggcagaattttcatttttgtctgagttagttggaccatttttctaaaaaagagttctttgaattttgtttttgttagattcttgaggggaattagaactttcagatggatcttcatatctatctacttgaagtacttttcgtttggactttaatgctgtgctgtgccttctggaaatattttatgttgtatcggttgctaggctattgtttatcgcgtgatattgcttgtccctatgaattagccaaggtgtgcataagttaattcagacatcttgagtta

SEQ ID NO: 1420 - DNA, 990 bp, Sarracenia psittacina
ttggctggtatcctaacagcagcaggaggggcaaccgcagccatggtgaagtactcgagggaaccggacaatcctacgaagtcttgcaaggctaggggctccgatctccgagttcattttaagaatacaagagagacagcccatgcaattcgaaaattgcctctggccaaggccaaaaggtatttggaggatgttcttgcccacaaacaagccattccattcacacgcttctgtcgtggagttggaagaactgctcaggcaaagaaccgccattcaaatggtcaagggcgttggcccgctaaatctgccagatttattctggatttacttaagaacgctgagagtaatgcagaagtgaaaggcttggatgttgagtcacttcacatttctcacatccaagtaaaccaagcccagaagcagaggcgccgtacataccgtgctcatggaagaatcaacccttatatgtcatctccctgccatattgagttgattttgtccgagaaggaagaaccagtcaagaaggagcctgagctgcaagtggcttcaagtaccaggaagagcaaagctctacgcagcggcgcttcttcttgaatgacagtgatggcttggttctggcaagtttgggggtgatgggttttcgtatccgtctctttttgggggaaactttgcttttgttgatcttttcagaaaatgtgctttgaatttatttggttagatttcttaaattacaattactggagggtttttagctttggcatggaccactgcatggagaatgttgatcttataagaatatgtgctttgaatttatttggttaggttcttgaattaccatcataagggatttctaactagagctttggcatggaagctgattgtttccctcatttaatagttttgttttttgttttttcccctgggaagagcatgctgaattgtgcctcaatggtaacatgtttatggtggtccttatagctgttgctgttgatt

SEQ ID NO: 1421 - DNA, 852 bp, Gossypium hirsutum
aaattgcccagtaaaccccataaaactttcggcgagaaaataaggaagcccaatattaaaccctaaaatgcctatccctttttatttgctaaagaagccctaactccgtacttcttctcttgcagtggtagggaacgaagtcgaactgtttcacacagcagccatggtgaagtattcaagagaaccggacaaccctactaaatcttgcaaagctaggggttctgatcttcgtgttcattttaagaatacacgagaaactgcattcgcaatccgaaagctacctttgacaaaggcaaaaaggtacttggaggatgttattgcccataagcaagcaattccattccgccgcttctgtggaggagttgggcgaaccgcacaggctaagaatcgacattctaatggacaaggccgctggcccgtgaaatctgcaaaattcattctcgatttgctcaagaatgccgagagcaatgctgaggtaaaaggtttggatgtagactcacttatcatatctcacatccaagtgaaccaagcacagaagcaaaggcgccgaacatatcgtgcacacggaaggattaacccctacatgtcttcaccgtgccacattgaactgatcctgtctgagaaagaggaacctgtcaaaaaagagcccgagactcaattggctccaaggaaatcaaagggtgcttcgtcttaaattgctgagtaatggattgtaactcttgaaaattttacattttactttagttgcctctgtaatgagaacatttttggtttccttatgaaatgcttaagactcaaagttagtctatggagattcttggtttctatttaaatctatggtcatttttcatt

SEQ ID NO: 1422 - DNA, 915 bp, Cajanus cajan
gccctagttagcttcctccttcagccgttcctctgcttcaaccgcgtggaagcaaaagaagaagaagaagaagcagccatggtgaagtactccagagaacccgacaatcccaccaagtcctgcaaggctagaggcgccgacctcagagtgcatttcaagaacactagggagactgcttttgccatcaggaagttgcccctggttaaagctaaaagatacctcgaggatgttttggcccacaaacaggccattcctttccgacgcttctgtggtggtgtgggaaggacagcccaggccaagaacagacactctaatggacaaggacgctggcctgtcaaatcagctaaattcatcctagatttgctgaaaaatgccgagagtaatgctgaagtgaaaggtttggatgtggatgctctttacatttctcatatccaggttaaccaagcacagaagcaaagacgccgtacctacagagctcatgggagaatcaacccttacatgtcatctccctgccacattgagctgatattatctgagaaggaagagcctgtcaagaaagagcccgagacgcagttggcaacaagcaagaagagggcggctgctgcttgaagtggtgcttcatcttaacttgctctggaagctagtgattcaatgacctacattcctagattatgtcagttttggtgatcattgtcctttatatttgttaagagacgtttttgaaacttgaacagcactttttgtttcgtatactatgttttaagttacttgagttacttggaaaattttattatggtaatcggatgattgattttagtttcaattactctgcgttgatacctgctgcttggtatttgtgtagtctcgatattctgattttgaggggaaaaaatagaaggccataacttatattga

SEQ ID NO: 1423 - DNA, 894 bp, Populus trichocarpa
aactctcatgtctcatcttattactgcgggcatttctattttggtggccacacaagtgtagacagaagctgcagcaatggtgaagtattcaagagaaccagataaccccaccaagtcctgcaaagctaggggatctgatctccgcgttcacttcaagaatacaagagagactgctttttcaatccggaaattgcctttgggcaaggctaaagggtacttggaggatgttttggcacacaagcaagctattccattccgccgcttctgtcgtggtgttgggcgaactgctcaagctaagaaccgccattcaaatggacaagggcggtggcctgctaaatctgctaaattcatccttgatttgctgaagaatgctgaaagcaacgctgaggtaaaaggtttggatgtcgatgcactttacatatcacatatccaagtcaatcaagcccaaaaacagcgtcgtcgtacttaccgtgcccatggaaggatcaatccttacatgtcatcgccttgccacattgagttgactttgtcagagaaggaagagcctgtcaagaaagaggctgatacacagattgctccaaggaagcccaagggtgctcttcgcagtggagcttcctcctgaaaagcgttggggtgatccaggattatggctccattagaaaattgttgtttttcttttgtttcagctgcctatcgaactataaaatttttcgataagattttgttctggagcttataaatgattttcttacattgctaactttttttcccagttggtgttggtttgggcaatcatgaatctcatagacattcaatgaaattccatagtgatgtctctctcattaaactgttagtgctttctacttggcttttttgaggaacaacttgattttg

SEQ ID NO: 1424 - DNA, 812 bp, Populus trichocarpa
ctctctatgtatcatataactgcggtctttctctttttgtggccaccgaagaatagacagaagctgcagcgatggtgaagtattcaagagaaccagataaccaaaccaagtcctgcaaagcaaggggatctgatcttcgtgttcactttaagaacacaagagagactgcgttttcaatccggaagatgcctttggacaaggccaaacggtacttggaggatgttttggcacacaagcaagctattcctttccgacgtttctgtggcggtgttgggcgaactgctcaagctaagaaccgccactcaaatggacaaggacgctggcctgctaaatctgctaaatttatccttgatttgctaaagaacgctgaaagcaatgctgaggtgaaaggtttggatgttgatgcactttacatatcacatatccaagtcaatcaagcacaaaaacagcgtcgccgtacttatcgtgcccatggaagaataaacccttacatgtcatcgccatgtcacatcgagttaattttgtctgaaaaggaagaacctgtcaagaaagaggctgatactcagattgctcctaggaagcctaagggtgctcttcgtagtggagcttcctcctgaaaagctttgggcagattcaggatagttgcaccatgagaacatttttgttttttcttctgttgaagcagcttatcaaactatgaatttatatgctaagattttgttcatgaatttgatatttgatgttggaatcacagaactttctcattaaacagtagcattggcttttatgaggattttgtttttgtgatctta

SEQ ID NO: 1425 - DNA, 720 bp, Silene vulgaris
atctaatccttaaaccctatcaaaaatggtgaagtactcccaagaaccggataatcctaccaaatcatgcaaggcgaggggatcagatctcagagtgcatttcaagaacaccagggagactgcattttctctccgtaagatgcctttggtgaaggccaaaaggtacctggaggatgtgctggctcacaagcaggctattcctttccgccgtttctgtggtggtgtgggtaggactgcccaagccaagagccgacactctaatggtcaaggacgttggccggctaagtcagccaaattcatccttgatttgttgaagaatgccgaaagcaatgcagagatgaaaggtttggacgttgacgcactgtacatctcccacatccaagtgaaccaagcccagaaacaaaggaggcgtacataccgtgctcacggaaggattaacccttacatgtcacacccttgccacattgagttggttttgtctgagaaggaagagccagttaagaaagaggccgagacacagttggctcccagcaaatctaagaggtcgcaagcttaagcactactagtgagcaaatctaagacatcaggcgaagcagtagtgtaggcaattgatatcattgctagatttgagacaagttttgttgttttatcatgttatgaacttggattttgtgaacactacaaccttcatcccaaactaattaattgtctttttggctt

SEQ ID NO: 1426 - DNA, 766 bp, Tragopogon dubius
tcggggaccattagctgggtcgccttcgcaaacacactctcaacttctgcagcagtcgcaccggcgaaactatcagcagccatggtgaagtattccaaggagccagacaaccctaccaaatcttgcaaagccagaggatcggatctcaggtgccatttcaagaacactagagaaaccgcacacgctatccgtaagttgcctctactcaaggctaaaagatacttagaagatgtgttggctcacaaacaagccattccattcacacgtttttgccgtggagttggacgcactgcacaagccaagaaccgtcattcaaacggccagggaagatggcctgccaaatctgcaaagttcattcttgacttgctaaaaaatgctgagagtaatgcagaagtcaaagggttagatgtggatgctcttcatatctcccacattcaagtgaaccaagcacagaaacagagacgtcggacttaccgtgctcacggaagaatcaatccttacatgtcatccccgtgtcatattgaactcactttgtctgagaaagaagaaccagtcaagaaagaggttgatactcagctggctccttctagaaaggcaaagaatcaagcttaaattacggatctgccctttttatgccaagagtttttgatttcattttgttggtgcatttgaattttttagataacctttggttacaagaacttgatagttgagtgtggctgatttcaatattatcttaagattttgaactaaaaaaaaaaaaaaa

SEQ ID NO: 1427 - DNA, 900 bp, Vinca minor
accttctctctatatctcttcctcagccgtcgaagcaggaaaaatggtgaagtactcaagagagccagacaatcctactaagtcctgcaaggccaggggttctgatcttcgtgttcatttcaagaacactagggagactgcacacgccatcaggaaattgcctttggttaaagccaaaaggtatctggaggatgttttggcccataagcaggcaattcccttcactcgcttttgtcgaggtgttggccgtactgctcaggctaagaataggcattcaaatggacaaggacgttggccagtgaaatctgctaagttcatcttagatctgcttaagaatgctgaaagcaatgctgaggttaaaggtttggatgtggattctctatacatttctcacgttcaagtgaatcaggcccagaagcaaagacgccgaacataccgtgcccacggaagaatcaatccgtacatgtcttcaccttgccacatagagttgattttgtctgagaaggaagagcctgtcaagaaggagcctgaatcacagttggctaccagcaacaagtctaggaaggcttaagctctaacttgtgcttccctgggaaatcttcaaagacttgtagcaattaatttttgggagcaattgaactctactttgtgcttttaggttggagacaatttaatctagtgcttcagtttataaaccttatttgaaaaggttgatctatagacatcatattttgttctttagcaagagaaaagacgtagttttggtattgtgaaatgttttatggctaaatccgaatgagttgtgcaatgttttagtttttttcttgcgaagatggtgcaattgctgtccggttgcttgatttatccctagtggtttaataaaagtctattaacttgggt

SEQ ID NO: 1428 - DNA, 787 bp, Vinca minor
ctctatagcttccctcttcactcagccgcagtagaagcaggaaaaaatggtgaagtactcaagggagccggacaatcctaccaagtcctgcaaggccaggggttctgatctccgtgttcatttcaagaacactagggaaactgcacatgctatcaggaaattgcctttggtcaaagccaaaaggtatctggaggatgttttggcccataagcaggcaattcccttcacacgcttttgtagaggtgttggccgtactgctcaggctaagaataggcattcaaatggacaaggtcgctggcctgtgaaatctgccaagttcattttggatctgcttaagaatgcagaaagcaacgctgaggttaaaggtttggatgtggattctctatacatttctcatgttcaggtgaaccaggctcagaagcaaagacgccgaacataccgtgcccatggaagaatcaatccttatatgtcttcgccatgccacattgagttgattttgtccgagaaggaagagccagtcaagaaagagcctgaatcacagttggctaccagcaacaaatctaggaaggcttaagcgctctgacttgtgctttcttgagaatcttcaaagtcttgtagcgattaattttggaagttttgaactctgttactttgtgctgttagtttggagataagtttataaaaacttatttgaatttttttgatttatagacatcatatttttttcttgaactacgaactacatacttttgttaattgtggaatgttgtttgtctgaatgcgaatg

SEQ ID NO: 1429 - DNA, 946 bp, Vinca minor
cctttaccttattttcttttcctcagccgcagctgaaccagggaaaaatggtgaagtactcaagggagccggacaatcctaccaagtcctgcaaggctaggggttctgatctccgtgttcatttcaagaacactagggagactgcacatgctatcaggaaattgcctttggtcaaagccaaaaggtatcttgaggatgttttggcccataagcaggcaatcccctttactcgcttttgcagaggtgttgggcgaactgctcaggctaagaacagacattcaaatggacaaggacgctggcctgtgaaatctgccaagttcatcttggatctgcttaagaatgccgaaagcaatgctgaggttaaaggtttggatgtggattctctatacatttctcacgttcaggtgaaccaggcccagaagcaaagacgccgaacataccgtgcccatggaagaatcaatccgtacatgtcatcgccttgccacattgagttgattttgtctgagaaggaagagcctgtcaagaaggagcctgaatcacagttggctaccagcaacaaatctaggaaggcttgatctctgacttgtgcttccttggcatcttcaaagtcttgtaacgattaattttggaagttttgaactctgttacttttgtgctgttaggttgaagacgagctattctagtgcttcagtttataaaccttattcgaaaaagttgatttatagaacatatttttgttctttagcaagaaaatacgtctttccgtaatttatggaatgttgtttggctgaatgcgaatgaatcgctatgttttgtatttcttgaaaagattatgcatatcctggaagcattatgaagtttatcacaggccgggtgataaaattctacttggaatgtaagataaaaaagtggcaattggtttacctgttaaaaagatctaggagtt

SEQ ID NO: 1430 - DNA, 799 bp, Cucumis melo
caacttttgttttcttcacagccccaagttgcagccgtcgccatggtgaagtattccagggaaccagacaatcccaccaagtcctgcaaagcccgtggctcggacctcagagtccactttaagaacacaagggaaactgcctttgccattagaaagttgccactggccaaggccaagagatacctagaggatgtacttgcccacaaacaagccattcctttccgtcgcttctgtggtggtgttggacgaactgctcaggcaaagaacagacactccaatggccaaggacgctggcccgtcaaatctgccaagtttattctagatttgcttaagaatgctgagagcaatgctgaagtgaagggtctcgatgttgatttgctccacgtatctcacatccaggtaaaccaagctcagaaacaaaggcgtcgtacctaccgtgctcatggaagaatcaacccttacatgtcttctccttgccatattgagctgattttgtctgaaaaggaagagcctgtgaagaaggagcccgagactcagctggcgaccggcaaacctaagaaaggtcaagctatccgtagtggcgcttcctcttgaatggcccaagtagaaattctgtttgtgggtttttgctgtgccatttctttttcttttttgaagtgagtttaattattgatgatcagatcactatatagaacgagggattattatttagatgttttgtgtgacaatgttatatttggaacctttcctagttcaattttcttcaagttgcaatcacattctcgtatttttgcgttca

SEQ ID NO: 1431 - DNA, 778 bp, Petunia hybrida
cgcgggggtctacaaagggacctttaccagcagcgcaaggggagtagcagcagcagccatggtgaagtattcaagggaacctgacaaccaaaccaaatcttgcaaagctaggggctcaagtctccgagttcatttcaagaatacacgagagacagcgcatgcacttaggaagatgcctttggacaaggctaagagatatctagaggatgttcttgcccataaacaagccattcccttcacacgcttttgtcgtggtgttggccgtactgctcaggcaaagaaccgccattcaaatggtcaaggacgttggcctgttaaatctgcaggatttatcttagatttactcaagaatgctgagagtaatgctgaggttaaaggcttggatgtggattcacttttcatatctcatatccaagtgaatcaagcacagaaacagaggcgccgcacttaccgagcccatggaagaataaacccctacatgtctcacccctgccacattgaattgatattatctgaaaaggaagagtctgtcaagaaggagcctgagactcagttggctcctagaaagactaaggcatcctcttaatatggacaatggatcctggaaattcagaagatggacttcccctatatatgccaaagtagtctgttatgaacaatttttgcatcttgaaccttgtttccttagatatttgtggtactagttttgcaaattctactattccgatacttgtattggatttgtttaccttattgctgagactgcgcaaactttttg

SEQ ID NO: 1432 - DNA, 759 bp, Petunia hybrida
ggcactagcagcagcagcaacaacagcaacatcgcaggcagcaatggtgaagtactcaagagaacccgataaccataccaaatcttgcaaagcaagaggctcagctctcagagttcatttcaagaatacaagggagacagcgcatgcacttaggaagatgcccttggacaaggccaagaggtacttggaggatgttcttgcccacaaacaagccattcccttcacgcgctactgtcgtggtgttggccgcactgcacaggcaaagaatcgtcattcaaatggacaaggacgttggccagtcaaatctgcaaagcatattctagatttactgaagaatgccgagagtaacgccgaggttaaaggtttggatgtggattcacttttcatatctcacatccaagtgaaccaagcacagaaacagaggcgtcgtacctaccgtgcccatggaagaatcaatccctacatgtctcatccctgccatatcgagttgatattgtctgaaaaagaggagtctgtcaagaaggagcctgagactcagttggctccaagaaagtcaaaggcatcctcttagtccgactagtaaatctcagattttagacagtgggaagtttgtttatgttgagataaaactatagtttgatgaaagaattttgtgatagttgaaccaggttttctgagaaatttgtagtatttttgcgtgatcttgatatttcagaactttgatctggtatctgttatcttattcttgcggctgagcga

SEQ ID NO: 1433 - DNA, 791 bp, Lippia dulcis
agcgcagcacatcacagtacctctcttctgctgaagacaataaccctaacggcaaagcacggcgcagaaacagcttagcaaaaatggtgaagtactcactggagcctgataatcccaccaagtcctgcaaggccaggggatctgatctcagagttcactttaagaacactagggagacagcgcatgctcttagaaagatgcccctgatcaaagccaagaggtacttggaggatgttctttcacacaagcaggccattcctttcactcgtttctgtggaggcgtaggcagaactgcacaggcaaagaacagacattcaaatggacagggtcggtggcccgtgaagtctgctaagttcatcttggatttgcttaagaatgccgaaagcaatgctgaggtgaaaggtttggatgtggatgctctttacattactcacattcaggttaaccaggctcagaagcaaaggcgtcgaacataccgtgctcatgggagaataaacccatatatgtcctcgccctgtcacattgagttgactctatctgaaaaggaagagcccgttaaaaaggagcctgaatcacagttggcgactagcaaacccaggaaggcttgagctttgtaatgagtttccagtcttatagtctttcactccttcaacaagttttggaaagaatttgtggtccttttgagctctgtttctcaagatgagttttgtcattttattttcaattttagaggtttatattggattcatcaaatgttatgctttaaagatattgcttattattaaatgtta

SEQ ID NO: 1434 - DNA, 838 bp, Salvia sclarea
ctgcaggaattcggcacgaggctacctcacaattataaaaaattgagacccataaaggtgaagcccagcccatgaagccattgagtattagggttttactataaaatcttctgcaccaacccttctctttctcttcaatcgacttccatcagtttccgcagtactgccgaagagaacagcagcagcaatggtgaaatactcgagagagcccgataacatcactaaatcttgtaaggctaggggatctgatctcagagttcatttcaagaacactagggagacagcgcacgccatcaggaagttgcctttgggcaaggccaagaggtacttggaggatgtgcttgcccacaaacaggccatacctttcactcgtttctgtggtggtgttgggcgaactgctcaggccaagaacagacactctaacggacaaggtcgctggccagtgaaatctgccaagttcatcttggacttgctcaagaatgccgaaagtaatgctgaggtgaaaggtttggatgtggatgcactattcatttctcacattcaggttaaccaggcccagaagcaaaggcgccgcacataccgtgcccatggaaggattaacccctacatgtcgtcaccttgccatatcgagttgattttgtcagaaaaggaagagcctgtgaaaaaggagcccgagtcgcagttggcgacgagcaaaccgaggaagtcttgagcaattggctatttgttggatcatatagtagttcaagttttgaaagttgttttttggtccactttgttttgaactatgtttagattttggagattaatcgaaattttcgtatgtgcttggatatgt

SEQ ID NO: 1435 - DNA, 831 bp, Nicotiana tabacum
ggccattacggccgggagcgaaaagacatctgtatcagcagctgctggagcgtagcagcatcaacggcaaccatggggaagtattcaagggaaccagagaaccccacaaaatcttgcaaagctaggggttcggatctcagagttcatttcaagaacactagagagacagcgcatgcccttaggaagatgcctttggacaaggcaaagagatacttggaggatgttcttgcccacaaacaggctattcccttcacacgattttgtcgtggggttggtcgtactgctcaggtaaagaatcgccactcaaatgggcaaggacgttggcctgtcaaatctgcagggtttattcttgatttactcaagaatgctgagagtaatgctgaggtcaaaggcttggacgtggattcactttacataactcacatccaagtaaaccaagcgcagaaacagaggcgccgcacataccgtgcccatggaagaatcaatccctacatgtcgaatccgtgccacatcgagttgacattgtctgagaaggaagaatctgtcaggaaggagcccgagactcaattggctcccagtaagacaaaggcatcctcttgagtggaggaatgaatctctgatttttctaagtataatttcaatgtccctatagccttagtatcaggagaattttgtggtgtttgaagtattttccataggaatgtgtttttttgtaatttttctatttcggattttgaaggttgtcattttgaggcatgttttcctagaaattttggagttctatcttgcaatttcaaagattgaattgggaatgtttatgttttgacggct

SEQ ID NO: 1436 - DNA, 916 bp, Musa acuminata
atgcttcgaatcacccgctcgcctaccagtcttgttggtggaaataaagccggggccgcgtgggacccactttttcctgagaaatcactgcgctcaaacaaaaagtcaggtattccagtgggtatggaaagtagccgcctcgtctttaagccagcctctccctccggctgccagagagtgggaatcggagatcgcgaagaatctttcgaagccatggtgaagtattcgagagagccttctaaccctaccaagtctgccaaggccatgggtcatgatttgagggttcactttaagaatactcgtgagacagctcatgcgattagaaagctacccttgtcaaaggccaaaaggtaccttgaagatgtaatagctcacaagcaggctattccctttcggaggttttgtggtggtgtaggacgtacagctcaagctaagggccggcacccaaatgggcagggccggtggcctgcgaaatcagccaggttcattttggatcttctcaagggcgccaaaagcaatgctgaggtgaaaggtttggatgttgatgctctcttcatatcacacatccaagtgaaccaagcaccaaagcagaggcgcaggacttaccgcgcccacggtcgaatcaacccttatatgtcctccccgtgtcacattgaactgatcttgtcagaaaaggaagagcctgtcaagaaagagccggagacccagattgctcccagtaagcccaagaaagcttgagcaattgattagaagtggaacaacttctcaggcagaagttttgtgaaagatactctcatttgatgtttgaatttgcagtttactttctttcattgtggtgttgaacgtgtcttcatgagtctttggtgaacattccggttgttttgttcaatgcagaaaatattttgaaggatttaat

SEQ ID NO: 1437 - DNA, 786 bp, Cicer arietinum
ccctgtcgtcatggtcaagtactcaagagagcccgataatcccaccaagtcatgcaaggctagaggtgctgatcttagagttcatttcaagaacactagggaaactgccttttcaatcaggaaattgcctttgacaaaggccaagagttacttggaggatgttcttgcacacaaacaagccattccattcaggcgtttctgtcgtggtgttgggaggacagctcaggccaagaatagacactctaatggacaaggaaggtggcctgccaaatccgccaagttcattctagatttgctcaagaacgcagagagtaatgctgaagtgaaaggtttggatattgatgctctatacgtgtctcatatccaagttaatcaagcacagaagcaaagacgtcgaacatacagagcccatggaagaattaacccttacatgtcatctccatgccacatagagttggtattatctgaaaaagaagaggcggtcaagaaagagcctgagacccagttggcaccaagcaagaagaaggcttaatctcttcattgctgcgcatgttaatttttcttcctttatttgtatcagatatttgtaggaaatgtttaaactcttttctatttgatactgttttcgtatcactttttttaagttttgattttgatgacttagctttggagtttgaactcttggactgttgttactttcttttggattctttttaggctttgtttggcttgatggaatgtgattaaatggggtgaatggaatggagtatgatttcattatttagg

SEQ ID NO: 1438 - DNA, 767 bp, Zingiber officinale
  misc_feature (700)..(700): n is a, c, g, or t
  misc_feature (735)..(735): n is a, c, g, or t
  misc_feature (746)..(746): n is a, c, g, or t
ctgctgcacagggagactcgaggatcctgaagaatcatttgcagtcatggtgaagtattcgagggacccttccaatccaaccaagtctgctaaggctatgggtcatgacttgagggttcacttcaagaacacccgtgaaactgcacaggcgattaggaaactacctctatcaaaggcgaaaagatatttgaacgacgtcattgctcataagcaggctattcccttccggaggttttgtcgtggagtaggtcgaactgctcaggccaagggcagacacccgaatgggcagggtcgttggcctgtgaaatcagctggattcattttagatctcctaaagaatgctgaaagcaatgcagaggtcaagggcttggatattgactcactcttcatttcacacatacaagttaaccaggcccagaagcagaggcgcaggacataccgtgctcacggtagaatcaacccctatatgtcctctccttgccatattgaacttatattgtctgagaaggaagagtcagtcaagaaagagcctgagacccagctcgccaccagcaaatcccggaaagcttagccgattagaagcgagacatctccacaggcatagcttttagtttactggatgctaatattacttgcttgtcattttggtattgaaacatttacttgggcatgtaacaaatcattatcaaattgcttttgngctcgatgagctttgttccagctactcttttcaangggaaaacttntattatattttggcctgtttt

SEQ ID NO: 1439 - DNA, 761 bp, Ipomoea nil
atccctttggcagagagaacagcggacctaagcacttcctggaagaggatcatcaatcgccatggtgaagtactcaagagagcccgacaatcccacaaaatcctgcaaagccaggggttctgatcttagagttcattttaagaacacaagggaaacagcgcatgctatcaggaagctgcctttaacaaaggctaaaaggtacttggaggatgttttggtccacaagcaagccattcccttcactcgcttctgcagaggtgttggaagaactgctcaggcaaagaacaggcatccaaatggacaaggacgttggcctgtgaaatcagctaggtttattctggatttgctcaagaatgctgagagcaatgccgaagttaaaggcttggatgtggattcacttttcatatcccacattcaggtaaaccaagctcagaagcaacgacgccgcacataccgtgctcatggaagaattaacccctatatgtcatccccctgccatatcgagttaactttgtctgaaaaagaagagcctgtcaagaaggagcctgaatcacaattggcaaccagcaaggctaggaaggcttaaggcatctgtgcttttttcaccagtgatttacaaaccttcaagaattgaacgattctgatactttcttttgcttccttgtgtttggacactagtttatttgcagtatgaacaagttttgttttaggagatatatttcctttcctgtattgtttgatactctctgagctttcccttt

SEQ ID NO: 1440 - DNA, 678 bp, Petunia hybrida
caagctccttctctcacagaatcaaatggtgaaatactcgagagagcctgaaaatcccaccaaatcatgcaaggctaggggttcagatctcagagttcacttcaagaacactagggaaacagcgcatgctattaggaagcttcctttggtcaaggccaagaggtatctggaggatgtcttggcccacaagcaggccataccatttacacgcttttgtagaggtgttgggcgaactgctcaggccaagaataggcattcaaatggacaaggacgctggccagtgaagtctgctgggttcattttggatttgcttaagaatgcagaaagcaatgctgaggtcaaagggttggacgtggattcactgtacatatctcatattcaggtgaaccaggctcaaaagcaaaggcgccgcacatatcgtgctcatggaagaattaacccctatatgtcatccccctgccatatcgagttaatcttgtctgagaaggaagagtcagtgaaaaaggagcctgaatcacaattggcagcgagcaaatctaggaaggcgtgaaaacatcagctttatcagtagagttataagcagttggcaaatttagaagtgtttttggcccatcttttacttttctttgaacaagtttcaatgtttcacttgtgaacaaatcttgttttaggatgtat

SEQ ID NO: 1441 - DNA, 719 bp, Ananas comosus
agtcgcagctacgatcgatctctcgcaatggtgaagtactcgagggagcccgcgaatcccaccaagtccgccaaggccatgggccaggacttgagggttcactttaagaatacccgtgagacagctcatgcaatcaggaagctaccattggcaaaggctaagaggtacctcgaggacgctgttgctcacaagcaggccattcccttccgcaggttttgcaggggtgtgggccggacagcacaagcaaaggcccgccactcaaatgggcagggtcgctggcccgtcaaatcttgcaggttcattttggacctgctgaagaatgccgaaagcaatgcagaagttaagggtttggatgtcgatactctctacgtatcacacatccaggtgaaccaagcccaaaagcagaggcgtcgcacgtatcgtgctcatggacgaatcaacccttatatgtcatctccatgtcacattgagttgatcttgtcagagaaggaagagccggtcaagaaagagccggagacccagattgcacccaggaagaccaagaacacttgagccttgcgcggtgaagccttttcgtaaggtttagcagattctagcattcgtagtaattccagttgaaagtttgggttcacttacccctcatttgtttttaattttgaattgatgtcggtacctttgcaacgagaactgtggtgggaattaatgtgttttgctgcgtt

SEQ ID NO: 1442 - DNA, 906 bp, Utricularia gibba
atggtgaagtactccagagagcctgataacgctaccaaatcatgcaaggcaagaggatccgatcttagggttcatttcaagaatacgcgggagactgcgcatgctatcagaaagttgcctctggccaaggcgaagcgatacttggaagatgtgcttgttcataagcaggccatacccttcacacgtttctgtggaggtgtaggacgaactgcccaggcaaagaaccgacattctaatggacagggtcgctggccggttaagtctgcaaagtttattttggacttgctcaagaatgccgaaagcaatgctgaggtcaagggtttggatgtagattcactctacatctcacatattcaagtcaaccaagctcaaaagcaaagacgtcgcacgtaccgtgctcatggaagaatcaacccttacatgtcctcaccctgtcacatagagctgattctttcagagaaggaagaagccgtcaagaaagagcccgagtctcagctggccaccaagcccaggaaggcatgatttgaagctcccagtggcatacaccaggttttgaagtcgtcacgttttctcccatcatgttactgatatatttgacatttcgatttgagactttcttttaatgctgcaagtagagattctattctgaccctgtgcttcacctaaaacattctcttgcaataacaaaatacaccatttacacctctgctcagcttcgagctttttttctacccttgtgaaacaaccgttttccccagtacgaatgtgaccagggacagttcaaggaagaaaattgtattgatcaaacctcgatccaccgtccacccgaaaatcgtaaccccccctggattctccctcaaatcatcactagagccagtctcttgtggtacgttgatatgtctgatg

SEQ ID NO: 1443 - DNA, 765 bp, Capsicum annuum
gcaccgccggagccatggtgaagtattcaagggaacccgataaccctaccaaatcttgcaaagccaggggttcaagtctccgagttcatttcaagaatacgcgtgagacagcccatgcacttagaaagatgccgttggacaaggccaagaaatatctggaagatgttctttcccacaaacaagccattcccttcacacgcttttgtggtggggttggtcgtactgctcaggtaaaggatcgtcattcaaatggtcaaggacgttggcctgtcaaatctgcagggtttattctggatttactcaaaaatgctgagagcaatgctgaggttaaaggcttggatgtggattcacttttcatatctcacatccaagtaaaccaggcacaaaaacagaggcgccgcacataccgagcacacggaagaattaacccctatatgtctcacccttgccatattgagttggtattgtctgagaaggaagagtccgtcaagaaagagccggagactcagttggctcctaggaaggcaaaagcatgagcagtgaatctcctggatcgcagaaggtgtccttaggctttgttatgtaacaattttggcagtttgaaccattttctccgttagtttgtcgcactgttctgcgtattcttattatttctaaagttgagttggatgcttaccttattttggtggctaaagacttctgatgaacttttcattggatcacaaactctcttcatttctatacttaatctgtgtgggtcgagtt

SEQ ID NO: 1444 - DNA, 6128 bp, Ricinus communis
aacggtaacgaagcaaaagttacactaaaataaagaagaaaggattttacatttactgtatacagtaaagtagtaaccaatgaagacaaacacaaatatttgcctatagattgcataaagcaggcaggacatgtggtaagagatggctcaaccacaagatcatagcacatacagccgaacaaagaaactagaggacgagaatgcttggattggatgtccatctacccaaggagcttcaatattattgctgaaagttcctgcataaatgatggggcatgtgctgaacaacatgtgtgaactgaaccttctagttggatcttcacgtcccctctggcagattttagctattatctgtactattctctagaaagtgccaatcatctatatctgatagtgccattgtatctactaaaagaaaataaataaaataaaattcgttcaagatattttagttgttaaaactgcaagacttttaatgcgtaaaatatttgctagaacacgatgccacgtaaagaaaaataaagaaagctgataaaataatgaaagagtctggcatgataaactgagaggaatcttacagggctaatctataaattttatgaagtggaacatacagtcatcctgcctttcggctacttagagttttaagtagcctctgaattcaggtattctttacagagcaaagtttctcatacaaaagctggacataaatattttgagacatggcctacgtaaattcagtctactaagattgaatgggtgactaacaggaaatgactgaaccagatacaaacagaatcaggcaaagtaaattgtatgaacaaccataaggaaaacaaacacaacatcaccaaaaatcaaaaacaagaagcttaaggttcaaatgggacgagggacataccaaaacttgacttatttcaaaattaaagcaagctgtttggttagggcttttctaagtagagcagatttgggtatggaatctcctctacatcaggcaaatagaaaagcacattggtgtattgtccctagtaacttcgatccttgttaactaaatagaggaattgaatgtttagaatcggtcaagatgctagaatgaatgccaaaaaaaaaggtgtaccattacaagctttcagcatgtataaacatagaacaaaaaagcacgcctttttccctaaaacataaatagcatcatgaactacaacttgaacaagaattccaccagaagaccacagaataaaggatctaaactgctccatctaaccaagttgatcaatatcagcacaaggatgaaacgaccagaaagacgttacaagtcttgacgtatatgccaccagttgtcaatttgagaatccttgattcaagtgcttccaggagtattatttccagcagacttgcgattcaggtaaagaataacagcatctccaaccctaaagattccaaccaaagattaaaaaaacactaaaaaacaccacaaatgctagtctgttaatcttatcttcttgtcattctgacttggatcagaccaaactccattggccagctccattacagtgaaaatgtgatcttgtggaaaaaatgtggctagattaaatgtatgtataaatacatgggcagcattaaactaaaattaaatcaaaattagagtggaaaaactcaccatgactgattatagaaatcagaacggcgctccttttctgcatgacgacttgcatctccagatacaagctttagatctttgctctgtgaagcaattaaagtattaataaattctgctggagactgactaaagtcaagaaagaaagcacgcctccttctatgctcatgtatcttctttatagaatcacatattaattcatcacaagcatctatttccttgtgcttctcagagcttgctaaaaatgcagcaaggtccttttgcaatggtgaaggaacatcaactataatatcataacaagttgttccggctgggcaatttcctgataattttatcctgtgctccaagtgaataggctgtggaggagttaagtgctgacttatcttctgcgaaaccatagcaaatttcaccttctcttctccaaacaatttcttaaggggaggatcacacatgaagaaagatgggtcatttgggatctgcaaccttttagatttcacataatgccaaattgccaccaaaatttttggacgggtttctacctcaattccaagtatttctgacaaagaaggtgaaagcttgaatttctctggcacataattcatttctagtctaattattgcagtaaattccttgtttccttttctcttcacttcaaagccctcgctaagtacaggcgaacgagcactctcccacagtatcacatgattatctggatacaggctctggtccaagtatattgtaatttttttaaagtaagatgagaattttgaatatgacttttgcggctttccagacagcagtggatctttgccatcttctagtatcctcccaacaatcttcagtgaccaagaaggaggctctgcattattcttctcaccttgcgcttgattttcatgagtgttaaaaatataaactcgaagtgttttctggatgcgcgagggattttttagtgactcttgaatatcaatcttctttcttgccatagctgaatctatcctagcctcaaagtcaagcatctgagtataaagtgcagactctggcaaaattgcagctattttatcgggaatctgcttctcagggatcttctgcttcttcctccgcgcagctggagtcaattccatagttttaaatggtgaagctgtattagtattggatgagccacctggaggcctagaagggggtttctggttagcccttttggcacttgtagtgcccgctgcagacacagacggtgatggtacaccagcattactaggattagggctttggagctgcgcagtggaatggttacttgattgtacctgagattgaaactgagcatgagctgcctgtgcatattgtgaatgaccatgcacttgggcttgcagttcagacagctgaaagtggcctggataggcaggcaccccctgtgtttgaggttgtggatggtgagatggttggacaggcaaaggctgtgttagcgtgccaggattggcaaatgccaacggtgtccctaagcttttcgcaggattattgttattcattgatatctctttctcataaaccacaatatcttccaaactccaaatgaaacctcataaaatcgccactaaaactaaaatgagattctggatatcaataaaagagcattcttttctaaattcacacttctaagtactcccatccaaccagcctaaacaaacaactcaaatcaaaacagagatgtaaaccctattctgtgaatgaaaccctaattatgagtaatccaacaaacatctactgaacacgtttatataaccgtaccaatagcttagctctttgatgtggttttagatatgtttaaacagtagttagctatatcactaatcagaaaaaaaaaaaaaaaaaaaaaaaagagaaggggagtgcagaatctacaagttcaaacctatgcatctacttagataatttaaaacataagaagacaaatgcaagatttcttacaagaacataagtatcttcggaagctaaaacgcttttatgctctttgcattttgcctctgtgtttcaaaatttgtctctctgcgattagctgtttaaggatttcaactctggtttttcggtttttctgttcttcttgtttggggtatatattctctcttgcgtaaatgacataaagacccttatttaaactgcaattttcaacagagtattcccacgtggggtaaaccgggtcggacccttaataaaacccaaataacatagtcattacggccgggggaagactgggacaactagaaaccctctcacaggtcaccacgagcaagcagcaagctttattagggttttgattggcgtttaacatttctgcaattttctattttggctcggaagtttggagcagaatcaccggcagagattgttagccatggtgaagtattctagagaaccagacaaccccaccaaatcttgcaaagcccgaggctctgatctccgagttcactttaagaatacgagggagactgcttattcaattcggaagttgcatttggcaaaggctaaaaggtacttggaggatgttatggcacacaagcaagctatcccattccgacgtttttgtggtggtgttgggcgaactgcacaggctaagaaccgacattcaaatggacaaggacgctggcctgttaaatctgcgaaatttattcttgatttgctcaagaatgctgaaagtaatgccgagatgaaaggtttggatgttgattcactctacatatctcacatacaagttaatcaagcccaaaaacaacgtcgccgcacttaccgggcccatggaaggattaatccttacatgtcctccccatgccacattgagttgattttgtcggaaaaagaagaagctgttaagaaagagccggaaactcaactagcacctaggaaagcaagggcttaagcgttacacagtggggcttcctcctgaaggctggccctgaaaattggtagtggaaaacatttttagatgtgacgcatcaagtttgtttcttgagatgtttgttataaaacttctactcatttatactgttattatagacctgaatcatgaaaactcaactgaattttgatattggttgaggcagcattgaaatgttcaagttataacctgttgctgaatgtgcaatatcctgtttatttcctaggaatatattattgttacagtaagttgtagtgggaggatactttgttgctgcattgctacaaaatggttttacctactgaatgcgttcgatagcatacgaacatgctttctgaccattttctcgagtctttactgatatctaggtggaaagcttccacgacgttgtagccatcattaaaatgcaagtttaccgatgtgtgtttagtatgaaaattgctattaaattgcatatatctcacaacacgcatttctaatagaacataaaaattgcaaaacatttaaaaggagcttcaagattgacgtagttttggacgctacgctaccaccaaataactgaacagacatagtaaaggttgtccgattacaaattatcagttgggcgatttcaattctggaacctgaatgagaatgccctatcgcgcatttgaatcagttcttctgagcagatgccacctattctcacggcgcaacaatacactagcatttgagcacttttaatcagcttcagactcccaattttaaatgtataaaccaatcgacaatttatcacataatctctcaactcattccacatctattatgcattcggaaggctgcttcaaggttgcacagcttccagaagtttctcatacacctgcctagcagacaaatcctccacctggtacagacctaaccgttagccaactacaactaatttccccaaaactcagataagagtccacagataataccaaactatcaacttctacttatggataagaatttaatccaaagaatcatcatggataaccaactcagaattaagagtaacggtaattctctgggtaatgtgttatatccctaaaatcacaatcatttaaatgcaaatcacctaggcttttaacaaataaggcatattcaccctcctacttaaacctatgcataacaagtatgaactgatctttcttttttccggatttagacaactgacccagtagaaatattgattcatgatattaccttgaacaacttatggataaacaaagaggaggctacagcataaaagtcgtggagtgcaaagactaatctcataaatcaaaaacttaggtacagtatgttaacccatatgtttgaatgagcttatctaattctagttacagaaacgctcgatgaacctaactagactcgcacacattacttccatctccttgaaagtcacaaaactggacttacaaaaattcaacatgagtaaattcctaacaaattcttaaggaacagaatgagacaacaataacatagtaaattcttcaataaacttacaacaaggagttttgatttgttgtt

SEQ ID NO: 1445 - DNA, 786 bp, Fagopyrum esculentum
gtctgctcaaaaggattcagggttaagcgttcaagatggtgaagtactcaagggaacccgataatcctaccaaatcttgcaaggctcgtggctctgatctccgtgttcatttcaagaacacaagggagactgcgttttccatcagaaagatgcctttggttaaggcaaagagatacctagaggatgttcttgtacacaaacaggccattccattccgtcgattctgtagaggagtaggaagaactgctcaagcaaagaacgcaggccatcccaatggccaggcgaggtggcccgccaaatccgcaaaattcatccttgatttgctgaaaaacgcagagagcaatgctgagatgaagggtttggatgtggactccctttacgtctctcatgttcaggttaaccaggcccagaagcaaaggcgtcgtacttaccgagctcatgggagaatcaacccttacatgtcacacccatgccacatcgagttgatcctgtccgagaaggaggaacccgtcaaaaaggagccggagtctcagcttgcagcaagcaaatccaagaagtctgctgcttccgcttaattttgtctgcacaccatttaggtttcattcagctgaggttctttgttttgccggtttagagagaattgaaagttttgttgcaaccatcttagactttcttgacaatatatttttgattatcttacccgaagttatcttcatggcctgggcttccttattatattcttcggtctttttgtaattgtagacgagtgtgaatgctttgtagttg

SEQ ID NO: 1446 - DNA, 858 bp, Capsicum annuum
agaagacaactaaagccgccgccgccggaggagagtagcagcagaatcgccggaagccatggtgaagtattcaagggaacccgataatcctaccaaatcttgcaaatctaggggttcaagtctcagagttcatttcaagaatacacgtgagacagcccatgcacttaggaagatgccgttggacaaggccaagaaatatcttgaggatgttcttgcccacaaacaagccattcccttcacacgcttttgtcgtggtgttggtcgcactgctcaggtaaaggatcgccattcaaatggtcaaggacgttggcctgtcaaatctgcagggtttattcttgatttactcaaaaatgctgagagcaatgctgaggttaaaggcttggacgttgattcacttttcatatctcacattcaagtaaatcaagcacaaaaacagaggcgccgcacgtaccgtgcacatggaagaattaacccctatatgtctcacccttgccatattgagttgatattgtctgagaaggaagagtccgtcaagaaggagccggagactcagttggcctctagaaagacaaaggcgtgatcaatgaatcctggaaagctgaaggtgttaagttttcatctctttgtagtattatgttctgaaacaatttcagtgacggtttctccaaaaatttgtgctgctgttttgcgtattcttactagagttgtatgtttaccttattttatatcttgctggaaatttctccccggatcagtctcagtttttcattttctatactccatcgtatgtgttaaataaagtatgagtagtttcgattggtgttttagggttgggcaatgatgatgacaactcatttt

SEQ ID NO: 1447 - DNA, 755 bp, Capsicum annuum
gaagaagacaactaaagccgccgccgccggaggagagtagcagcagaatcgccggaagccatggtgaagtattcaagggaacccgataatcctaccaaatcttgcaaatctaggggttcaagtctcagagttcatttcaagaatacacgtgagacagctcatgcacttaggaagatgccgttggacaaggccaagaaatatcttgaggatgttcttgcccacaaacaagccattcccttcacacgcttttgtcgtggtgttggtcgcactgctcaggtaaaggatcgccattcaaatggtcaaggacgttggcctgtcaaatctgcagggtttattcttgatttactcaaaaatgctgagagcaatgctgaggttaaaggcttggacgttgattcacttttcatatctcacattcaagtaaatcaagcacaaaaacagaggcgccgcacgtaccgtgcacatggaagaattaacccctatatgtctcacccttgccatattgagttgatattgtctgagaaggaagagtccgtcaagaaggagccggagactcagttggcctctagaaagacaaaggcgtgatcaatgaatcctggaaagctgaaggtgttaagttttcatctctttgtagtattatgttctgaaacaatttcagtgacggtttctccaaaaatttgtgctgctgttttgcgtattcttactagagttgtatgtttaccttattttatatcttgctggaaatttctccccggatc

SEQ ID NO: 1448 - DNA, 904 bp, Populus trichocarpa
agcaagaattagggtttctctgatttagcaaccctaataccctatttataaaccgcactcagcagtgtcacatcttctcttatgctagagccaccggcatcaacgtctgtatcttcaacaaggcagaaggtgctgcagcataagccaccatggtgaagtactctagggagcctgataatcccactaagtcctgcaaagcaaggggcggtgacctcagagttcattttaagaatacaagggagacagcttttgctttgaggaagttgcctttggccaaggccaagaggtacctggaagatgtcctggctcacaagcaggccattccattccgacgtttctgtggtggagttgggcgaactgctcaagcaaagaacaggcactcaaacggacaaggacgctggcctgccaagtctgcaaggttcatcctggacttgctcaagaatgctgagagcaacgcggaggtcaagggtttggatgtggatgcgctctacatatctcacatccaggtgaatcaggcacagaagcagaggcgtcgtacatatagggcacatggaagaattaatccttacatgtccagcccgtgccacattgagttggttttgtctgagaaggaagagccagttaagaaagagcctgagacccagatagcaaccagcaaatcaaagaagtcgcaagcttcttcttgagtggacagcttgtttgtttatatcgagctatgctcattgttccatgagaaatttcttggagagcttagatgaaagtctgttttcatcagagttttgttgtatcataatttgacaaatagtcctcgataatttcaatgatcggtctaactgatatcttgtttacgaaccatgcgtagctttcagattatagatttttgaatgaataattttgattcacc

SEQ ID NO: 1449 - DNA, 712 bp, Carthamus tinctorius
  misc_feature (511)..(511): n is a, c, g, or t
cgggggcggaaacctctcaccagactcatcgttgccggaaaacgcagtaaacatggtgaagtactcgaaagagcccgataatcctaccaaatcctgcaaggctaggggttctgatctcagggttcacttcaagaatactagagaaaccgcacatgccatcaggaaattgcctttaatcaaggcgaaaaggtacttggaggacgtccttgctcataagcaggccatacccttcactcgtttttgtaggggtgtagggcgtactgctcaggcaaagaaccgacattccaatggtcaaggtcgatggcctgccaagtcagcaaagtacattttggatttactcaagaatgccgaaagcaatgctgaggtgaaaggattggatgtggatgcacttttcatttctcacatacaagtgaaccaagctcagaaacaaagacgtagaacataccgtgcccatggaagaatcaacccttatatgtcatctccctgccatattgagttgactttgtctganaaggaggagcctgtgaaaaaggaggctgaatctaggttggcaactagtggcaagtagaagaatcatacttttggatatcagttttggattgatttttgtgcttcattgttgaagaccaattttgttctatatacttatgattttgtacaatgatattgggttttctttaatcataaagagagttatggttttatgctggcc

SEQ ID NO: 1450 - DNA, 820 bp, Brassica juncea
gaagatagtttagttcatatgtcccccgttatatataaactaaactatcttcatcaactccaaatcacttctccttcagttcttctctttggccgccatggtgaagtactcacaagaaccagacaactccaccaaatcttgcaaggcaaggggagccgatcttagggtccacttcaagaacacaagagagacagcgcatgccataagaaagctaccattgaacaaggcgaaaaggtatttagaagatgtgattgcacacaagcaagctatccccttcacacgtttctgtcgtggtgttggacgtactgctcaggcaaagaacagacattcaaacggtcaaggtcgttggcctgctaaatctgctcatttcgttcttgatctcctcaagaatgctgagagcaacgctgaggtcaaaggcttggatgttgatgcacttttcatatctcacatccaagtcaaccaagcagctaaacagaggcgtaggacttaccgtgctcatggaagaatcaatccttacatgtcaaacccatgccacattgagttgattttgtcagagaaggaagagcctgtgaagaaagagccggagactcagttggcagctaaatcaaagaagggagcctcggcttgagcctatagacaagtagttttttcgtggtgacctctgttacaagaacgcatgatacattttgttcacttaccgttctgtaagaatatgttgctttgtttgtggaataccggagctttgttcatttattgagtaaccaattccagaaatttttaaacgaatcagttcaaaaatgattacactctcaatcctgcc

SEQ ID NO: 1451 - DNA, 890 bp, Rosa hybrid cultivar
aaacaaaccctatcgcacaacccttcactgaagcagaagcagcaccagccgccatggtgaagtactccaaagagcccgataatcccaccaagtcttgcaaagcaaggggctctgacctcagagttcatttcaagaacacaagggagactgcgttctcaatcaggaagatgtccttgattaaggcaaagcgatatctggaggatgttttggttcacaagcaagccattccattcagacgtttctgccgtggtgttgggcgtacagctcaggccaagaacaggcattccaatggccagggacgctggcctgtgaaatctgccaagttcattttggatttgcttaagaatgctgagagcaatgctgaagtgaagggtttggatgttgactctcttgttgtatctcacatccaagtcaaccaagcacagaagcaaagacgccgaacataccgtgctcatggaagaatcaacccatacatgtcatctccatgccacattgagctcaccttgtctgaaaaggaagaaccagtgaagaaagagccagactcccaattggcaaccagcaaatccaggaagtctcaagctgttcgcagtggtggttctgcttgagtggcaattagacctgccaattgaagagttcctgactatcttgttttttcgtactatgagaaatttttgttgcttattatatagtttgagatgttatgcagacagtttttggaccaccttgtgtactgttaattccagattatctttagtttggatctgtgatggattgcttgaggattaccttgaaatccaatgctagaaacctatgtgatactatgatagaatgggcagatgggcattattttggcaaatattcttgttaaattggttgtcttgtcacgttac

SEQ ID NO: 1452 - DNA, 1088 bp, Picea glauca
aaagcagagcggagcagaagttgttgaggccgcagccatggtgaaatactcgagggagcctggcaatcccaccaaatctgcgaaggccaggggttctgatttacgtgttcatttcaagaacacaagagaaactgcacaggcggttaagaagctacctttaactaaggctaagaggtatttggaggatgtcattgcccacaaacaagcaataccctttcgccgcttttgtggaggtgtttggcagaaccgcccaagcaaagtctcgaaattcaaatggacagggtcgctggcctgtcaagtctgctgaatttttgtaggtttacttaaaaatgcagagagcaatgctgaggtaaggggctcgatgttgatacactttatattttctcacattcaagtgaaccaggctcagaagcagcggagacgaacataccgtgctcatggaagaatcaatccatatatgtcatcaccatgtcacattgagctgatactgtctgaaaaggaagcacctgtcaaaaaagaaggctgaaactcaaattgctccgaggaaaccaaggaaagctcaaacacttcgaagtggtgcctcttcttgagatgttgaagtagtttgaatttgagcacgccaatgcgatatttttaacataaaccttgtctggtttatctttttagtgactggaggaaactacacccgtttttattttactaggatagtatgaattgtagacaaacattttcttattgaaaacttactttaattcatgttattgttgctttgtgtgattttccggctgttgttatagtgcaagccagcctggtaagcatacaaaagtaaaggaaagctttgctttttatgtttttcatggcacaaaactctggatggtttatgtgatcctcaaggtgacgaaaattaaaagacttattttcatgcataccgtgaggacttttctgcaaggctatctggggaatgaaggttcaggttcagttgacaggttcatcaaatgggagatgtcaacatttgacttttgttagatagttcaccatgatatatttcttgaaatttttttatgctcattttttgtttgctgttagtt

SEQ ID NO: 1453 - DNA, 801 bp, Helianthus annuus
atatcctgcagtaactccattgaagcataagcagccgcagcaatggtgaaatactcgaaggagcctgataatcctacaaaatcctgcaaagctaggggttccgatctcagatgtcactttaaaaatacaagagaaaccgcacatgccataaggaagttgcctttgatcaaagcaaaaagatatctggaggatgttttggcccacaagcaggccattccgtttacccgtttttgtaggggtgttgggcgtacagctcaggccaaaaacaggcactctaatggtcaaggtcggtggcctgccaagtcagctaaattcattttggatttactcaagaatgctgaaagcaatgctgaggttaaaggcttggatgttgatgcacttttcatttcacatattcaagtaaaccaagctcagaaacaaaggcgtagaacataccgagctcatggaagaatcaacccctacatgtcatctccctgccacattgagttgactttgtctgaaaaggaagagcctgtgaaaaaagaggcggaatctcaactggcaaccagtggaaagtcaaagaagtcccaggcctagttcatgccatagaaacgtttaggtttgaccagaaacagttttgaactactattgtcttttgtgttttgaagacgatctttgtttggcgatcgtgtttttgtggcaagtgtactttgtttttggatgttcgattagtgtcaaaagaaatatggttcttatgattctaaccaaaaaaaaaaaacacactcaaaaaattgtggccgcttcggccaatccattttaaat

SEQ ID NO: 1454 - DNA, 728 bp, Helianthus annuus
accatatcctgcagtaactccattgaagcataagcagccgcaacaatggtgaaatactcgaaggagcctgataatcctacaaaatcctgcaaagctaggggttccgatctcagatgtcactttaaaaatacaagagaaaccgcacatgccataaggaagttgcctttgatcaaggcaaaaagatatctggaggatgttttggcccacaagcaagccattccgtttacccgtttttgtaggggtgttgggcgtacagctcaggccaaaaataggcactctaatggtcaaggtcggtggcctgccaagtcagctaaattcattttggatttactcaagaatgctgaaagcaatgctgaggttaaaggcttggatgttgatgcacttttcatttcacatattcaagtaaaccaagctcagaaacaaaggcgtagaacataccgagctcatggaagaatcaacccttatatgtcatctccatgccacattgagttgactttgtctgaaaaggaagagcctgtgaaaaaagaggcggaatctcaattggcaaccagcggaaagtcaaagaagtcccaggcttagttcaagtcatagaaacatttaggtttgatcggaaacagttttgaactactattgtcatttgtgttttgaagacgatctttgtttggccctcgtgtttttgtggcaagtataattggtatttggagttttttgttatcaaatgaaagatg

SEQ ID NO: 1455 - DNA, 673 bp, Helianthus annuus
gcagcaatggtgaagtactcgcaagagcccgataatccgacaaaatcctgcaaagccaggggttctgatctgagatgccatttcaagaactcgagagaaacggcgcatgctatcagaaagttgcctttgatcaaggcaaaaagatatttggaggacgttctggcccacaaacaggctataccgttcactcgtttttgtaggggtgttgggcgtacagctcaggcaaaaaaccgacattctaatggtcagggtcggtggcctgccaagtcagcaaaatttattttggatttactcaaaaatgctgaaagcaatgctgaggtcaaaggcttggatgttgatgcacttttcatttcacacattcaagtgaaccaagctcaaaagcaaaggcgtagaacataccgagctcatggacgaattaatccttatatgtcatctccgtgtcatattgagctgactttatccgaaaaggaagagcctgtgaaaaaagaggcggaatcacaactggcaaagtcgaagtagtctcagacttgatctatggcttatttatttaattttaaccaaaaaaacctttcaaaactattctcagggttaattttgtcgtttgtggcttctacttgtgaacacaaattttgttggagaattttgtattggtgcctaatatatttatttttgg

SEQ ID NO: 1456 - DNA, 1230 bp, Abies balsamea
atgctaagctctttcccatgtgacctcattgttagggtttgtggattcggggttttttagggtttgttcgcctgtttaacgttttacttattttcagaggaagaaacccgagaacaaacgagagcggaggagacgaagcagaaatctgaacacaatggtgaagtattcaagggagccttctaatcctaccaaatcatgcaaggctcgggggtcagacctacgggtccattttaagaatactcgagaaacagctcaggctgtgaagaagttacccttggccaaggctaagagctatcttgaggatgtgcttgcccacaagcaagctatacccttccgtcgcttttgtgggggggtaggacgtactgcccaagcaaagtctcggcattctaatggccagggccgttggcctgtcaagtctgctcagtttttgttacaactgctgaagaatgcagaaagcaatgcagaggtgaagggacttgatgtggatgcactatacatttctcacatacaagtaaaccaggctcaaaaacagaggagacgaacttatcgtgcccatggaagaattaatccttacatgtcatcgccatgccatattgagttgatactgtctgagaaagaagcacctgttaaaaaggaggttgaatcacaaattgctcccactaggtcaaagaaaggccaagctcttagtagtggcacctcctcataaggtgctaaggtgctagagcagttttaatgcagcacttcactaccacaaattttgaaagcaaggattatcaaggcacggagttttttgtagttttcttgtgggaactataccacctatttgtttaccaaactggaattctaaagtctagactctagacagagcaatttgtcaaattttgtttgtctttgtttttattgcagttatttttgtgcttgattgccatctatgggtttgaaacagcaagctcagtaagatggaagcctttaacttctgttctctgcaatgtttaagacaccgaggaaagattgtaagattgcttgcaggattatttctttgctgagtaacttaaaatggacttattttccatgcataccatgtggaagtgtctgcaaggctgcctggggaatgaagctttgggttcaaagtgtttgttgttagaattctgacagaccttttaatgttagagacttctagttgtacggtgtaccttaaaatatgatatatttatgaagcggttggttggg

SEQ ID NO: 1457 - DNA, 791 bp, Malus domestica
ataagcaaaagcgtaaacccttcactgacgcagaagctccatcggccgccatggtgaagtactccagagagcccgacaatatcaccaagtcttgcaaagcaagaggttctgacctgagggttcatttcaagaacacaagggaaactgcgttttctatcagaaagatgcgcttggacaaggcaaagagttatttggaggatgttctggctcacaagcaggccattcccttccgtcgtttctgccgtggtgttgggcgtactgcccaggcaaagaacaggcattccaatgggcaaggacgctggcctgtcaagtctgccaagttcatattagatttgcttaagaatgctgagagcaatgctgaagtgaagggtttggatgttgattccctaatcgtatctcacatccaggtcaaccaagcacagaagcaaaggcgccgaacctacagggctcacggaagaatcaacccttacatgtcatcgccctgccatatcgagctgatcctttccgagaaggaagaacccgtcaagaaagagcccgagagccagttggcaacaagcaaatcgaagaagtctgcgcttaagagtggtgcttcctcttagagcgtatcattggggttgctggtttcctttgatgagggttttttgctgcttttttatttagtttgagatgttatgtagacaacttttgggcctcttgttgtttgagttccaaattatgttttgtttgggtaatacgcttgataactaatggtagacataatttcataattaagccccacattattatgcctc

SEQ ID NO: 1458 - DNA, 787 bp, Malus domestica
gcaaaagcgtaaacccttcactgacgcagaagctccatcggccgccatggtgaagtactccagagagcccgacaatatcaccaagtcttgcaaagcaagaggttctgacctgagggttcatttcaagaacacaagggaaactgcgttttctatcagaaagatgcgcttggacaaggcaaagagttatttggaggatgttctggctcacaagcaggccattcccttccgtcgtttctgccgtggtgttgggcgtactgcccaggcaaagaacaggcattccaatgggcaaggacgctggcctgtcaagtctgccaagttcatattagatttgcttaagaatgctgagagcaatgctgaagtgaagggtttggatgttgattccctaatcgtatctcacatccaggtcaaccaagcacagaagcaaaggcgccgaacctacagggctcacggaagaatcaacccttacatgtcatcgccctgccatatcgagctgatcctttccgagaaggaagaacccgtcaagaaagagcccgagagccagttggcaacaagcaaatcgaagaagtctgcgcttaagagtggtgcttcctcttagagcgtatcattggggttgctggtttcctttgatgagggttttttgctgctttttatttagtttgagatgttatgtagacaacttttgggcctcttgttgtttgagttccaaattatgttttgtttgggtaatacgcttgataactaatggtagacataatttcataattaagccccacattattatgcctct

SEQ ID NO: 1459 - DNA, 1156 bp, Aristolochia fimbriata
gaaaacatggtccgcactccggacccttactaaggttttagggttagggtttataaatgtcagtcttcttattctcgttcctcgtttgcctcgagtgacttcagagccggagcagccatggttaagtactcgagagaacctgataacccaactaaggcctgcaaggctcgtgggtcagatctccgtgtgcacttcaagaacacccgggaaactgctcatgccataagaaagcttcctttggtcaaggctaagcgctatctggaagatgttattgctcataagcaggctattcccttcaggaggttctgtggtggtgttggcagaactgctcaagcgaagaataggcattccaatggtcagggaaggtggcctgtgaaatctgcaaagttcattcttgaccttcttaagaatgcggagagcaatgctgatgtgaaaggactggatgttgatgctctttatgtaagtcatgtccaagtcaaccaagcacagaaacagaggcgcaggacataccgtgctcatggacggatcaatccatacatgtctagcccctgtcacatcgagttgattttgtctgagaaagaagaaagtgttaagaaggagcccgacactcaattggcaccacggaaatcgaagagccaagccctgcgcagtggtgcttcatcagcttaattcgtggcgcttttctattgtttctgtgttactcgtgttgaacttttagtttaagctcaaagttttgtactgtttgtggtttttttcccatctatctctctttattgtgaacctgaattatactgaattagtctattgagcagggtttagttattttcaattttggataatgatgatgatttaaagacctcagaaaccgtgtttgtctttggtagcttttgtattccatcctcgtggtaccggaatttgacagcagccttttgaatccgattctggctgcatgggattattagttttgtttcattacacgaccaagtctgcaagaatcatgatgttttcacaagctgcagaggggattgtcttcttcccctgctgtttggtgcagaacttttataagtgtaatccctcttgctccatgttggggtagagaacggggctggctctggggcgccctctgttttatttatgaccgaacctcgttctatga

SEQ ID NO: 1460 - DNA, 641 bp, Brassica juncea
gcagccatggtgaagtactcgcaagaacccgacaatcagaccaagtcttgcaaggctagaggatccgatcttagggttcacttcaagaacactcgggaaacagcgcacgctatcaggaagctaccattgctcaaggctaagaggtaccttgaggatgtgatagctcacaagcaagctattaccttcacccgtttctgccgtggtgttggacgtactgctcaggcgaagaacaggcattcaaacggtcaaggtcgttggcctgccaagtctgctcagttcgttcttgatcttcttaagaatgctgagagcaatgctgaggtcaaaggtttggatgttgatgcccttttcatttctcacattcaagtgaaccaagcagcaaagcagaggcggaggacatatcgtgcacatggaagaatcaatccttacatgtcaaacccatgccacattgagttgatattgtccgagaaggaagagcctgttaagaaagagccggagactaagttagctgcaaagtcaaagaaaggagcctcgtcttgagcctagttacagtagctttcttgtggtgtgtgatacattttcttcacttttattgtaagacaacggagccgattctaaaaaacataagatacgatgattggatt

SEQ ID NO: 1461 - DNA, 806 bp, Fagus grandifolia
gcgttagacaccactctctttgccccagaaagctcagtactcagtgacccttcccatattttctgaatcaacaacaatggtgaagtattcgagggagcctgaaaatcccactaagtcctgcaaggccaggggctcggatctgagagctcatttcaagaacacaagagagacagcccatgctattagaaagttgcctttacttaaggctaaaaggtatctggaagatgttctggtccacaaacaagccattcccttccgacgcttttgtcgtggtgttggtcgaaccgctcaggcaaagagccgtcattcaaatggtcaaggacgctggcctgttaaatctgctaaatttattcttgacttgcttaagaatgctgagagcaatgcagaagtgaaaggtctggatgtggattctctgcacatatctcacatccaggtgaaccaagcccaaaaacagaggcgccggacctaccgtgctcatggaagaatcaatccctatatgtcatctccctgccatattgagttgaccttgtctgagaaggaagagccagtcaagaaggagcctgaaacacagttggctcctagcaaaaccaggaagactcaagctttacgagtggtgcttcttcttgaaatatggtggctacagggaattctagttattcatttctttattgtccactccggttaattagaatgcatccttctaagataatatttcatttaaaattgagaaccttgtctctgttttccttaatgtttttctatctgattttcttttttgtagtacttgtgtggaacttgaatgtcgg

SEQ ID NO: 1462 - DNA, 660 bp, Brassica napus
aggtgaagtactcgcaagaacccgacaattccaccaaatcttgcaaggcgaggggagcagatcttagggtccacttcaagaacactagggaaacagcgcatgctataaggaagctacccttgctcaaggcgaagaggtacttggaagatgtgatagctcacaagcaagctatccccttcacacgtttctgccgtggtgttgggcgtactgctcaggcgaagaacaggcattcaaacggtcaaggtcgttggcctgccaaatctgctcagttcgttcttgatcttctcaagaatgctgagagcaatgctgaggtcaaagggttggatgttgatgcccttttcatttctcacattcaagtgaaccaagcagcaaagcagaggcggaggacataccgtgctcatggaagaattaatccttacatgtcaaacccatgccacattgagttgatattgtcggagaaggaagagcctgttaagaaagagccggagactcagttggccgccaagtccaaaaaaggagcctcgtcttgagcctagggactgtagttatcgtgtggtcacattgtgtgatacattttgttcacttttattattgtaagacaacgcagccgtttaaaaaacatgattgaattttggataacagaagcgttgactttattta

SEQ ID NO: 1463 - DNA, 738 bp, Centaurea maculosa
  misc_feature (5)..(5): n is a, c, g, or t
  misc_feature (9)..(9): n is a, c, g, or t
  misc_feature (22)..(22): n is a, c, g, or t
  misc_feature (172)..(172): n is a, c, g, or t
  misc_feature (223)..(223): n is a, c, g, or t
taggngggngctatctgagaancgaaattcagcggcatttgcaaaccagttgctccaatggtgaagtactcaaaggaaccggataatccgacgaaatcttgcaaagctaggggagcagatctcaggtgccatttcaagaacactagagaaactgcccatgctatacgtaagntgcctttaattaaggctaaaagatatttggaggatgttcttgcccataagnaagctatccctttcacacgcttctgtcgtggagttggacgtacagcacaagcaaagaatcgccattcaaatggacaaggacgttggcctgctaaatccgcaaagtttatcctggacttgctcaagaacgccgagagtaatgcagaagttaaaggcttggatgtggatgctcttcacatctcccacatccaggtgaaccaagcacagaaacagagacgtcgcacatatcgtgctcatggaagaatcaacccttacatgtcttctccatgccacattgagctcaccttgtctgagaaggaagaacctgttaagaaagagcctgagagtcaattggccgcaagaaagaccaactagaatgaagcataactcgggtggatcgattggattaagttggcaagtcatagattggtagtagaaaaagttcaatttttttttctcattattatcagggaatgaatacatgcatttttgtatttgaaggtctatgtttgatatttgattacaagattctttata

SEQ ID NO: 1464 - DNA, 885 bp, Cleome gynandra
tctcttcccctgtataaaagacctccgtcatcttttctttcttctgtcgcagagagaagagatcggccgccatggtgaagtactcaagagaacccgacaattccaccaaatcttgcaaggcgaggggatccgatctcagggttcacttcaagaacacaagggaaactgcgcacgccattaggaagcttcccttgataaaggccaagaggtatttggaagatgttatagctcacaagcaggctattcccttcactcgattctgtcgaggtgttggacgtactgcccaggcgaagaacaggcattccaatggacaaggtcgatggccagcaaaatctgccaatttcatcctcgatttgctcaagaatgcagagagcaatgctgaggttaagggtttggatgtggatgccctatacatatcgcacatccaggttaaccaagcaaggaaacaaaggcgtaggacctatcgtgcccatggaagaatcaatccttacatgtcatccccttgccacatcgagttgatcttgtcggagaaagaagagccagtgaagaaagagcctgagactcagttggcaaccaagtctaagaaatcagcatcatcttaagctcatttctattttgttcatcatcatcttttgtttcttcaagagattattatgttccttttttcccaatagatgaggcatttgattcgagacattgaatgattttggattttctttgacatgtgacattctccttcagttcaacatagtacctcttgtcctaattgtctgccttaccctcttgcttcaaattacgtgacattttgttgatagctctaaggtaaaacactcactcacttatgcaaagagaagttggtttggtccgagttacattttggtcatg

SEQ ID NO: 1465 - DNA, 896 bp, Gossypium hirsutum
gctttcgagcggccgcccgggcaggtacgcggggcctcttttaggcggcagaagcagcttaggcaaccagttcgcagccatggtgaagtattcgaaggagtcagataatcccaccaagtcctgcaaggcaaggggctctgatctcagggttcatttcaagaacacaagggagactgcgtttgctatcaggaagttgcctttgggtaaggctaagaggtatttggaggatgttatggctcacaaacaggccgtacccttcagacgcttctgtggtggtgttggacgtacagctcaggcaaagaacaggcattctaacggacaaggtcgctggcctgtaaaatctgccaaattcattctagatttgctgaagaatgctgagagcaatgccgaggtcaagggtttggatgtggatgcactctatatttctcacatccaagttaaccaggctcagaaacaaaggcgtcgtacataccgtgcccatggaagaatcaatccttacatgtcttctccttgccacatcgagttaattttgttggagaaggaagagcccgttaagaaagagcctgagactcagttggcagctagcaagtcgaagaagtcccaagtatctgtgtagacggtcagcaaaagattgaaattttagtcgatgaaggaagttgtatctgggaaatgatttctgtcttactctgcgagtaagtagttttgatgtttattcaaagtagaaagagttgttagatgtcttttgaaaccttgtttagtcaaatgttattgatctgagattcatgttggagatttttgttttaatccatgattttatatgaagttattttgttgaggaaaataatgatgagtgttcattgccataaaccataattagggaaaaaagggattaaaaa

SEQ ID NO: 1466 - DNA, 847 bp, Gossypium hirsutum
gattcatatatattcttataccttcccacttcttttacttcctcttttaggcggcagaagcagcttaggcaaccagttcgcagccatggtgaagtattcgaaggagtcagataatcccaccaagtcctgcaaggcaaggggctctgatctcagggttcatttcaagaacacaagggagactgcgtttgctatcaggaagttggctttgggtaaggctaagacgtatttggaggatgttatggctcacaaacaggccatacccttcagacgcttctgtggtggtgttggacgtacagctcaggcaaagaacaggcattctaatggacaaggtcgctggcctgtaaaatctgccaaattcattctagatttgctgaagaatgctgagagcaatgctgaggttaagggtttggatgtggatgcactctatatttctcacatccaagttaaccaggctcagaaacaaaggcgtcgtacataccgtgcccatggaagaatcaatccttacatgtcttctccttgccacatcgagttaattttgtcggagaaggaagagcccgtcaagaaagagcctgagactcagttggcagctagcaagtcgaagaagtcccaagtatctgtgtagacggtcagcaaaagataaagattgaaattttagtcgatgaaggaagttgtatctgggaattaatttctgtcttactctttgagtaagtagttttgatgtttattcaaagtagaaagagttgttatgccttttgaaaccttgtttagtcaaatgttattgatctgagattcatgttggagatttttgttttaatccatgattttatatgaagttattttgttgagg

SEQ ID NO: 1467 - DNA, 891 bp, Gossypium hirsutum
ggcacgaggaagggtctttgagtccttcaccttaagctcatgatgcttccattgaccgtgaacactgtcgtacttaaacatgtaggtcatgtattcagtggtgatgaaagctcgtgccgaattcggcacgagcgcagccatggtgaagtattcgaaggagtcagataatcccaccaagtcctgcaaggcaaggggctctgatctcagggttcatttcaagaacacaagggagactgcgtttgctatcaggaagttggctttgggtaaggctaagacgtatttggaggatgttatggctcacaaacaggccatacccttcagacgcttctgtggtggtgttggacgtacagctcaggcaaagaacaggcattctaatggacaaggtcgctggcctgtaaaatctgccaaattcattctagatttgctgaagaatgctgagagcaatgctgaggttaagggtttggatgtggatgcactctatatttctcacatccaagttaaccaggctcagaaacaaaggcgtcgtacataccgtgcccatggaagaatcaatccttacatgtcttctccttgccacatcgagttaattttgtcggagaaggaagagcccgtcaagaaagagcctgagactcagttggcagctagcaagtcgaagaagtcccaagtatctgtgtagacggtcagcaaaagataaagattgaaattttagtcgatgaaggaagttgtatctgggaattaatttctgtcttactctttgagtaagtagttttgatgtttattcaaagtagaaagagttgttatgcctttgaaaccttgtttagtcaaatgttattgatctgagattcatgttggagatttttgtttaatccatgaatttatatgaagttattt

SEQ ID NO: 1468 - DNA, 715 bp, Cucurbita pepo
ggtcggtcaccgcgtaattcaactgtttttcagaagccgaagttgcagacgtcgctatggttaagtactcgagggaacccgacaatcccaccaagtcctgcaaagccagaggttcggacctcagagtccactttaagaacacaagggaaactgcccatgccatcaggaagttgccgctggtcaaggccaagaggtatctagaggatgtacttgcccacaagcaggccattccttttcgtcgcttctgtggtggtgttggacgaactgcccaggcaaagaacaggcattccaatggccaagggcgctggcctgtcaaatctgccaagtttattctagatttgcttgtgaatgccgagagtaacgctgaagtaaagggcctggatgttgatttgctccacgtatctcacatccaagtaaaccaagctcagaagcaaaggcgtcgaacctaccgtgctcacggaagaatcaacccatacatgtcttctccttgccatattgagttgattttgtctgagaaagaagagcctgttaagaaggagcccgagactcagctggctactggcaaatcgaagaaaggtcgagcgatccgaagcggtgcttcttcttgaatcaaaagtacaaattttgatgtgggttttacagtgccattctttttttgaagttagtttaatttataagtcactatatagaaggaggtattatgatttagatgttt

SEQ ID NO: 1469 - DNA, 650 bp, Flaveria ramosissima
gcgaacacataattctgctgttgcaatggtgaagtactcaaaggaaccagataaccccactaaatcttgcaaagctaggggttcagatctcaggtgtcattttaagaacactagggaaactgcacatgctatacgcaagttgccattgattaaggctaagaggtacttagaagatgttcttgcccataaacaagctatcccgtttacgcggttttgtggcggagttgggaggactgcacaagcaaagaatcggcattcgaatggacaaggacgttggcctgctaagtctgcaaagtttatccttgatttgctcaagaatgccgagagcaatgcagaagttaaggggttggatgtggattctctttacatttctcacattcaggtgaaccaagcacagaaacaaagacgtcggacttaccgtgctcatggaagaatcaatccttacatgtcttctccttgtcatattgagctgactttatctgagaaggaagaacctgttaagaaagagcctgagtctcagttggctgcaaaaaagacaaagtagagtctagcaggatatcttaagtggcggacgactttgctaggaagaactttagttgtgttatcattgtcgtgtgaaacatgcacttcaatttatgagattttcatct

SEQ ID NO: 1470 - DNA, 725 bp, Flaveria ramosissima
agaacaacacaaaattctgcagcatttgcaccagcgatccacctgctgcaatggtgaagtactcaaaggaaccagacaaccccaccaaatcttgcaaagctaggggttcagatctcaggtgtcattttaagaacactagggaaactgcacatgctattcgcaagttgccattgattaaggctaagaggtacttagaagatgttcttgctcataaacaagctatcccgtttacacggttttgtggcggagttggaaggactgcacaagcaaagaatcggcattcgaatggacaaggacgttggcctgctaagtctgcaaagtttatccttgatttgctcaagaatgctgagagtaatgcagaagttaaggggttggatgtggattcgctttacatttctcacattcaggtgaaccaagcacagaaacaaagacgtcggacttaccgtgctcatggaagaatcaatccttacatgtcttctccttgtcatattgagctgactttatctgagaaggaagaacctgttaagaaagagcctgagtctcagttggctgcaaaaaagacaaagtagagtctagcaggatatctgaagtggcggacgactttgctaggaagaactttagtttattgtcatcatcatgtgaaacatgcacttcaatttttgagattttgatctgatgtacgattactactttatgtgatctttttatattttatgttgtttgac

SEQ ID NO: 1471 - DNA, 708 bp, Panax ginseng
attcaacaaacctatctgcggcagccatggtgaagtattctaaggaacctgacaaccccaccaaatcttgcaaagccaggggttctggtctcagagttcattttaagaacaccagggaaactgctcatgctattcgtaagttacctctgaccaaggctaaaaggtacttggaggatgttcttgcccacaagcaagctattcctttcacgcgcttctgtagaggagtaggtcgaactgctcaggccaagaacagacattctaatgggcaaggacgctggcctgttaaatcagcaaaatttatcttggacttgctcaagaacgctgagagtaatgctgaagtgaaaggtttggacgtggattcacttcacatatctcacatccaagtcaaccaagcacagaagcagaggcgtcgcacataccgtgcccatgggagaatcaacccttacatgtcatctccctgtcacattgaactgactttgtctgagaaggaagagtctgtcaagaaggagcctgaaactcagttggctcctaggaagaacaagaagaaccaagttttacgcagtggtgcttcatcttgaattatttctaaccgttagtgatttaaggaagtgtgaagaatgtcattctatttcctcagtattatgagaacaatctcgtctctgtcacgattctccctaaaggtttcatgagattatacatatttggcga

SEQ ID NO: 1472 - DNA, 1893 bp, Vitis vinifera
ccctaatccacgaagtcccgccttcgcctcttctctcagcagaacaagagatcaacatctctagtgaggcagaagcagcatcagccgccatggtgaagtactccagagaaccggacaaccccactaagtcttgcaaggccagggggtcagatctcagagttcatttcaagaacacaagggagactgctcatgccattaggaagttgcctttggccaaggccaaaaggtatttggaggatgttctggtccacaagcaagccatacctttcacccgcttctgtagaggtgttgggcgaactgctcaggcaaagaacaggcattcgaatggacaaggacgctggcctgtcaaatctgctaaattcatcctagatttgcttaagaatgctgagagtaatgctgatttgaaaggtctggatgttgattcactctacatatctcacatccaagtgaaccaggcacagaaacaaaggcgccgcacataccgggctcatggaagaatcaacccatatatgtcatcaccatgccatatcgagttgattttgtctgaaaaggaagaacctgttaaaaaggagcctgaaactcagttggcgacaggcaaatccaagaagtctctgcgcggtggtgcttctactcgaattgcaatctgatgatagagctagtaactcttcaagaaattttcatgccaattttaattgtcactctttcattttaagatgagttttgttgtcttaatataaagtcaggggttattgagagtctttgagccactttgttttgttttcagaattttgttgttgagtattttggaaagttatggaaattttagatgaagatacccccgaaataaccctagttttgtcctcttataaatggacctaatcaagtcgattaattgcaaaccatggttattttggccaaaaagtctttcatttggtgcaaatcatcaagaagtttggttcaatgctcacatggttatttctcatctctgcataagctgtcctttttcatattatatttctcaactttccgccatggtgaagtactccagagagccagacaatcccaccaagtcttgcaaggccaggggctcagatctcagagttcacttcaagaacacaagggagactgctcatgccattaggaagttgcctttggccaaggccaaaaggtatttggaggatgttctggtccacaagcaagccatacctttcacccgcttctgtagaggtgttggacgaactgctcaggcaaagaacaggcattcaaatgggcaaggacgctggcctgtcaaatctgctaaatacatcctagatttgcttaagaatgccgagagtaatgctgatttgaaaggtctggatgttgattcactctacatatctcacatccaagtgaaccaggcacagaaacaaaggcgccgcacataccgtgctcatggaagaatcaacccatatatgtcatctccctgccatatcgagttgattttgtccgaaaaggaagaacctgttaaaaaggagcctgaaactcagttggctaccagcaagtccaagaagtctcatgcagtgcgcggtggtgcatcttcttgaatggcaggctgatgatagagctagtaacgctttaagaaattctcatgtcatttttatccaaaaaagaacagaagttttcatgtcaaatttgatttgcccctctttcatttgaaaatgagttttgttgcctttatataaaaatgatggattattgagtgtctttgagccactttgttttgttttatgaagattgttgagtattttgggaagttatggaaattttagattaagatactcgtcccccttaaacaaccttagcgttttcctcttaaaaatagacctaatcaagtcaattaatttgcaagtcatg

SEQ ID NO: 1473 - DNA, 933 bp, Humulus lupulus
accgcctccattgttctctctgctgtagggagtttacaaaacctattactgaggtttgaagctgcacactcgccggcagccatggtgaaatactcaagagagcccgataatatcaccaagtcctgcaaggcaagaggatccgacctcagagttcacttcaagaacaccagggaaacagcgtttgccatcagaaagttgcctttgatcaaggctaagagatatttggaagatgttctagtccacaaacaagccattcccttccgaaggttctgtcgtggtgttgggcgtactgcacaggctaaaaacaggcattccaatgggcaaggtcgttggccagtcaagtcagccaagttcatacttgatttgcttaagaatgctgagagcaatgcagaggtcaagggtttagatgtcgatgcactctttgtatctcacatccaggtcaaccaagcacagaagcaaagacgtcgtacttaccgtgctcatggaaggatcaacccctatatgtcatccccttgccatattgagttgactttatctgagaaagaagaagctgtcaagaaagaggccgagacccagttggcaacaaacaaatcaaagaaaacccaacttcgcagtggtgcttcttcttaagagttccattcatttagttctactttggagggtcatcagatttttcgtttctttctcctgtggaattttgttgctttaaaaatataacaattaaatgttatctagataattttcagacatcgtgtgttcgtccaagttctggttagctcaatgtcattgagaattttggattggtatttatttggtggatagatttacccaagtcttttatggcttttttgaccattattttgtcatgttatattatcggcggctatacttctaaaaacaacttggaaaataagaaaactgaaaattcgagtt

SEQ ID NO: 1474 - DNA, 780 bp, Mesembryanthemum crystallinum
  misc_feature (20)..(20): n is a, c, g, or t
  misc_feature (729)..(729): n is a, c, g, or t
  misc_feature (748)..(748): n is a, c, g, or t
  misc_feature (755)..(755): n is a, c, g, or t
  misc_feature (765)..(765): n is a, c, g, or t
  misc_feature (773)..(773): n is a, c, g, or t
  misc_feature (776)..(776): n is a, c, g, or t
  misc_feature (779)..(779): n is a, c, g, or t
acattggtctgaaccatcgngctgcaggaattcggcacgagagagagagaggcagcagcactccctcaaaaccctaaaaatggtgaagtactctagagaacccgataatcctaccaaatcatgcaaggctaggggctcggatctccgagtgcatttcaagaacacaagggaaaccgcattttccatcaggaagatgcctttggccaaggccaagaggtatatggaggatgttcttgctcacaagcaggcaattcctttccgccgtttttgtggtggtgttggaagaacggctcaggcaaagaacaggcactcgaatggtcagggacgttggcctgcaaagtctgcaaaattcattcttgatttactgaagaatgcagagagcaatgcagagatgaaaggtttggatgttgattctctgtacgtctctcatgtccaagtgaaccaggctcaaaagcaaaggcgtaggacttaccgtgctcatgggcgtatcaacccctacatgtctcatccctgccacattgagttgattttgtcggagaaggaagagccagttaggaaggagcctgagtcgcagctggcaaccagcaaatctaagaagtcacaggcatcttgagtgttaaaataggattctagcctggaaaggaaatttgttctactgtgagatcttggtttttgtagacgaaagtattgttcatctaaatcacttattaaagtttcagagagcacctnggttttgttctaatgcatnaagagtnagtgttttgnggaaaaanaanaant

SEQ ID NO: 1475 - DNA, 978 bp, Mesembryanthemum crystallinum
  misc_feature (26)..(28): n is a, c, g, or t
  misc_feature (31)..(31): n is a, c, g, or t
  misc_feature (34)..(34): n is a, c, g, or t
  misc_feature (39)..(39): n is a, c, g, or t
  misc_feature (721)..(721): n is a, c, g, or t
  misc_feature (723)..(723): n is a, c, g, or t
  misc_feature (728)..(728): n is a, c, g, or t
  misc_feature (735)..(735): n is a, c, g, or t
  misc_feature (740)..(740): n is a, c, g, or t
  misc_feature (747)..(747): n is a, c, g, or t
  misc_feature (749)..(749): n is a, c, g, or t
  misc_feature (753)..(753): n is a, c, g, or t
  misc_feature (757)..(757): n is a, c, g, or t
  misc_feature (765)..(765): n is a, c, g, or t
  misc_feature (773)..(773): n is a, c, g, or t
  misc_feature (780)..(780): n is a, c, g, or t
  misc_feature (785)..(785): n is a, c, g, or t
  misc_feature (787)..(787): n is a, c, g, or t
  misc_feature (792)..(792): n is a, c, g, or t
  misc_feature (794)..(794): n is a, c, g, or t
  misc_feature (797)..(797): n is a, c, g, or t
  misc_feature (807)..(807): n is a, c, g, or t
  misc_feature (809)..(809): n is a, c, g, or t
  misc_feature (812)..(812): n is a, c, g, or t
  misc_feature (816)..(816): n is a, c, g, or t
  misc_feature (875)..(875): n is a, c, g, or t
  misc_feature (916)..(916): n is a, c, g, or t
cgggctgaggaacccccggctgcagnnnttnggnactanaaccgccattgacgcatcctccaagcagcagcaacagcagcagccatggtgaagtattcgcaagaaccggacaaccccaccaagtcttgcaaggctaggggctcagatcttagagtccatttcaagaatacaagggagaccgcattctcactccgaaaaatgcccttggccaaggctaaaaggtatttggaagatgtccttgcccacaaacaagcaattccattccgtcgtttctgtcgaggagttggacgaactgctcaggctaaaaatcgccattcaaatggacagggacgttggcctgccaaatctgcaaagtttattctggatttgctcaaaaatgctgagagcaatgctgaaatgaaaggattggatgtggattccctttacatctctcacattcaggtgaaccaagctcaaaagcagaggcgtcgaacataccgtgcccatggaagaatcaacccttacatgtcacatccatgccacattgagctaatcgtgtcggaaaaggaagaaccagtgaaaaaggagcctgaatctcagctggccacaagcaaatcaaagaagggtgcctcatcttgagcaaagtgaagttaaaagtcttgagcagagaaattgaggagttgaagacccttttttcccttttttggaagttgtagaatgtgacctttattttcgtttcatnancgatnggacatnttttntcccctntncctntcgnttgggctngcattttngtgctgnttatnanatatngnganagccctttgntncantggngatatttggaatttaaatagtagaactttatgaggggaattgggttggtcccaccaaantaatattctcccccttacatctttctccctttccacactancccctcgcgggggggccccggccccaaatccccctaattggggtgggtttcccccccccccg

SEQ ID NO: 1476 - DNA, 601 bp, Eragrostis curvula
  misc_feature (55)..(55): n is a, c, g, or t
gggaaggagaccaggacgcatggtgaagtactcgacggagcggtcatccaccaangccgccaagccatgggccgggatctccgtgttcacttcaagaacacccgtgagacagcgtttgcactgaggaagttgccactcaccaaggccaaaaggtaccttgaggatgtgatcgcccacaagcaagccattcccttccgcaggtactgtggtggtgttgggcgcactgctcaggctaagaaccgtcagccaaatgggcagggacgctggccggcaaagtctgctaggttcattctggatcttctcaagaatgcggagagcaacgctgaggtcaaaggtctggatgttgatgccctctacatttcgcacattcaagtaaaccaggctcagaagcagcggcgcaggacctaccgtgctcacgggcgcatcaatccttacatgtactccccgtgccatattgagctgatcttgtcggaaacggacgagccagtgaagaaagaggctgagtctcaaatcccaacaaggaacggacttagagaagcgaaagctttgacacatcttggaatgtaaagtggaactgtagaatactggacgtatggcttgg

SEQ ID NO: 1477 - DNA, 738 bp, Nuphar advena
  misc_feature (673)..(673): n is a, c, g, or t
  misc_feature (689)..(689): n is a, c, g, or t
gtcgctcttgctgggggagatcgatccggaacgagaatggtgaagtactccagggaacccgataaccccaccaaatcgtgcaaggcacggggttcggatcttagggttcacttcaagaatacccgtgagacagcctttgcaataaggaagctgccattggacaaggcaaagaggtacctcgaggatgttattgcccacaagcaagccattccattcaggcgtttttgtggtggagttgggcgaacagctcaagcaaaggttcgccattctaatggccaagggcgatggcctttaaagtctgccaagtttatcctgaacttgctgaaaagtgctgagatcaatgcagatgtgaaaggtttggatgttgatacactgtatatttctcacattcaagttaaccaggcccaaaagcagagaagacgtacttatcgtgcacacggacggataaacccttacatgtcttcaccttgtcatattgagctgattttgtcagagaaggaggctcctgttaagaaagaggctgaaacacaggttgcacccaggtagcccaaagaaaatcaagtaattcgaagtggggcatccccttgtagagcgtgggagaggctgagagcaagagcagtaatacgaattgtggattttgggattttaggatttcttatcttgcgagttttgngtttattatcttcagntcttacttcctgaggtgttttacgaacttctcacagtacagtgattttt

SEQ ID NO: 1478 - DNA, 777 bp, Ananas comosus
caagcggagtgcggcggcgagagcgattcctctccgtttccccccacctccccaatctctccgcggccatggtgaagtactcgagggagcccacaaaccctaccaagtccgccaaggccatgggccgggacttgagggttcactttaagaacactcgtgagacagcttttgcaattaggaagctgccgctggcaaagactaaaagataccttgaggatgtgattgctcacaagcaagcaattcccctccgcaggttctgtggaggcgttggccggactgcacaggctaagtcccgccactcaaatgggcaaggccgctggcctgtcaagtcttgcaggttcattttggatctgctcaagaatgctgaaagcaatgcggaggtgaagggtttggatgttgatgctctctacatttcgcacgtccaagtgaatcaagcccagaagcagaggcgtcgcacctatcgtgctcacggccgcatcaacccttacatgtcttctccgtgtcacattgaattaattttgtcggagagggaagagccagttaagaaagagccggagtcgcagattgcgcccaggaagactaagaacactgttgcataagtaagcagaatctcttcctgagtagaaatatcagtgattgtagtaaatttgagttgaaattttgcgatggctgcccactcatttgtttcaatgttagatggacttaaggtcaccttttacttatcagctagtattttagtggaatttgtcagcgtcttattggattatatttctggtt

SEQ ID NO: 1479 - DNA, 834 bp, Prunus persica
cacacgactcgcctcttctgctaaatagcaaacgcaaaccccttctgtgaggcagaagcagcatcagccgccatggtgaagtactccagggagcccgacaatatcaccaagtcctgcaaagcaaggggttctgacctcagagttcatttcaagaacacgagggaaactgcatttgctatcagaaagttgcccctagtcaaggcaaagaggtatttggaggatgttctggtccacaagcaggccattcccttccgccgtttctgtcgtggtgttgggcgtactgctcaggcaaagaacaggcattccaatggacagggacgctggcctgtcaaatctgccaagttcatattagatttgcttaagaatgctgagagcaatgctgaagtgaagggtttggatgttgattcgctaattgtatctcacatccaagtcaaccaagcacagaagcaaaggcgcagaacctacagggctcacggaagaatcaacccctatatgtcatccccctgccatattgagctgattttggccgagaaggaagagcctgtcaagaaagagcctgagagccagttggcaactagcaaatctaagaagtctcaagctctacgaagcggtgcttcctcgtaaagtgtcacaagaaatcgaagaggcattatcgattcatcgtttgcattgatatggtttttggctgctttttatatagtttgagatgttgtgtagacaatttttggtactcgtgttttagtttcagattatgttatgttttgttggagaatatgcttgaaagtcgatgtttatcataattagaccccatcaatatcatgagccttttatata

SEQ ID NO: 1480 - DNA, 703 bp, Raphanus sativus
  misc_feature (10)..(10): n is a, c, g, or t
  misc_feature (62)..(62): n is a, c, g, or t
  misc_feature (179)..(179): n is a, c, g, or t
  misc_feature (314)..(314): n is a, c, g, or t
  misc_feature (341)..(341): n is a, c, g, or t
  misc_feature (356)..(356): n is a, c, g, or t
ggagcaacangtctcttcttgtccatcaaatcttctcttaggccgcaatggtgaagtactcncaagaaccagacaacaccaccaaatcttgcaaggcaaggggagccgatctcagggtccacttcaagaacactagggagacagcgcatgccataagaaagctaccgttgaacaaggcnaaaaggtacttggaagatgtgattgcacacaagcaagcgatccccttcactcgtttctgtcgtggtgttggacgtactgctcaggcaaagaatagacattcaaacggtcaaggtcgttggcctgctaaatctgcncagttcgttcttgatcttctcaagaangctgagagcaacgcngaggtcaaaggtttggatgttgatgctcttttcatatctcacatccaagtgaaccaagcagcaaaacagaggcgtagaacataccgtgctcatggaagaatcaacccttacatgtcaaacccatgtcacatcgaattgattctttcagagaaagaggagcctgtgaagaaagagccggagactcagttggcagcgaagtcaaagaagggaacctcgtcttgagcggcgcctatagacagtagttatcgttgtcacaaacgcttgatacatttttgttcactccttcgttaagacaagtaactaaaatttttaagacaaaaaaaattgattggtgccaaaaaaaaaaa

SEQ ID NO: 1481 - DNA, 717 bp, Raphanus sativus
ggtcttctcgtttggccgccatggtgaagtactcccaagaaccggacaattcgaccaaatcttgcaaggcaaggggagcagatctcagggtccacttcaagaacactagggaaacagcgcatgccatacggaagctgccactgatcaaggcgaaaaggtacttggaagatgtgatagcccacaagcaagctattcccttcacacgtttctgtcgtggtgttggacgaactgctcaagcaaagaacagacattcaaacggtcaaggtcgttggcctgccaaatctgctcagttcgttcttgatctcctcaagaatgctgagagcaatgctgaggtcaaaggtttggatgttgatgcccttttcatttctcacattcaagttaaccaagcagcaaaacagaggcggaggacatatcgtgcccatggaagaatcaatccatacatgtcaaacccatgtcacattgagttgattttgtcagagaaggaagagtctgtgaagaaagagcctgagactcagctggctgccaagtcaaagaaaggtgcctcgtcttgagtctagatacagtagctatcttgtggtcacgttgggtgatacattttgttcactttcatttgtttgtggatcctttttaaaaaaaaacacacaaatgatcttttgtttgtcacaccagaagcgttgaatttatttacaaatcaaacaaatcgtgatttggttttga

SEQ ID NO: 1482 - DNA, 810 bp, Rosa hybrid cultivar
gcacgagctcgtgccgattcggcacgaggcacgacccttcactgaagcagaagcagaagcagaaccagccgccatggtgaagtactccaaagagccagataatcccaccaagtcttgcaaagcaaggggctctgacctcagagttcatttcaagaacacaagggagactgcgttctcaatcaggaagatgtccttgattaaggcaaagcgatatctggaggatgttttggttcacaagcaagccattccattcagacgtttctgccgtggtgttgggcgtacagctcagggcaagaacaggcattccaatggccagggacgctggcctgtgaaatctgccaagttcattttggatttgcttaagaatgctgagagcaatgctgaagtgaagggtttggatgttgactctcttgttgtatctcacatccaagtcaaccaagcacagaagcaaagacgccgaacataccgtgctcatggaagaatcaacccatacatgtcatctccatgccacattgagctcaccttgtctgaaaaggaagaaccagtgaagaaagagccagactcccaattggcaaccagcaaatccaggaagtctcaagctgttcgcagtggtggttctgcttgagtggcaattaaacctggcaattgaagagttcccaactatcttgttttttcgtactatgagaaatttttgttgcttattatatagtttgagatgttatgcagacagtttttggaccaccttgtgtactgttaattccagattatctttagtttggatctgtgatggtttgcttgaggattaccttg

SEQ ID NO: 1483 - DNA, 785 bp, Euphorbia esula
  misc_feature (700)..(700): n is a, c, g, or t
ggcacgaggcaacagccgtcatggtgaagtactcaagagagcccgataattctaccaagtcctgcaaggcaaggggctcggaccttagagtccacttcaagaacaccagagaaacagcgttcgccttgagaaagttacctttggccaaggccaaaaggtacttggaagatgttatggcccacaagcaagccatacccttccgtcgtttttgtggtggtgttggaagaactgctcaagcaaaaagcaggcactctaatggccaaggacgctggcccgcaaaatctgccaagtttattctagacttgctcaagaacgctgagagcaatgctgaggttaaaggattggatgtggagaacctctatattactcatatccaggtgaaccaggcacaaaagcagaggcgtcgtacctacagggcccatggaagaattaatccttacatgtctagcccttgccacattgagttgattttgtctgagaaggaagaatcagttcagaaagagcccgagacccagttggccacaagcaaatccaagaagtctcaagctgtaagaacaggtgcttctgcttaagtgggtctgtcattgaccaatcaaaggagaagttttgaattgaatactttgtattttgctcttcagtttgaggaattttgtttgttctcattttagaatgatatgctacttagatgaattgaacagcntgtttgtttgttttgacctatgtttagttaattgttctgagattttatccttgactatttatatgggagcttatctttgcagagt

SEQ ID NO: 1484 - DNA, 814 bp, Helianthus annuus
gagttcagacaccatatcctgcagtaactccattgaagcataagcagccgcagcaatggtgaaatactcgaaggagcctgataatcctacaaaatcctgcaaagctaggggttccgatctcagatgtcactttaaaaatacaagagaaaccgcacatgccataaggaagttgccgttgatcaaggcaaaaagatatctggaggatgttttggcccacaagcaggccattccgtttacccgtttttgtaggggtgttgggcgtacagctcaggccaaaaataggcactctaatggtcaaggtcggtggcctgccaagtcagctaaattcattttggatttactcaaaaatgctgaaagcaatgctgaggttaaaggcttggatgttgatgcacttttcatttctcatattcaagtaaaccaagctcagaaacaaaggcgtagaacataccgagctcacggaagaatcaacccctacatgtcatctccttgccacattgagttgactttgtctgaaaaggaagagcctgtgaaaaaagaggcggaatctcaactggcaaccagtggaaagtcaaagaagtcccaggcttagttcatgccatagaaacgtttaggtttgaccagaaacagttttgaactactattgtcattcgtgttttgaagacgctctttgtttagcgctcgtgtttttgtggcaagtgtactttgtttttggatgttctattaatttcaaaagaaagatggttcttatgattctaaccaaaaaaaaaaaacacactcaaaaaattgtggccgcttcggccaatccattttaaat

SEQ ID NO: 1485 - DNA, 763 bp, Eutrema halophilum
acctagtctcttctccgtcagttcttctgtttggccgtcatggtgaagtactcgcaagaacccgacaattccaccaaatcttgcaaggcgaggggagccgatctcagggtccacttcaagaacactagggagacagcgcatgccataagaaagctaccattgaacaaggccaaaaggtacttggaagatgtgatagctcacaagcaagctatccccttcacacgtttctgtcgtggtgtgggtcgtactgctcaggcgaagaacaggcattcaaacggtcaaggtcgctggcctgctaaatccgctcagttcgttcttgatcttctcaagaacgctgagagcaatgctgaggtgaaaggtttggacgtcgatgccctcttcatttcacacatccaagtgaaccaagcagcaaaacagagacggaggacatatcgtgctcatggaagaatcaatccttacatgtcaaacccatgccacattgagttgattctgtcagagaaggaagagcctgtgaagaaagtgcccgagactcagcttgcagccaagtcaaagaaaggaacctcgtcttgagccttaatagtcagtagtatttgtgagtcagctctgttacaacgtttgatacattttgttcgcttttgtttctataaagacaaagttgccaatttaaagacatatatgatgattggtttttggattgatgcttcacttttgctttattgattaaccaatacagaacttgaaagtaagggaaaatgagttgaat

SEQ ID NO: 1486 - DNA, 732 bp, Thellungiella halophila
aatcggccatcacgataacagagagagagctcgtggttcaaatcggccatcacgtagtctcttctccgtcagttcttctgtttggccgtcatggtgaagtactcgcaagaacccgacaattccaccaaatcttgcaaggcgaggggagccgatctcagggtccacttcaagaacactagggagacagcgcatgccataagaaagctaccattgaacaaggccaaaaggtacttggaagatgtgatagctcacaagcaagctatccccttcacacgtttctgtcgtggtgtgggtcgtactgctcaggcgaagaacaggcattcaaacggtcaaggtcgctggcctgctaaatccgctcagttcgttcttgatcttctcaagaacgctgagagcaatgctgaggtgaaaggtttggacgtcgatgccctcttcatttcacacatccaagtgaaccaagcagcaaaacagagacggaggacatatcgtgctcatggaagaatcaatccttacatgtcaaacccatgccacattgagttgattctgtcagagaaggaagagcctgtgaagaaagtgcccgagactcagcttgcagccaagtcaaagaaaggaacctcgtcttgagccttaatagtcagtagtatttgtgagtcagctctgttacaacgtttgatacattttgttcgcttttgtttctataaagacaaagttgccaatttaaagacatatatgatg

SEQ ID NO: 1487 - DNA, 851 bp, Trigonella foenum-graecum
cctatcccctgtgtgccttgcctagttgcgtgtctcagcggccgggggtttcttctcagcctccttccctcattccttacgaattaccagagcagccatggtgaagtactccagagagcccgacaatcccaccaaatcgacaaaagcccgtggtgctgaccttagggttcatttcaagaacaccagggaaacagcgtttgccatcaggaagttgcccctgatcaaagccaaaagatacttggaagatgttttggcccacaaacaggccattcctttcagacgcttttgtcgtggtgttgggaggactgcccaagctaagaacagacattctaatgggcaaggacgctggcctgtcaagtcagctaaatttattcttgacttgcttaagaatgctgagagtaatgctgaggtgaaaggtttggatgtggatgctctctacgtgtctcatatccaagtcaatcagagtcagcgtcaacgtagacgcacctatagggctcatggaagaatcaatccctacatgtcatctccgtgtcacattgagctgatattatccgagaaggaagaggctgtccagaaagagcccgagacccagttggcaacaaacaagaagaagtctcaagctctttgaagtggtgcttcatcataaattgttatttgagataatagttgaggccctttatttctagattatgtcagttttgttgcactttctcagttatgtttattatgagctgtttttaaagtttgagcagcagtttttgtttcgtattcaactatggtttatgttaattgacttgcttggaaaattttatggtggtaattgcatgattgattcaattttatttataccc

SEQ ID NO: 1488 - DNA, 775 bp, Tripterygium wilfordii
ctctctggctgcgctctatctttggctcgggatcgagaatttgcagaagcggcagtcatggtgaagtactcgagggagccaagcaatcctaccaagtcctgcaaagccaggggcagtgatcttcgggttcattttaagaatactagagagaccgcccatgctattaggaagttggccttggtgaaggctaaaagctacttggaggatgtgattgtccataagcaagctattccctttaggcgtttctgtcgcggtgtgggccgaactgctcaggcgaagaaccgtcactcaaatggacaaggacgctggcctatgaagtctgctaagtttattcttgatttgctcaagaatgctgagagcaatgctgaggtgaaaggtttggatgtggatgctctttatgtttctcacatccaagtaaatcaagcacagaagcaaaggcgacggacctacagagcacatgggcggatcaacccatacatgtcttccccttgccacattgaattgactctgtcggagaaggaagaatctgttaagaaagagcctgagactcagttggctccaaggaaggttaaaggtcaagctcttcgcagtggtgcatcctcttaaacggctgtggagttctagattgattcaagagtaggccacatcatatgaaatttccagctttccttgtttgttaaaatactctgaacttgagttttcatcatgggatgctcatgaattttggatgttatgctattataactgatttaaatctttaatgatctgttaaaca

SEQ ID NO: 1489 - DNA, 781 bp, Tripterygium wilfordii
cggaaaccctcgctgccgccgccatggtgaagtactcgaaagagcctgacaatcccaccaagtcttgcaaggctagaggctctgatcttcgagttcatttcaagaatacaagggagacagcttttgcgataagaaaattgcctttggtcaaggctaaaagatacttggaagatgtgactgtccataaacaggctattcccttccgacgcttctgtcgtggtgtgggacgtactgctcaggccaagaacaggcactcaaatggacagggacgctggcctctcaaatctgcgaagtttattctagatttgctgaagaatgctgagagcaatgctgaagtgaagggtttggatgtagattcactctacatctctcacatccaagttaatcaggcccaaaagcaacgtcgccgtacctatcgtgcacatggaagaattaacccttatatgtcttcaccatgtcatattgagttaactctgtctgagaaggaggaacctgtgaaaaaggagcctgagacccagctgacaacaagcaaatcaaagaagagtcaagccttgcgcagtggtgcttcttcttaagtactcattgcgtagcacattaaggagtgttttgtagcttttcattggtgatttcaaattgaagtgaattttgttatagactgagtttttattaagaagactgcctgtttttgtttcagacaattttttgtttaatgttctatgaaagattttctttgggaaatcggatgtggacatgcattttggagtttcatgtatacattagt

SEQ ID NO: 1490 - DNA, 913 bp, Tripterygium wilfordii
aattagggtttacattttatttaagcacccctcgctacgcctcctccagcttcagattcataaaggaaggaggaggcaatttagaatctctccaagcagccatggtgaagtactcgaaagagccagacaatcccaccaagtcttgcaaggctcgaggctctgatcttcgagttcatttcaagaatacaagggagacagcgtttgcaattagaaaattgccgttggtcaaggctaagagatacttggaagatgttatgggccacaaacaggctattccctttcggcgcttctgtcgtggtgtgggacgtactgctcaggccaagaacagacactcaaatggacagggacgctggcctctcaaatctgctaaatttattctagatttgctcaagaatgctgagagcaatgctgaagtgaagggcttagatgtagattcactctacatctctcacatccaagttaatcaagctcaaaagcaacgtcgccgtacctatcgggcacatggaagaattaacccgtatatgtcttcaccatgtcatattgagttaactctgtctgagaaggaggaaccggtgaaaaaggagcctgagacccagctgacaacaagcaaatcaaagaagtctcaatccctgcgcagtggtgcttcttcttaagtcattacctgttaagcacattaaggagtgtttttgtagcttttcattggtgatttccaattgatgcgagttttgttatagaatgagtttttattcagaagaatctagactcgcttgtttgtttcaagctattttttcgtttaatgttctatgaaagattttctaaattggatcttgacatgccttttggtgtttgcacttgtgcattagttgcctggttgtgaaccattttaccttgcacaaaatcaatcttgatggac

(The sequence listing continues in the following parts.)

What is claimed is:

1. A method of increasing yield, growth rate, biomass, and/or seed yield of a plant as compared to a non-transformed plant, the method comprising expressing within the plant an exogenous polynucleotide, said exogenous polynucleotide comprising a nucleic acid sequence encoding a polypeptide comprising the amino acid sequence set forth by SEQ ID NO: 625, thereby increasing the yield, growth rate, biomass, and/or seed yield of the plant as compared to the non-transformed plant.

2. A method of producing a crop comprising growing a crop plant transformed with an exogenous polynucleotide comprising a nucleic acid sequence encoding a polypeptide comprising the amino acid sequence set forth by SEQ ID NO: 625, wherein the crop plant is derived from plants transformed with said exogenous polynucleotide and selected for increased yield, increased growth rate, increased biomass, and/or increased seed yield as compared to a wild type plant of the same species which is grown under the same growth conditions, and the crop plant having the increased yield, increased growth rate, increased biomass, and/or increased seed yield, thereby producing the crop.

3. The method of claim 1, wherein said nucleic acid sequence encoding said polypeptide is set forth by SEQ ID NO: 384, 52, 277 or an optimized nucleic acid sequence thereof.

4. The method of claim 2, wherein said nucleic acid sequence is set forth by SEQ ID NO: SEQ ID NO: 384, 52, 277 or an optimized nucleic acid sequence thereof.

5. The method of claim 2, wherein said nucleic acid sequence is set forth by SEQ ID NO: 384, 52, or 277.

6. A nucleic acid construct comprising an isolated polynucleotide comprising a nucleic acid sequence encoding a polypeptide which comprises the amino acid sequence set forth by SEQ ID NO: 625 and a promoter for directing transcription of said nucleic acid sequence in a host cell, wherein said promoter is heterologous to said nucleic acid sequence.

7. The nucleic acid construct of claim 6, wherein said nucleic acid sequence is set forth by SEQ ID NO: 384, 52, 277 or an optimized nucleic acid sequence thereof.

8. The nucleic acid construct of claim 6, wherein said nucleic acid sequence is selected from the group consisting of SEQ ID NOs: 384, 52, and 277.

9. The nucleic acid construct of claim 6, wherein said nucleic acid sequence is set forth by SEQ ID NO: 384.

10. A plant cell transformed with the nucleic acid construct of claim 6.

11. The plant cell of claim 10, wherein said plant cell forms part of a plant.

12. A transgenic plant comprising the nucleic acid construct of claim 6.

13. A method of growing a crop, the method comprising seeding seeds and/or planting plantlets of a plant transformed with the nucleic acid construct of claim 6, wherein the plant is derived from plants transformed with said exogenous polynucleotide and selected for at least one trait selected from the group consisting of: increased biomass, increased growth rate, increased yield, and increased seed yield as compared to a non-transformed plant which is grown under the same growth conditions, and growing the crop.

14. The method of claim 1, wherein said nucleic acid sequence encoding said polypeptide is set forth by SEQ ID NO: 384, 52, or 277.

15. The method of claim 1, wherein said nucleic acid sequence encoding said polypeptide is set forth by SEQ ID NO: 384.

16. The method of claim 1, further comprising selecting the plant expressing said exogenous polynucleotide for an increased trait selected from the group consisting of: leaf blade area, plot coverage, rosette area, and rosette diameter as compared to a wild type plant of the same species which is grown under the same growth conditions.

17. The method of claim 2, wherein said nucleic acid encoding said polypeptide is set forth by SEQ ID NO: 384.

18. A method of increasing leaf blade area, plot coverage, rosette area, and/or rosette diameter of a plant as compared to a wild type plant of the same species which is grown under the same growth conditions, the method comprising:
(a) expressing within the plant an exogenous polynucleotide, said exogenous polynucleotide comprising a nucleic acid sequence encoding a polypeptide comprising the amino acid sequence set forth in SEQ ID NO:625, and
(b) selecting the plant expressing said exogenous polynucleotide for an increased trait selected from the group consisting of: leaf blade area, plot coverage, rosette area, and rosette diameter as compared to a wild type plant of the same species which is grown under the same growth conditions,
thereby increasing the leaf blade area, plot coverage, rosette area, and/or rosette diameter of the plant as compared to the wild type plant of the same species which is grown under the same growth conditions.

19. The method of claim 18, wherein said nucleic acid sequence is set forth by SEQ ID NO: 384, 52, 277 or an optimized sequence thereof.

20. The method of claim 18, wherein said nucleic acid sequence is set forth by SEQ ID NO: 384.

21. A method of producing a crop comprising growing a crop plant transformed with an exogenous polynucleotide encoding a polypeptide which comprises the amino acid sequence set forth by SEQ ID NO: 625, wherein the crop plant is derived from a plant transformed with said exogenous polynucleotide and selected for increased leaf blade area, increased plot coverage, increased rosette area, and/or increased rosette diameter as compared to a wild type plant of the same species which is grown under the same growth conditions, and the crop plant having the increased leaf blade area, the increased plot coverage, the increased rosette area, and/or the increased rosette diameter, thereby producing the crop.

22. The method of claim 21, wherein said nucleic acid sequence is set forth by SEQ ID NO: 384, 52, 277 or an optimized sequence thereof.

23. The method of claim 21, wherein said nucleic acid sequence is set forth by SEQ ID NO: 384.

24. A method of generating a transgenic plant, comprising:
   (a) transforming a cell of a plant with the nucleic acid construct of claim 6,
   (b) generating a mature plant from said cell of said plant transformed with said nucleic acid construct,
   thereby generating the transgenic plant.

* * * * *